United States Patent
Zhang et al.

(10) Patent No.: US 12,281,301 B2
(45) Date of Patent: Apr. 22, 2025

(54) SEQUENCING-BASED PROTEOMICS

(71) Applicants: THE BROAD INSTITUTE, INC., Cambridge, MA (US); MASSACHUSETTS INSTITUTE OF TECHNOLOGY, Cambridge, MA (US)

(72) Inventors: Feng Zhang, Cambridge, MA (US); Jonathan Leo Schmid-Burgk, Cambridge, MA (US); Veit Hornung, Cambridge, MA (US)

(73) Assignees: THE BROAD INSTITUTE, INC., Cambridge, MA (US); MASSACHUSETTS INSTITUTE OF TECHNOLOGY, Cambridge, MA (US)

( * ) Notice: Subject to any disclaimer, the term of this patent is extended or adjusted under 35 U.S.C. 154(b) by 1069 days.

(21) Appl. No.: 17/048,369

(22) PCT Filed: Apr. 26, 2019

(86) PCT No.: PCT/US2019/029488
§ 371 (c)(1),
(2) Date: Oct. 16, 2020

(87) PCT Pub. No.: WO2019/210268
PCT Pub. Date: Oct. 31, 2019

(65) Prior Publication Data
US 2021/0147831 A1    May 20, 2021

Related U.S. Application Data

(60) Provisional application No. 62/663,712, filed on Apr. 27, 2018, provisional application No. 62/751,314, filed on Oct. 26, 2018.

(51) Int. Cl.
C40B 30/04 (2006.01)
C12N 9/22 (2006.01)
(Continued)

(52) U.S. Cl.
CPC .......... *C12N 15/1065* (2013.01); *C12N 9/22* (2013.01); *C12N 15/65* (2013.01); *C12N 2310/20* (2017.05)

(58) Field of Classification Search
None
See application file for complete search history.

(56) References Cited

FOREIGN PATENT DOCUMENTS

JP    2018-042503 A    3/2018
WO    2016/149422 A1    9/2016

OTHER PUBLICATIONS

Roberts et al., Systematic Gene-Tagging Using CRISPR/Cas9 in Human Stem Cells to Illuminate Cell Organization, 2017, Molecular Biology of the Cell, vol. 28, 2854-2874 (Year: 2017).*

(Continued)

*Primary Examiner* — Christian C Boesen
(74) *Attorney, Agent, or Firm* — F. Brent Nix, Esq.; Johnson, Marcou, Isaacs & Nix, LLC; Erin M. Daly, Esq.

(57) ABSTRACT

The invention provides a cell library for use in detecting protein expression comprising a plurality of cells, wherein each cell comprises a polynucleotide sequence encoding a detectable marker integrated into the genome of the cell in frame with a protein coding gene selected from a set of target genes, wherein the library comprises more than one cell tagged at each target gene, as well as a cell library for use in detecting protein interactions between a protein of interest and a set of target proteins and a cell library for use in detecting protein modifications. The invention also provides methods of constructing a cell library for use in proteomics, as well as methods for sequencing integration sites of a (Continued)

donor sequence inserted into the genome of a cell. Also provided are systems for analysis of proteins in a cell and kits comprising vectors for tagging a population of cells and for performing proteomics studies.

17 Claims, 75 Drawing Sheets

Specification includes a Sequence Listing.

(51) Int. Cl.
    *C12N 15/10*     (2006.01)
    *C12N 15/65*     (2006.01)

(56) References Cited

OTHER PUBLICATIONS

"International Preliminary Report on Patentability issued in International Application No. PCT/US2019/029488", mailed on Nov. 5, 2020, 17 pages.
"International Search Report and Written Opinion issued in International Application No. PCT/US2019/029488", mailed on Mar. 25, 2020, 28 pages.
"Invitation to Pay Additional Fees issued in International Application No. PCT/US2019/029488", mailed on Jan. 31, 2020, 13 pages.
Auer, et al., "Highly Efficient CRISPR/Cas9-Mediated Knock-in In Zebrafish by Homology-Independent DNA Repair", Genome Research, vol. 24, Oct. 31, 2013, 142-153.
Cohen, et al., "Dynamic Proteomics of Individual Cancer Cells in Response to a Drug", Science, vol. 322, Dec. 5, 2008, 1511-1516.
Cristea, et al., "In Vivo Cleavage of Transgene Donors Promotes Nuclease-Mediated Targeted Integration", Biotechnology and Bioengineering, vol. 110, No. 3, Mar. 2013, 871-880.
Dewari, et al., "An Efficient and Scalable Pipeline for Epitope Tagging in Mammalian Stem Cells Using Cas9 Ribonucleoprotein", eLife, vol. 7, No. e35069, Apr. 11, 2018, 29 pages.
Dixon, et al., "NanoLuc Complementation Reporter Optimized for Accurate Measurement of Protein Interactions in Cells", ACS Chemical Biology, vol. 11, 2016, 400-408.
Feldman, et al., "Pooled Optical Screens in Human Cells", bioRxiv, Retrieved via: http://dx.doi.org/10.1101/383943, Aug. 2, 2018, 23 pages.
Harikumar, et al., "An Endogenously Tagged Fluorescent Fusion Protein Library in Mouse Embryonic Stem Cells", Stem Cell Reports, vol. 9, Oct. 10, 2017, 1304-1314.
Huh, et al., "Global Analysis of Protein Localization in Budding Yeast", Nature, vol. 425, Oct. 16, 2003, 686-691.
Lackner, et al., "A Generic Strategy for CRISPR-Cas9-Mediated Gene Tagging", Nature Communications, vol. 6, No. 10237, Dec. 17, 2015, 7 pages.
Leonetti, et al., "A Scalable Strategy for High-Throughput GFP Tagging of Endogenous Human Proteins", Proceedings of the National Academy of Sciences, vol. 113, No. 25, Jun. 6, 2016, E3501-E3508.
Maresca, et al., "Obligate Ligation-Gated Recombination (ObLiGaRe): Custom-designed Nuclease-mediated Targeted Integration through Nonhomologous End Joining", Genome Research, vol. 23, 2013, 539-546.
Roberts, et al., "Systematic Gene Tagging Using CRISPR/Cas9 in Human Stem Cells to Illuminate Cell Organization", Molecular Biology of the Cell, vol. 28, Oct. 15, 2017, 2854-2874.
Schmid-Burgk, et al., "CRISpaint Allows Modular Base-Specific Gene Tagging Using a Ligase-4-Dependent Mechanism", Nature Communications, vol. 7, No. 12338, Jul. 28, 2016, 12 pages.
Schwinn, et al., "CRISPR-Mediated Tagging of Endogenous Proteins with a Luminescent Peptide", ACS Chemical Biology, vol. 13, 2018, 467-474.
Sigal, et al., "Generation of a Fluorescently Labeled Endogenous Protein Library in Living Human Cells", Nature Protocols, vol. 2, No. 6, 2007, 1515-1527.
Tsai, et al., "Guide-seq Enables Genome-wide Profiling of Off-target Cleavage by Crispr-cas Nucleases", Nature Biotechnology, vol. 33, No. 2, Feb. 2015, 187-197.

* cited by examiner

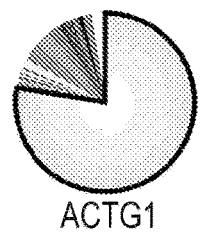
ACTG1
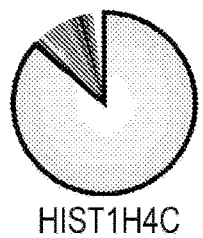
HIST1H4C
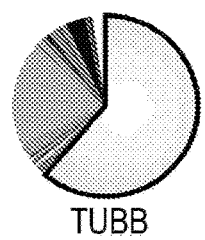
TUBB
☐ mNeon seamless integration  ▨ Frame +0  ▨ Frame +1  ■ Frame +2
FIG. 4

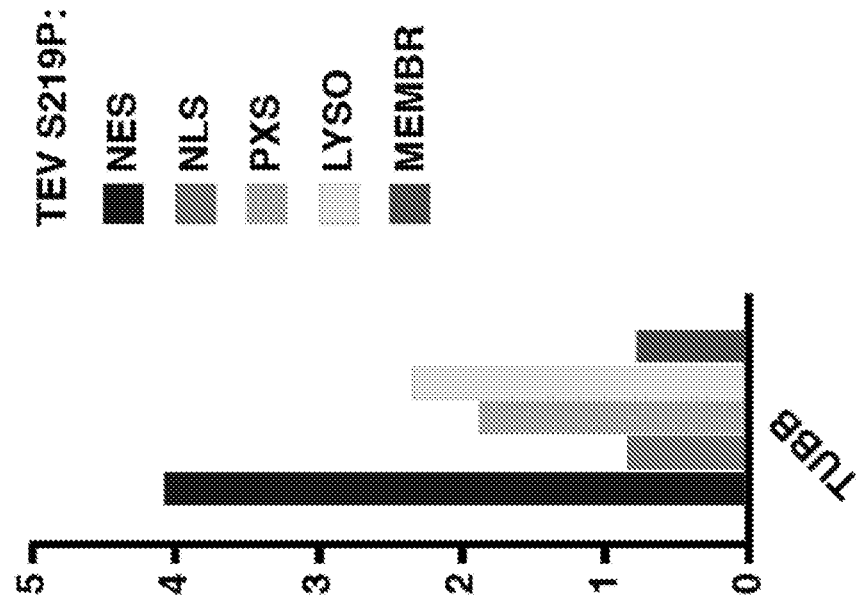
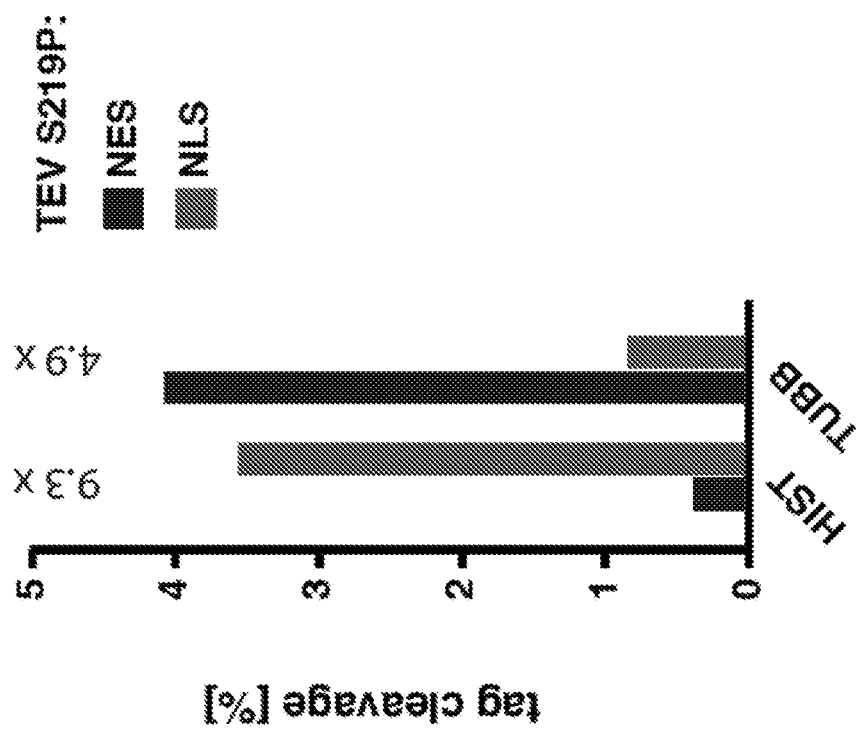
FIG. 16

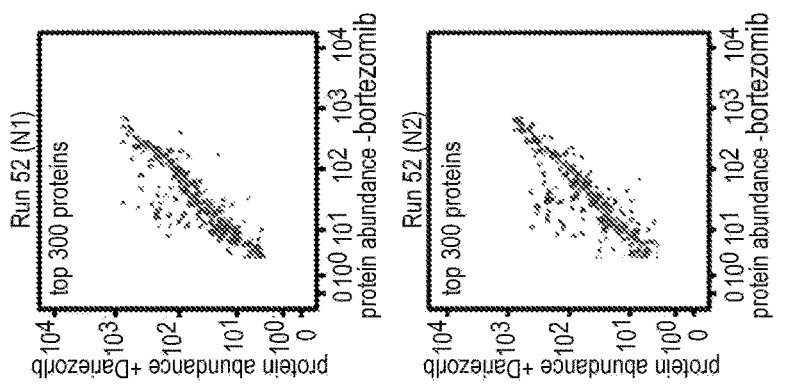
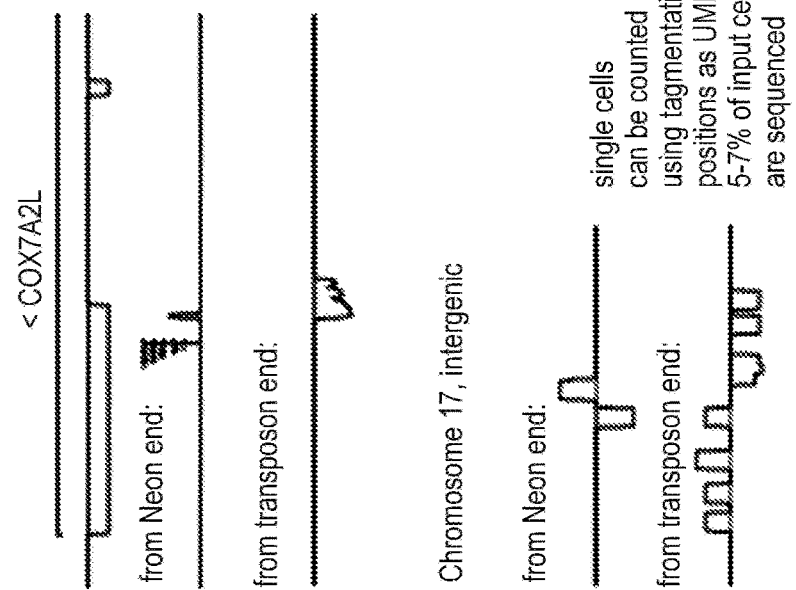
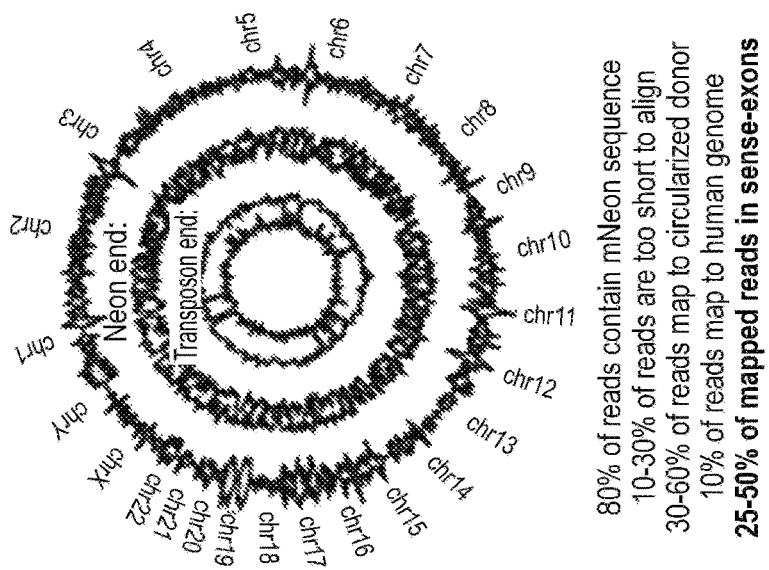
FIG. 20

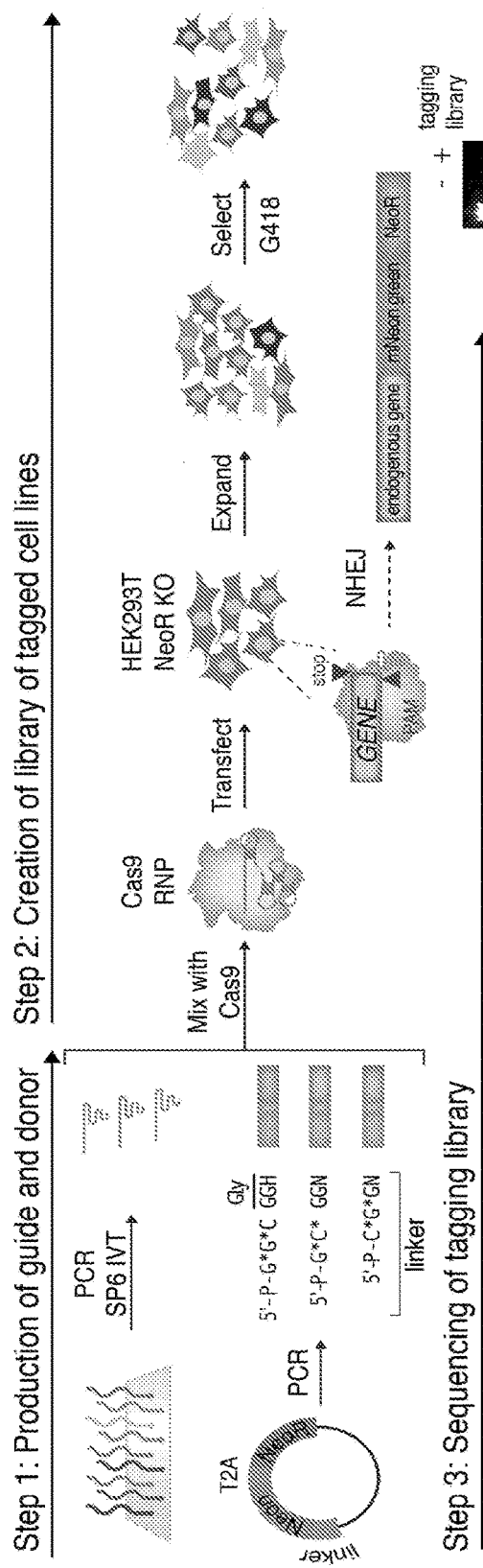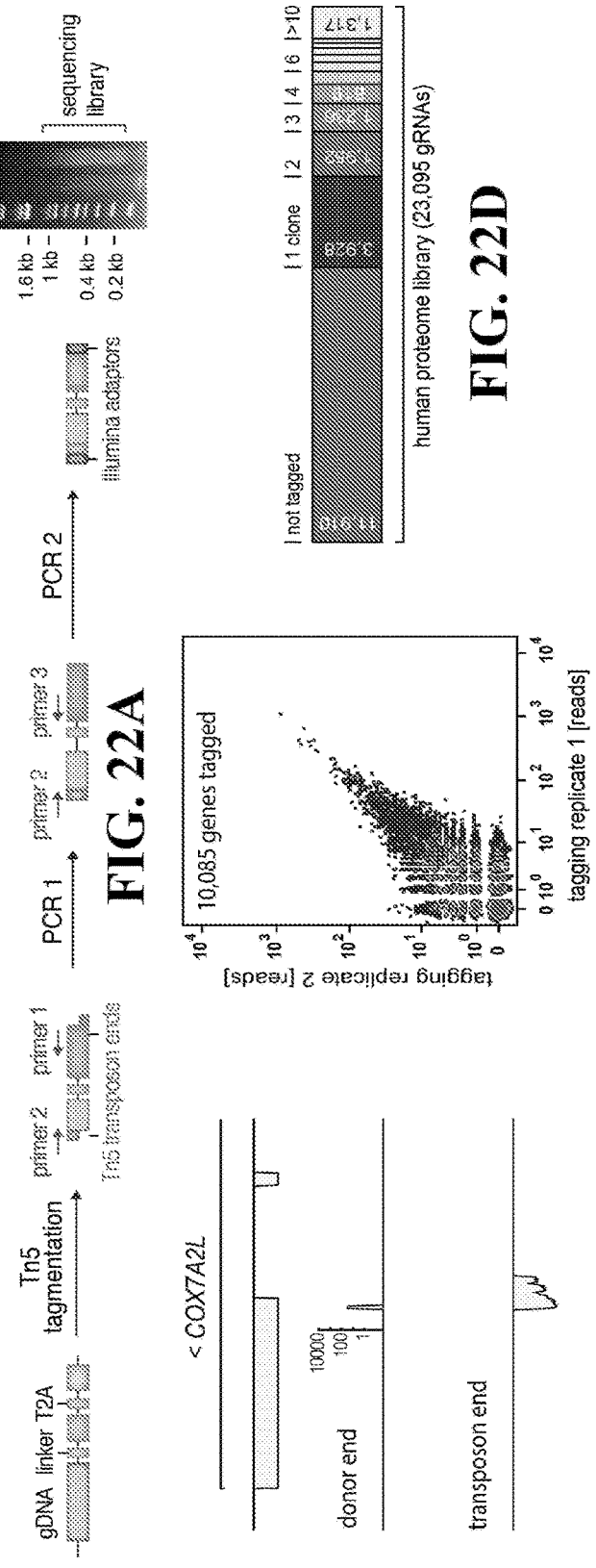
FIG. 22A
FIG. 22B
FIG. 22C
FIG. 22D

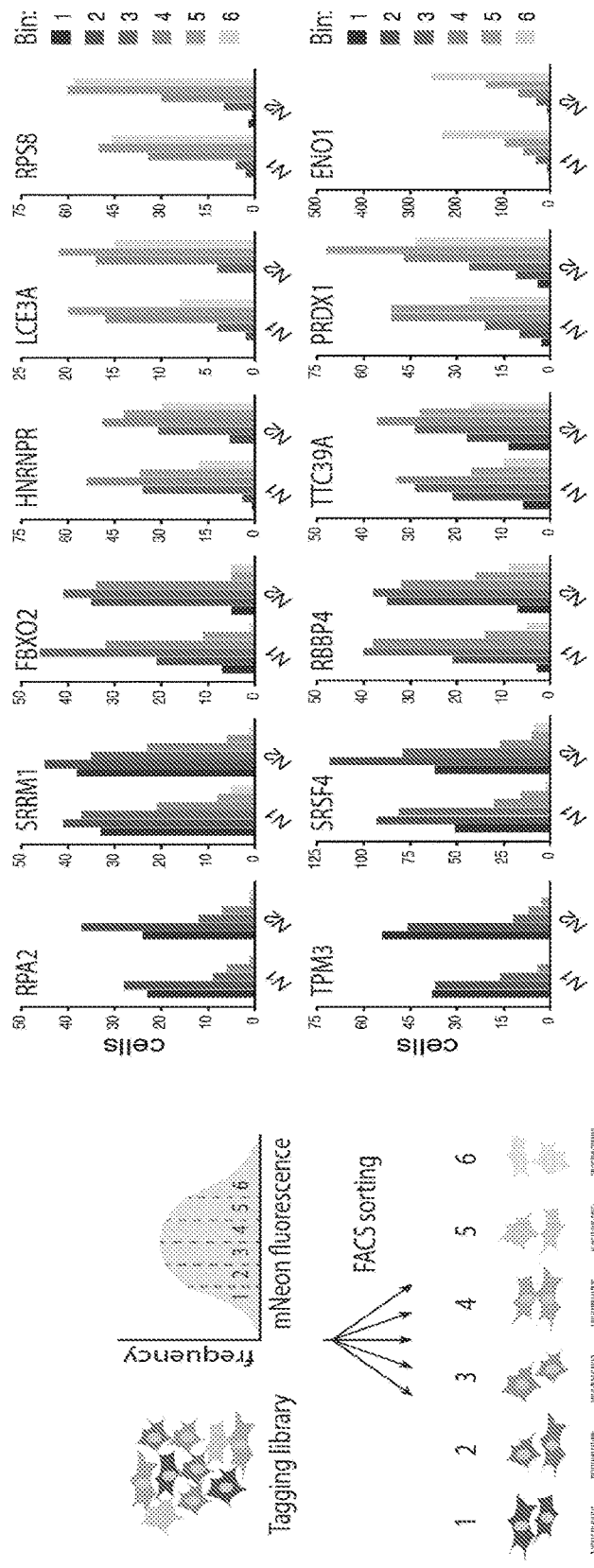
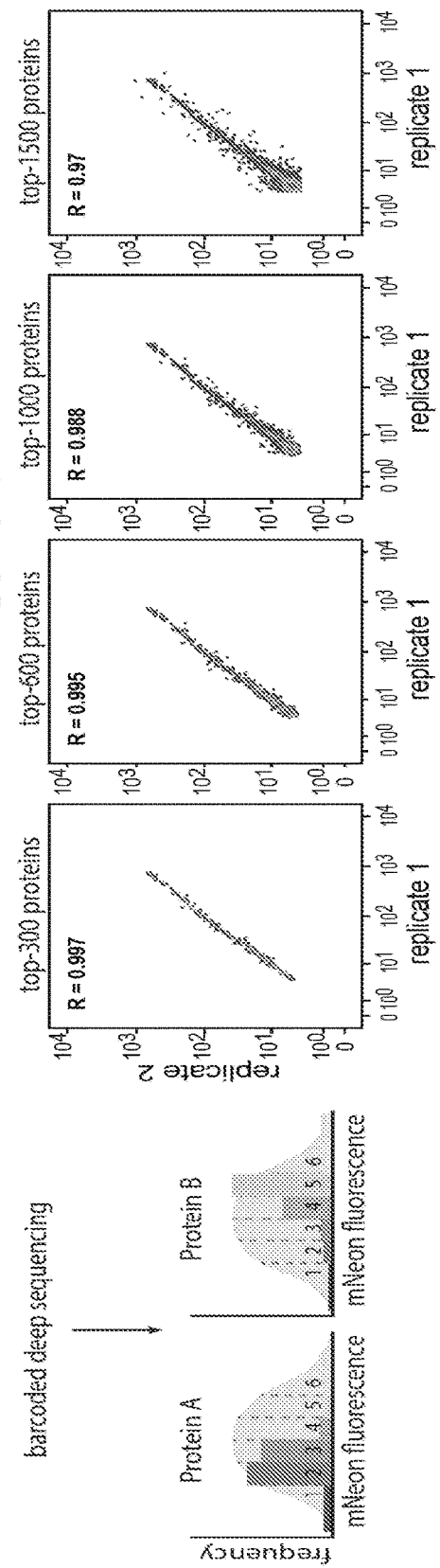
FIG. 23B
FIG. 23C
FIG. 23A

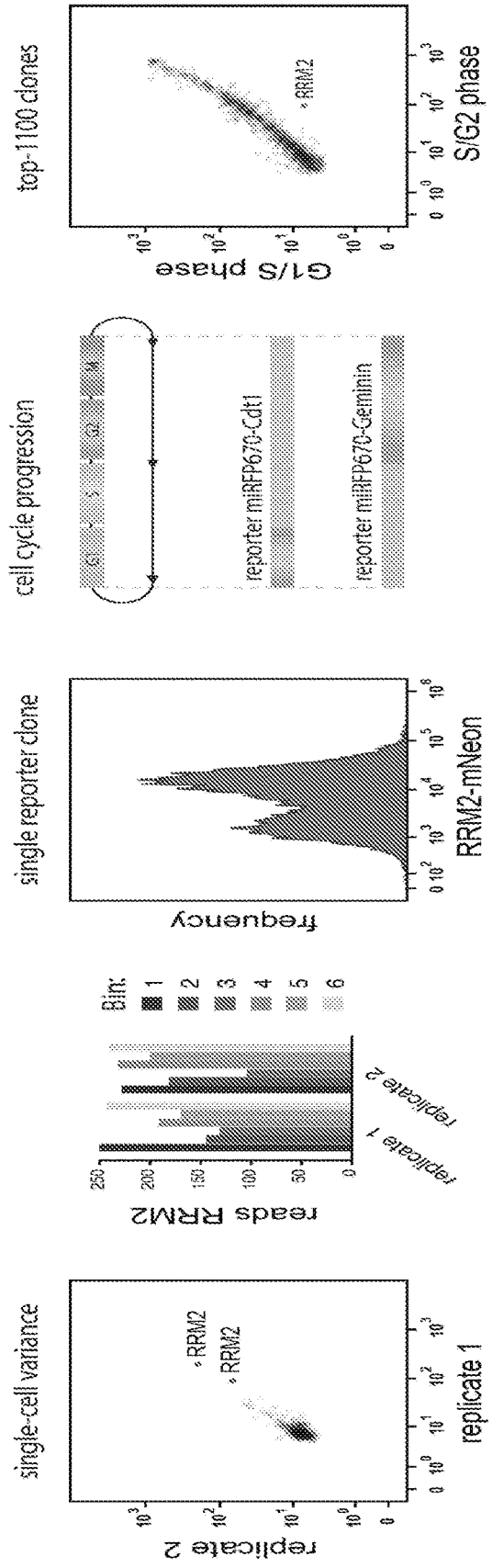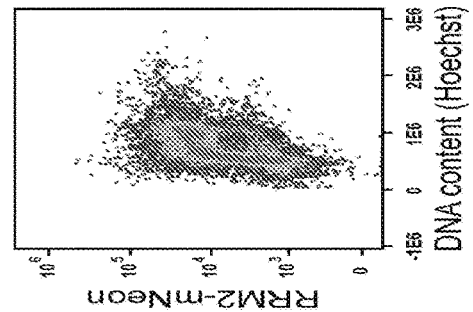
FIG. 23H
FIG. 23G
FIG. 23F
FIG. 23E
FIG. 23D
FIG. 23J
FIG. 23I

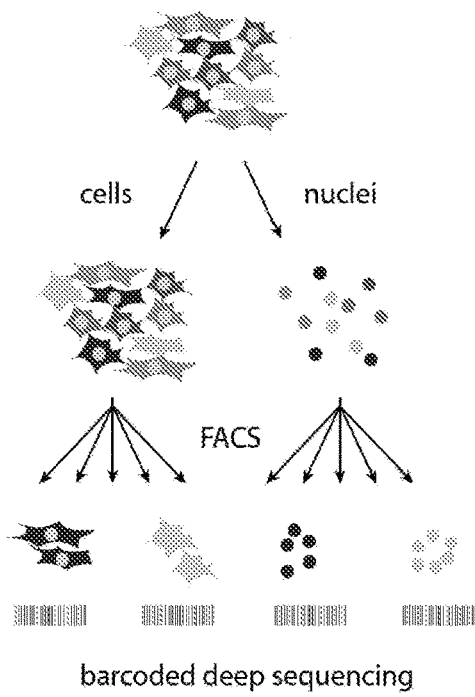

FIG. 25A

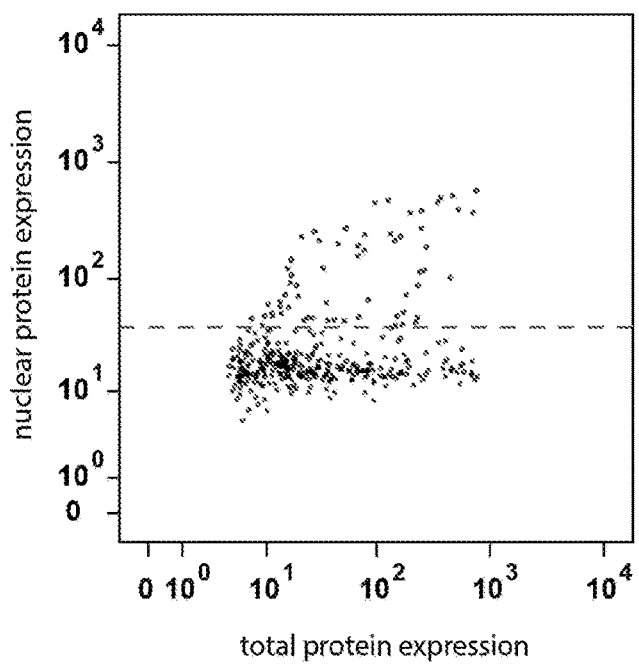

FIG. 25B

| Protein | Confocal | Literature | Protein | Confocal | Literature |
|---|---|---|---|---|---|
| ADAR | Nuclear | Nuclear/Cyto | RPS17 | Nuclear/Cyto | Nuclear/Cyto |
| BRD2 | n/d | Nuclear/Cyto | RPS4X | Nuclear/Cyto | Cytoplasmic |
| BRIX1 | n/d | Nuclear | RPS5 | n/d | Nuclear/Cyto |
| CCER1 | n/d | n/d | RPS8 | Nuclear/Cyto | Nuclear/Cyto |
| CDV3 | n/d | Nuclear/Cyto | SF3B5 | n/d | Nuclear |
| CHERP | Nuclear | Nuclear/Cyto | SNRNP200 | n/d | Nuclear |
| DDX39B | n/d | Nuclear | SNRNP70 | Nuclear | Nuclear |
| DHX15 | n/d | Nuclear | SNRPB | n/d | Nuclear |
| DHX9 | Nuclear | Nuclear/Cyto | SNRPD3 | n/d | Nuclear/Cyto |
| EIF3A | n/d | Nuclear/Cyto | SNRPF | n/d | Nuclear/Cyto |
| H2AFZ | n/d | Nuclear | SNRPG | n/d | Nuclear |
| HNRNPR | Nuclear | Nuclear | SOX9 | n/d | Nuclear |
| HOXD13 | n/d | Nuclear | SRRM1 | n/d | Nuclear |
| IFITM3 | n/d | Cytoplasmic | SRRM2 | n/d | Nuclear |
| ILF3 | n/d | Nuclear/Cyto | SRSF2 | n/d | Nuclear/Cyto |
| MATR3 | Nuclear | Nuclear | SRSF3 | n/d | Nuclear |
| MFAP1 | n/d | Nuclear/Cyto | SRSF4 | n/d | Nuclear |
| MYBBP1A | n/d | Nuclear | SRSF5 | Nuclear | Nuclear |
| NCL | Nuclear | Nuclear | SRSF6 | Nuclear | Nuclear |
| NOP56 | Nuclear | Nuclear | SRSF7 | n/d | Nuclear |
| PARP1 | n/d | Nuclear | SSRP1 | n/d | Nuclear/Cyto |
| PMPCA | Nuclear/Cyto* | Mitochondrial | STAG2 | n/d | Nuclear/Cyto |
| PNN | n/d | Nuclear | SYNCRIP | n/d | Nuclear/Cyto |
| POLR1C | n/d | Nuclear | TRA2B | n/d | Nuclear |
| PRPF40A | n/d | Nuclear | TYMS | n/d | Nuclear |
| RACK1 | n/d | Nuclear/Cyto | U2SURP | n/d | Nuclear |
| RBBP4 | Nuclear/Cyto | Nuclear | WDR3 | n/d | Nuclear |
| RBM39 | n/d | Nuclear | WDR43 | n/d | Nuclear |
| RNPS1 | n/d | Nuclear | WNT8 | n/d | Extracellular |
| RPL10A | n/d | Nuclear/Cyto | ZC3H19 | n/d | Nuclear |
| RPL3 | Nuclear/Cyto | Nuclear/Cyto | ZSCAN16 | n/d | Nuclear |

*Passenger tag present in clone

FIG. 25C

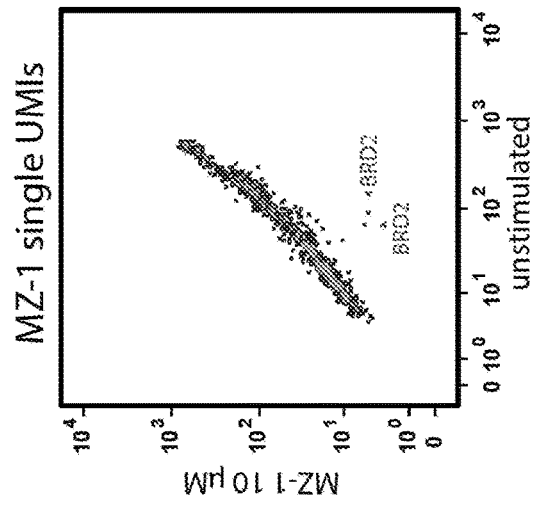
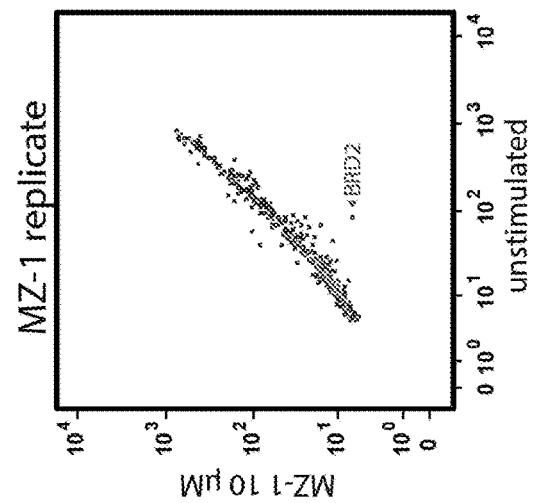
FIG. 31A
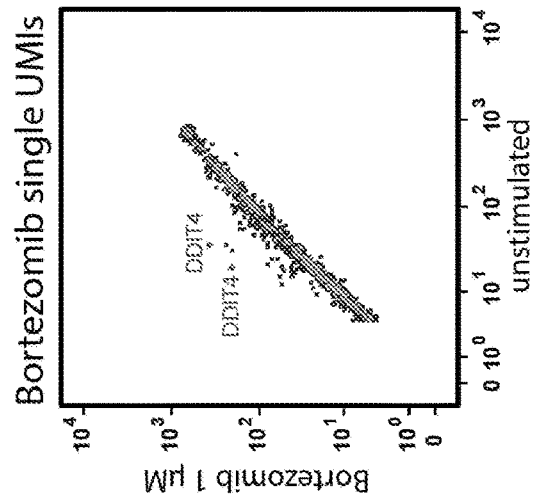
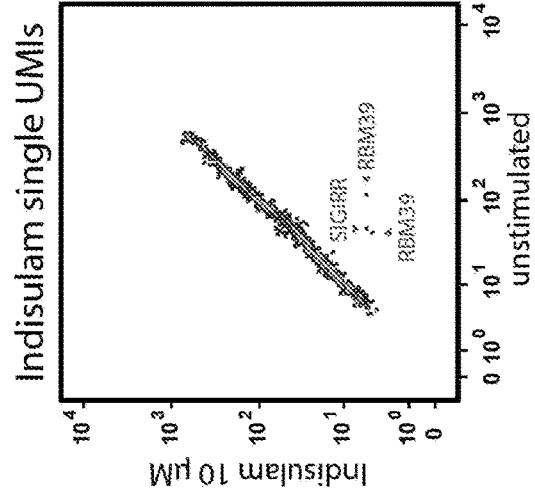
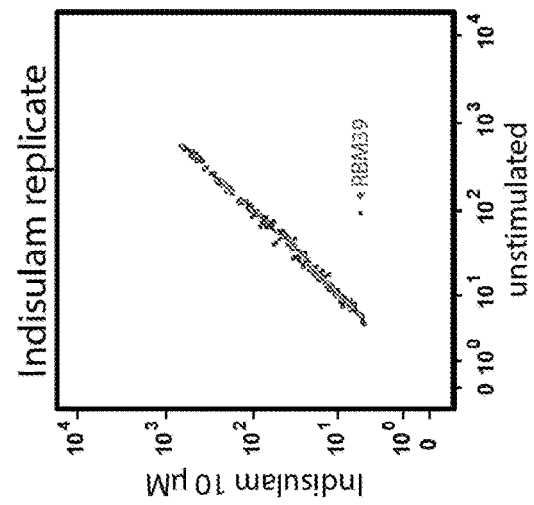
FIG. 31B

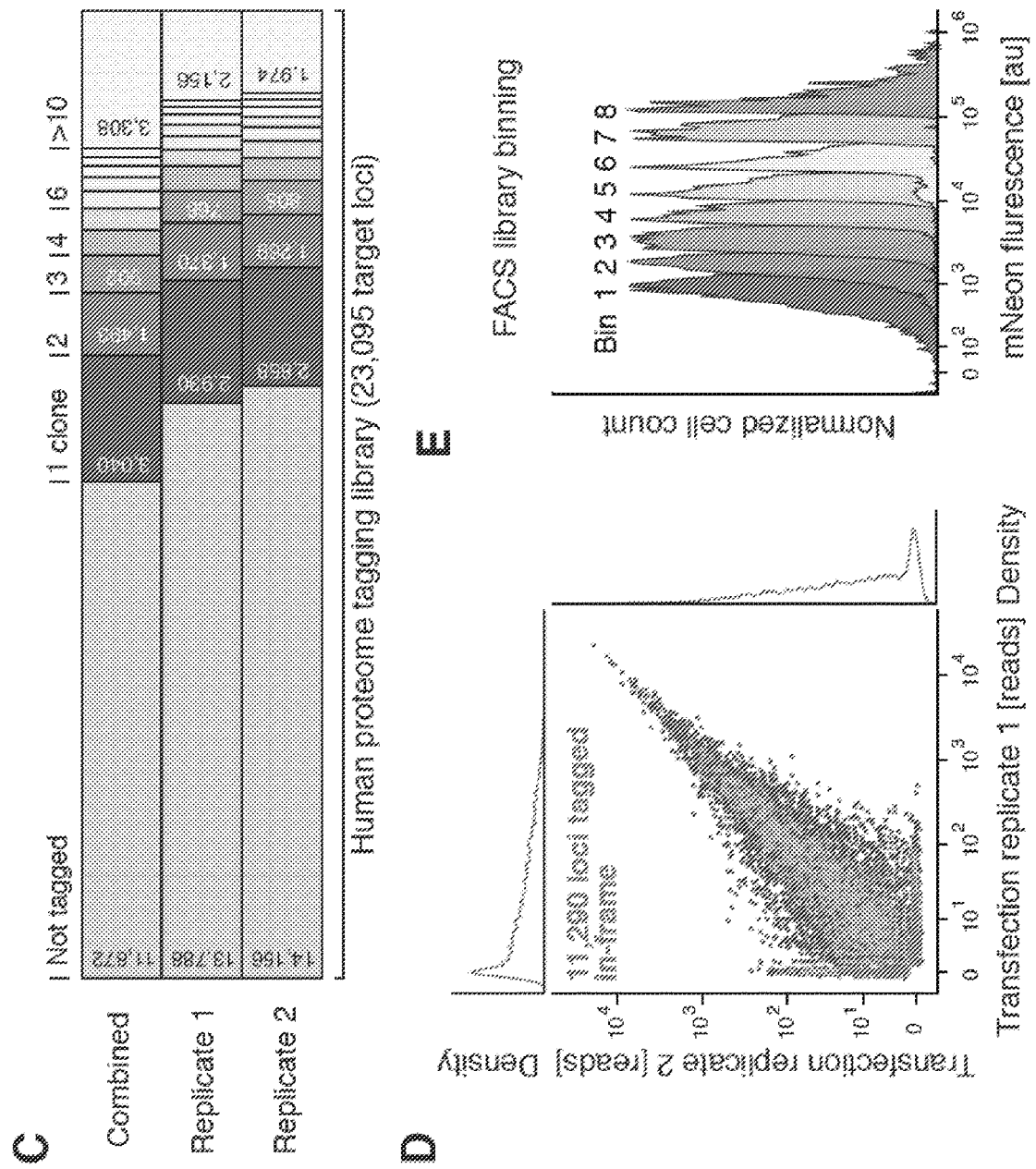
FIG. 32C-E

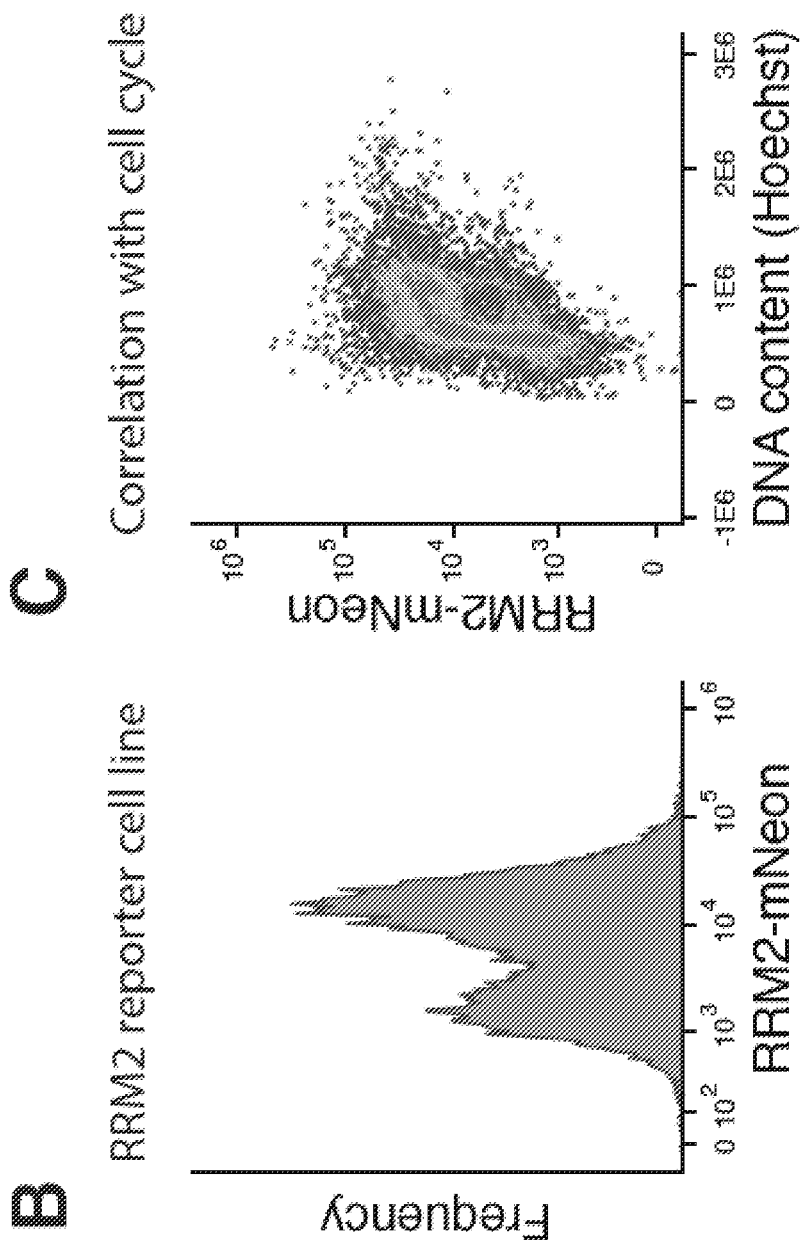
FIG. 33B-C

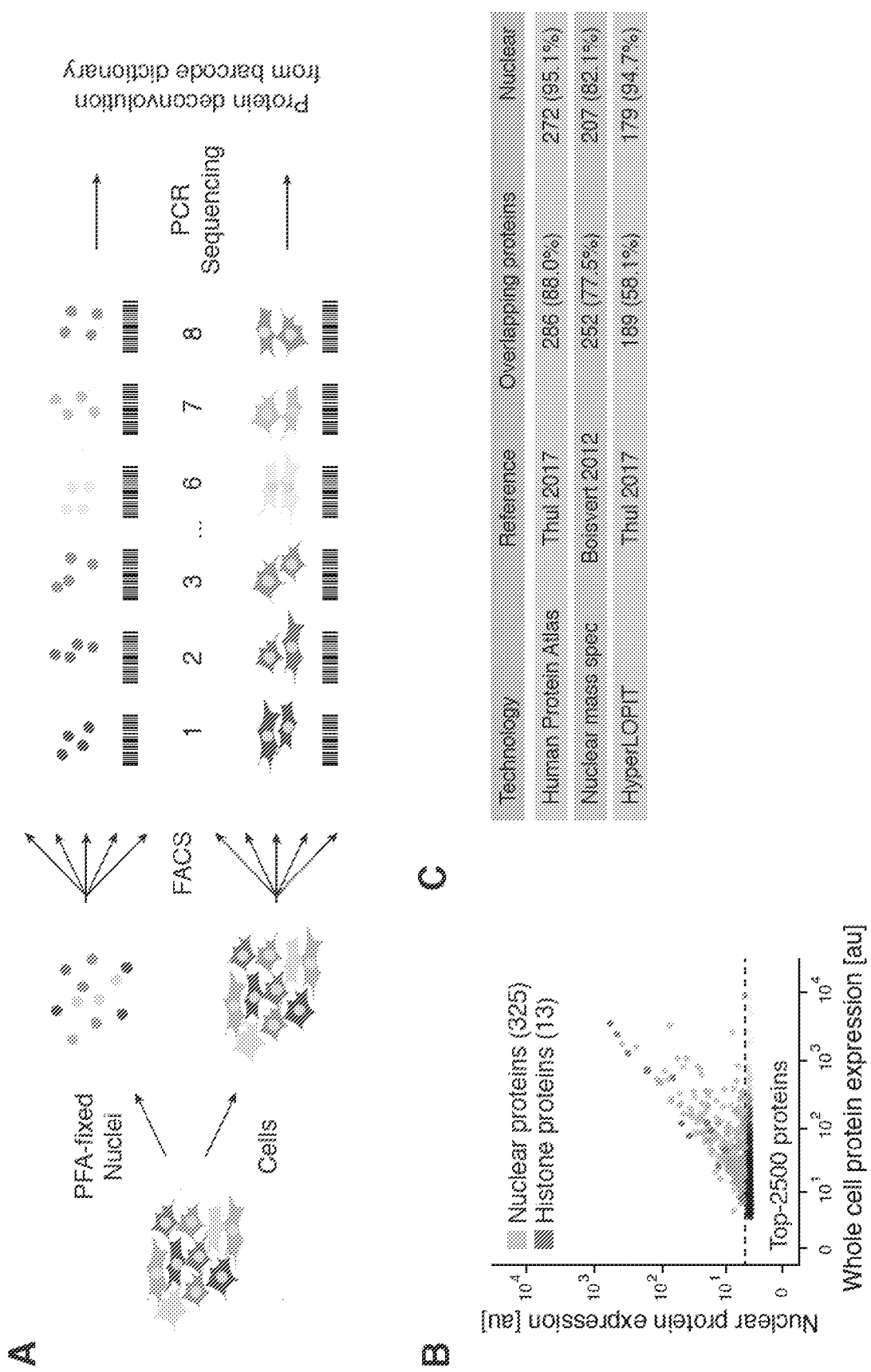
FIG. 34A-C

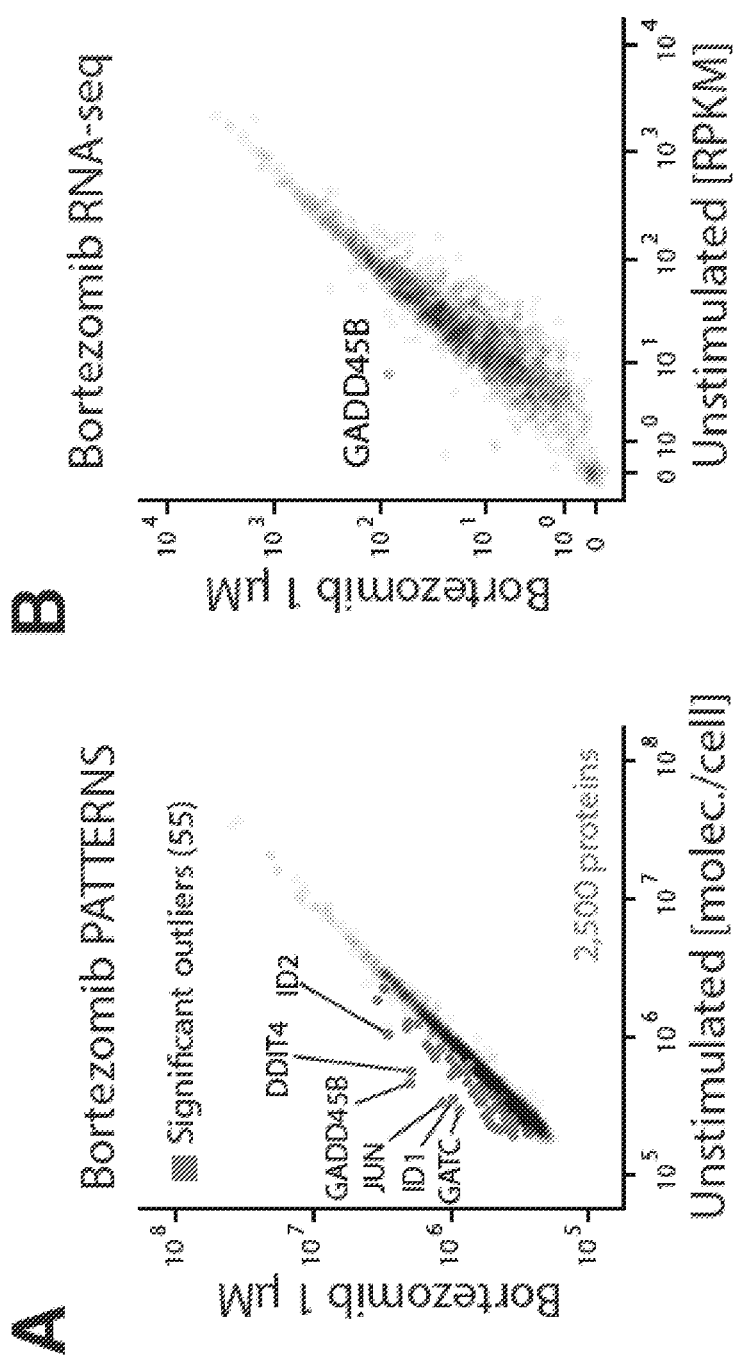
FIG. 35A-B

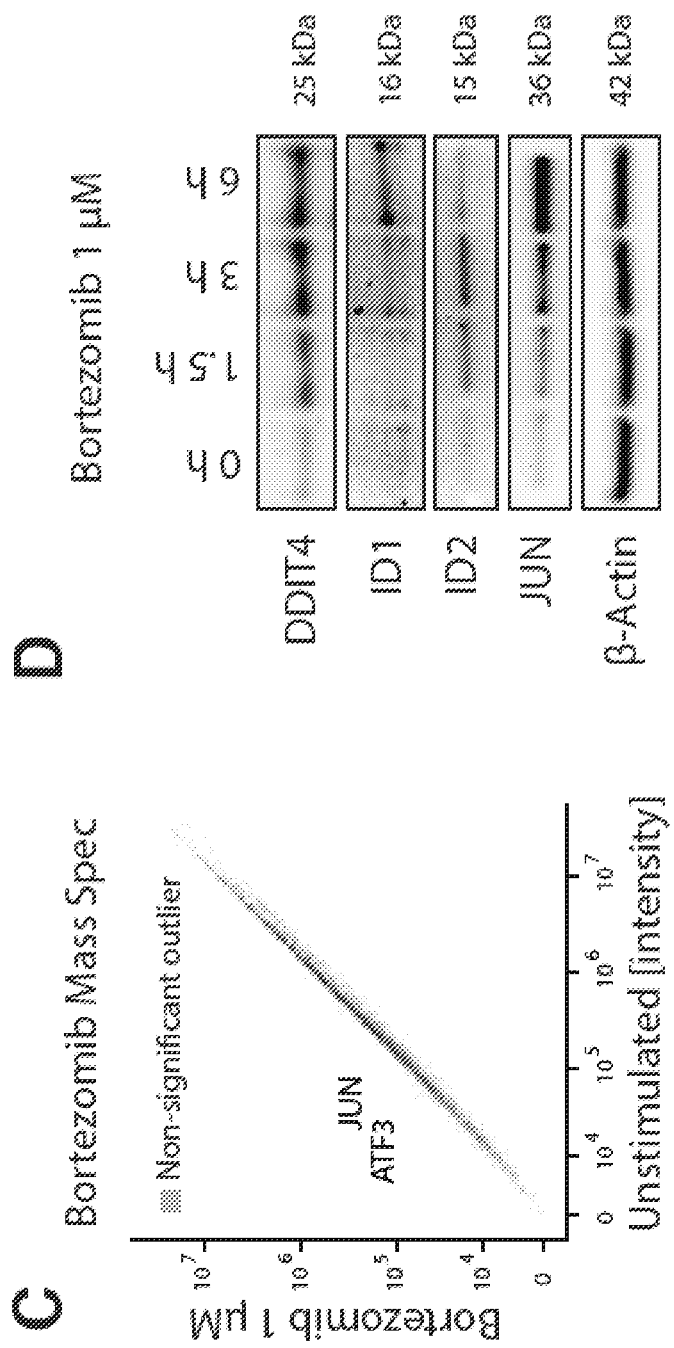
FIG. 35C-D

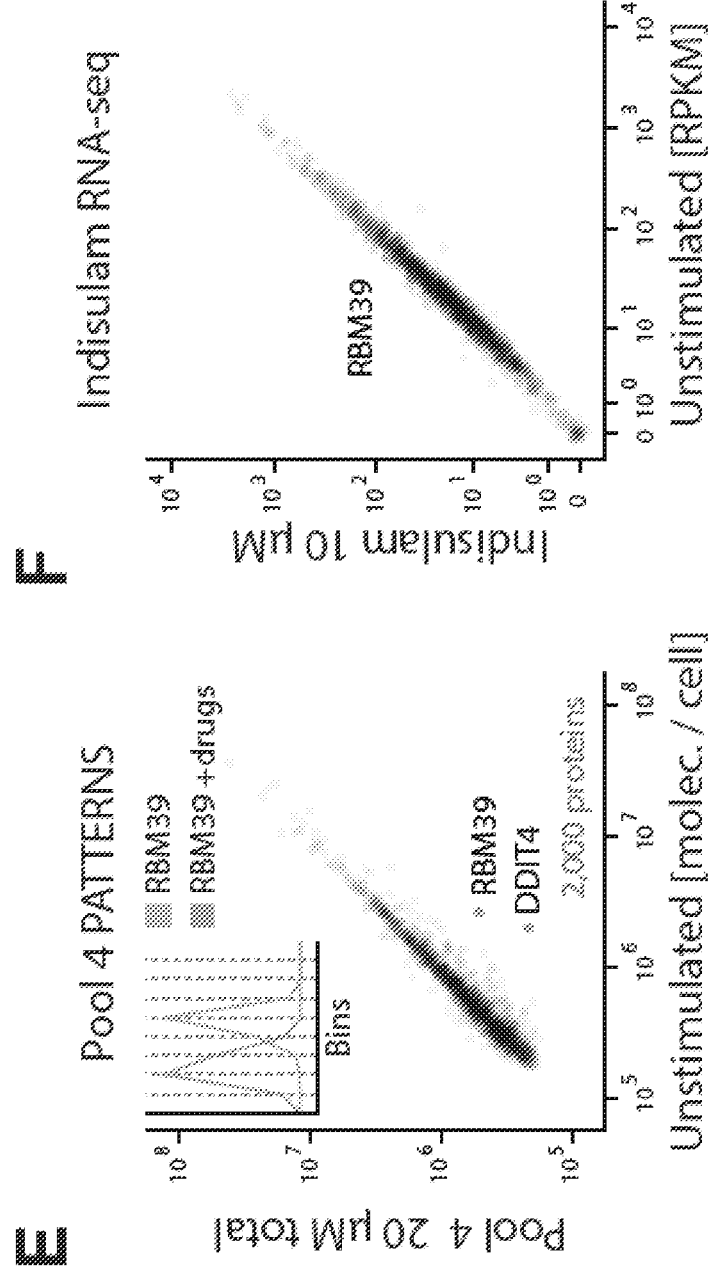
FIG. 35E-F

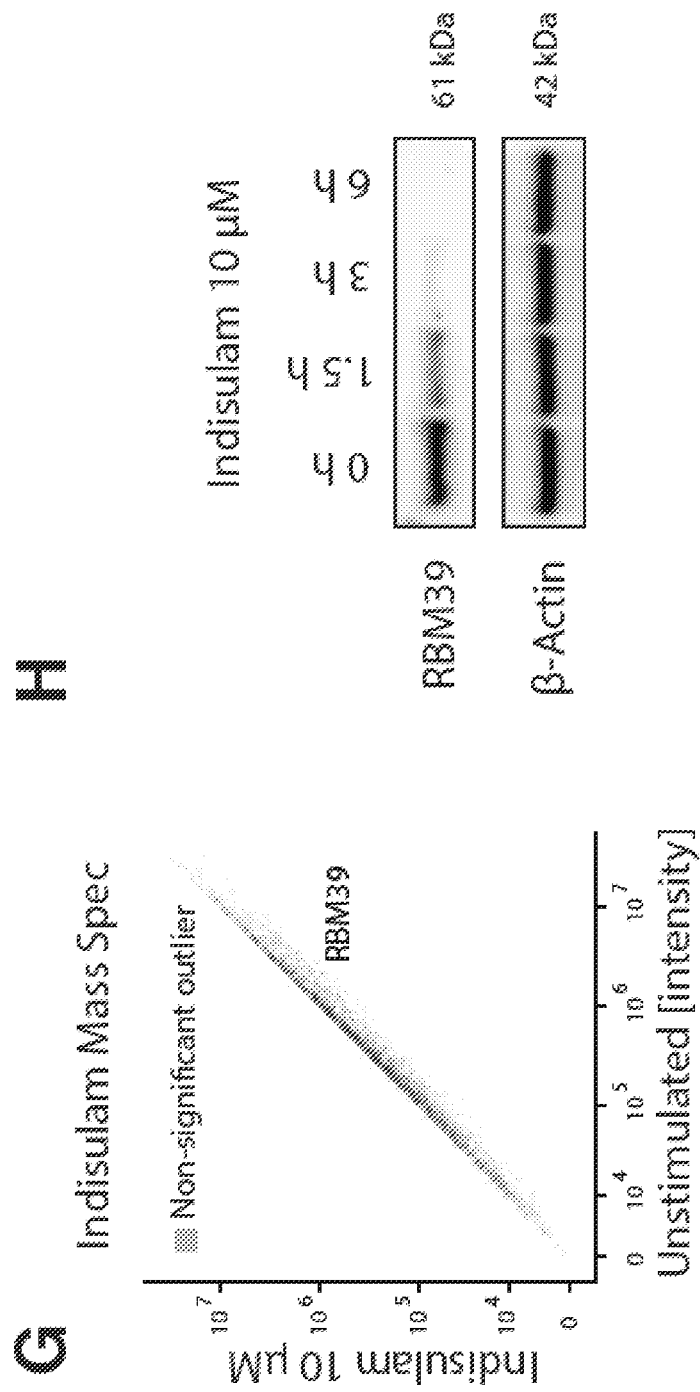
FIG. 35G-H

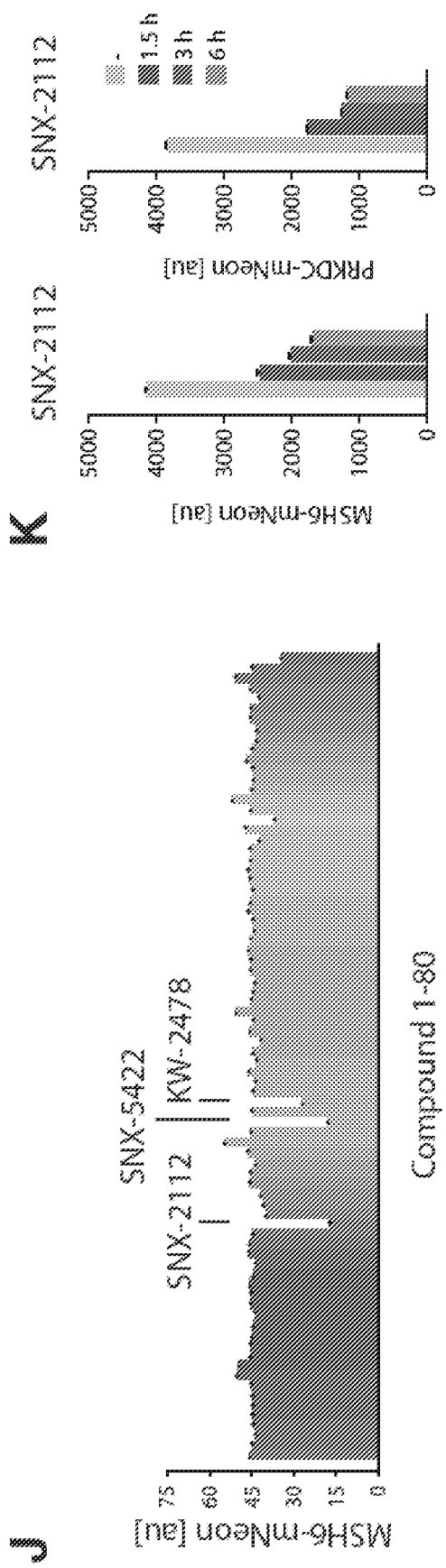
FIG. 35J-K

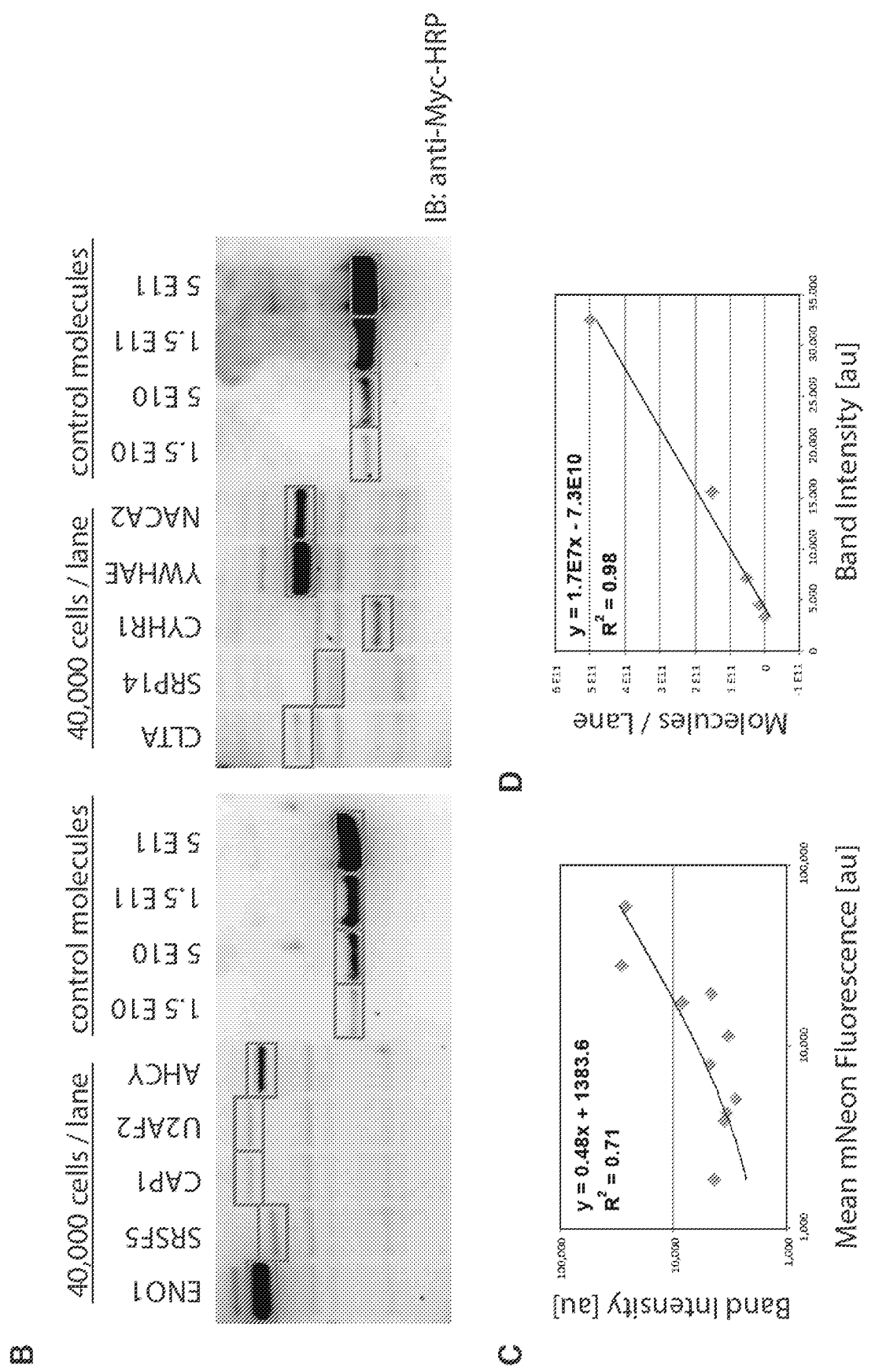
FIG. 37B-D

Estimated Molecules Per Cell = 203.8 * (Mean mNeon Fluorescence)

| Sorted Bin | Mean Fluorescence [au] | Est. Molecules/Cell |
|---|---|---|
| Bin 1 | 852.9 | 173,818 |
| Bin 2 | 1,859 | 378,820 |
| Bin 3 | 3,831 | 780,787 |
| Bin 4 | 7,598 | 1,548,533 |
| Bin 5 | 15,261 | 3,110,267 |
| Bin 6 | 30,380 | 6,191,443 |
| Bin 7 | 76,148 | 15,518,993 |
| Bin 8 | 194,285 | 39,595,198 |

FIG. 37E-F

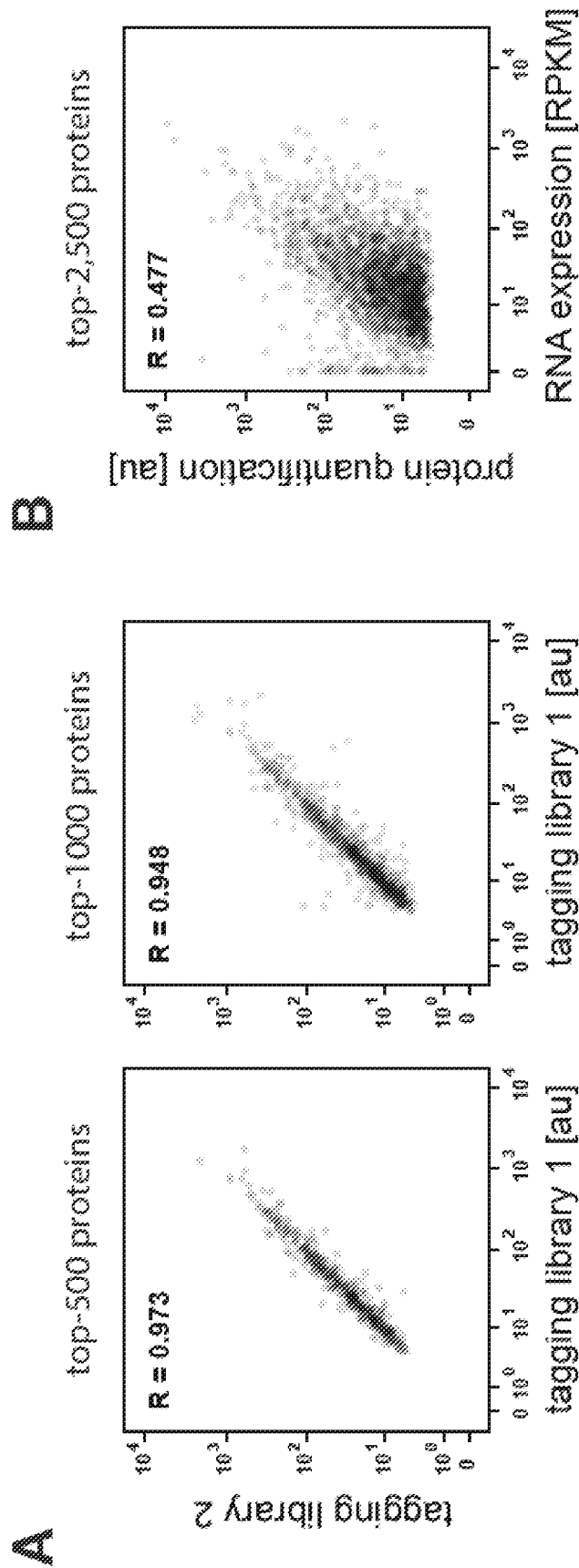
FIG. 38A-B

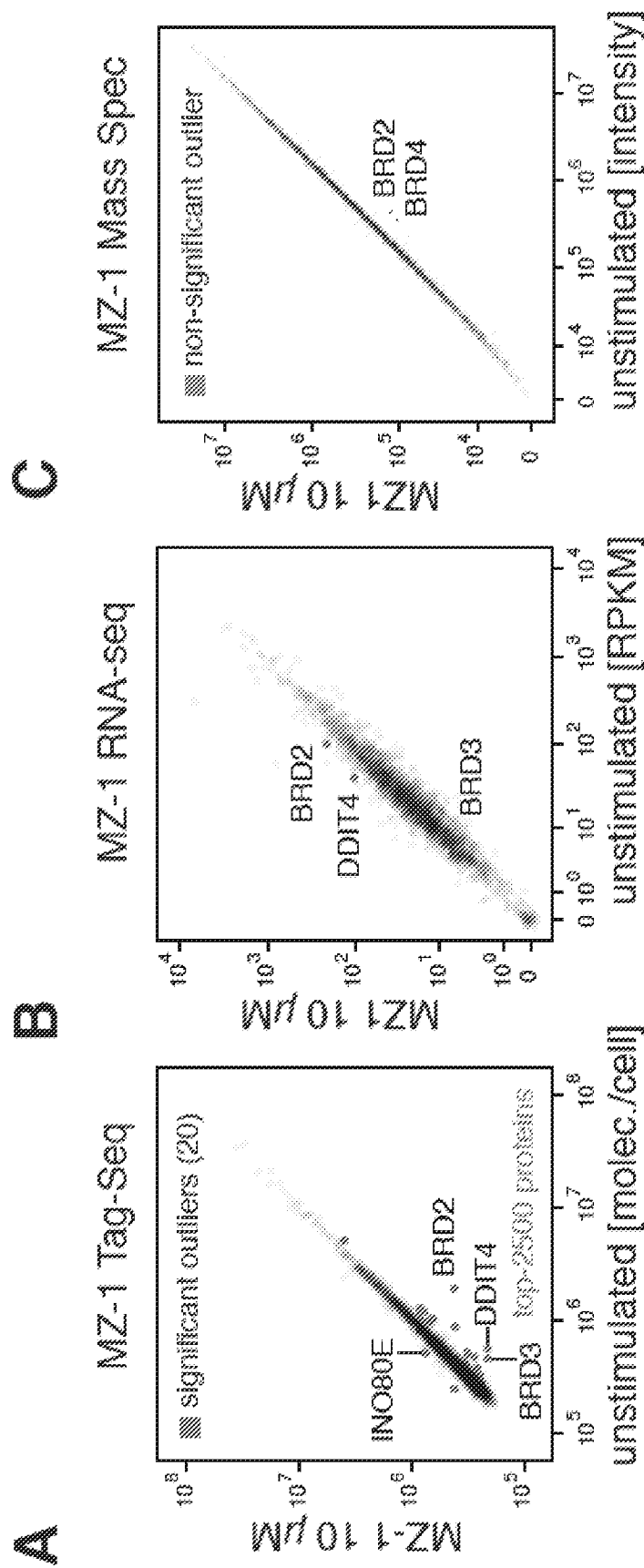
FIG. 39A-C

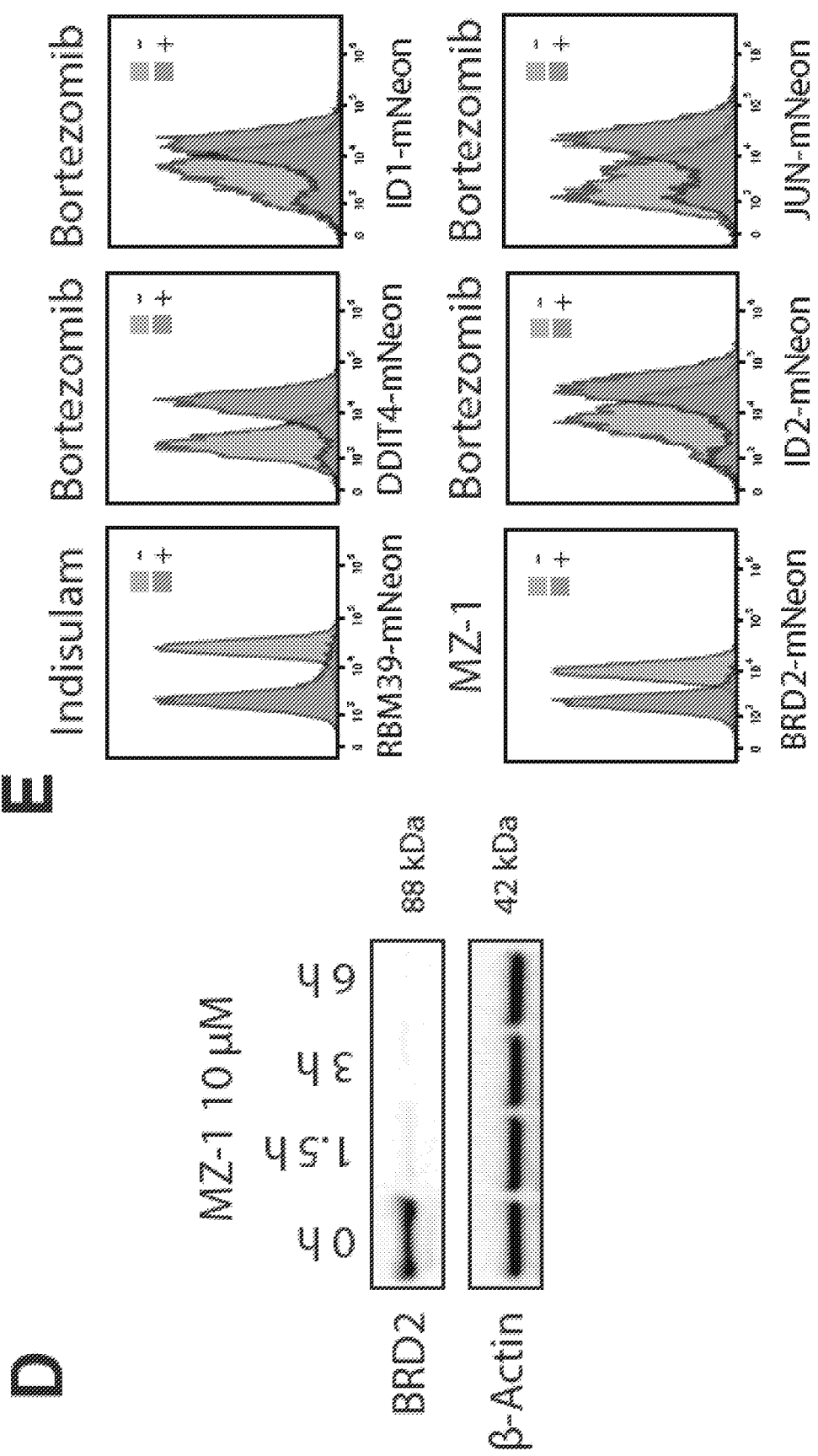
FIG. 39D-E

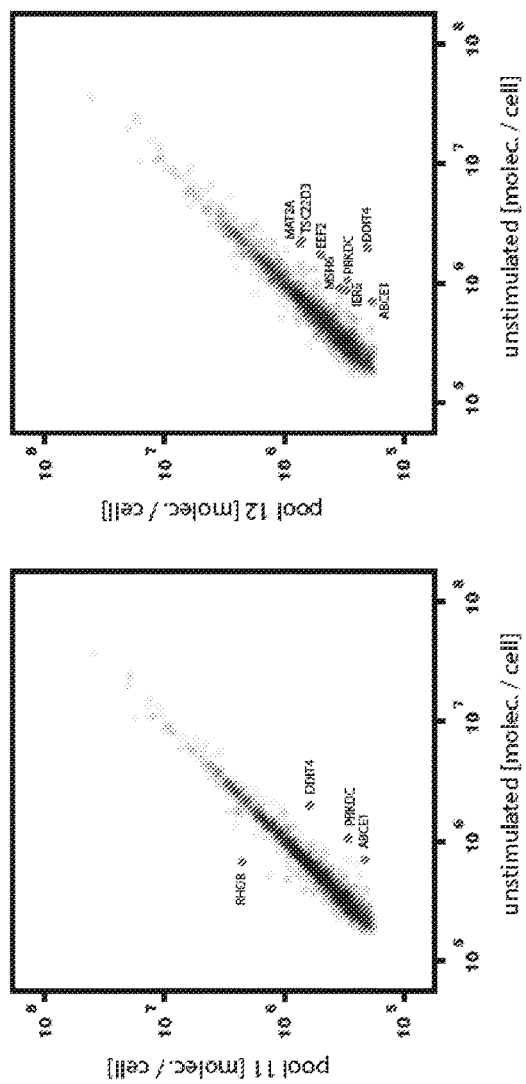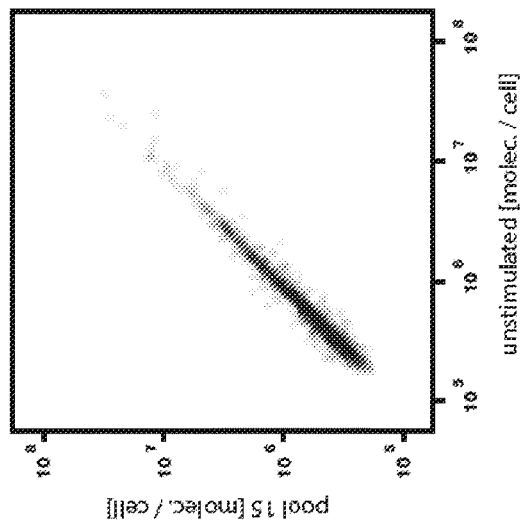
FIG. 41 continued

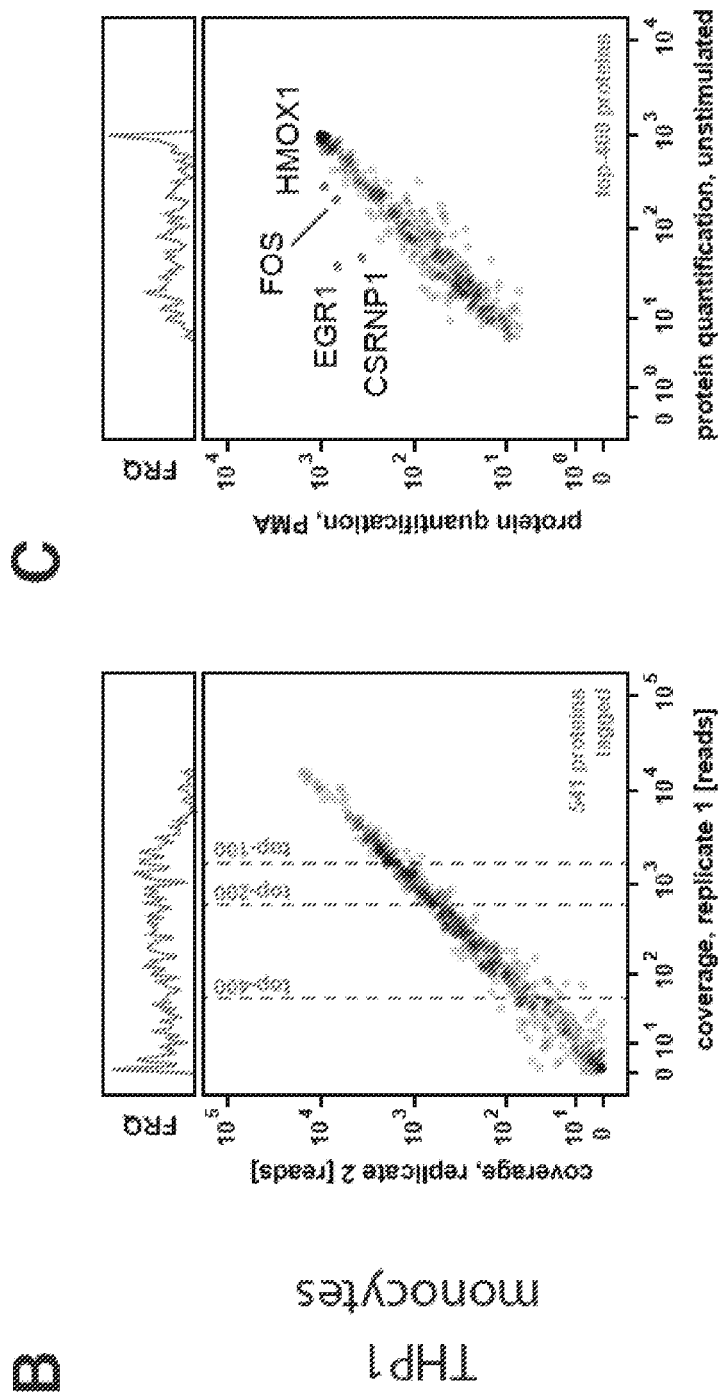
FIG. 42B-C

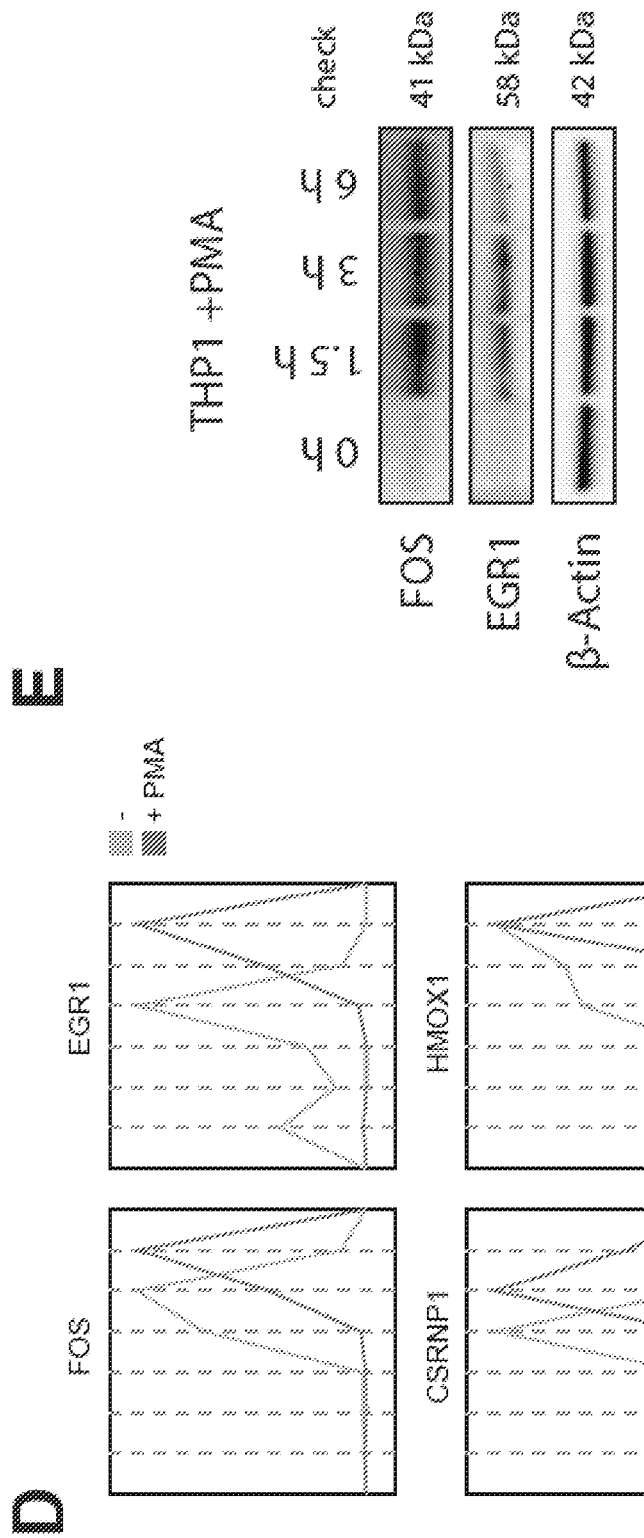
FIG. 42D-E

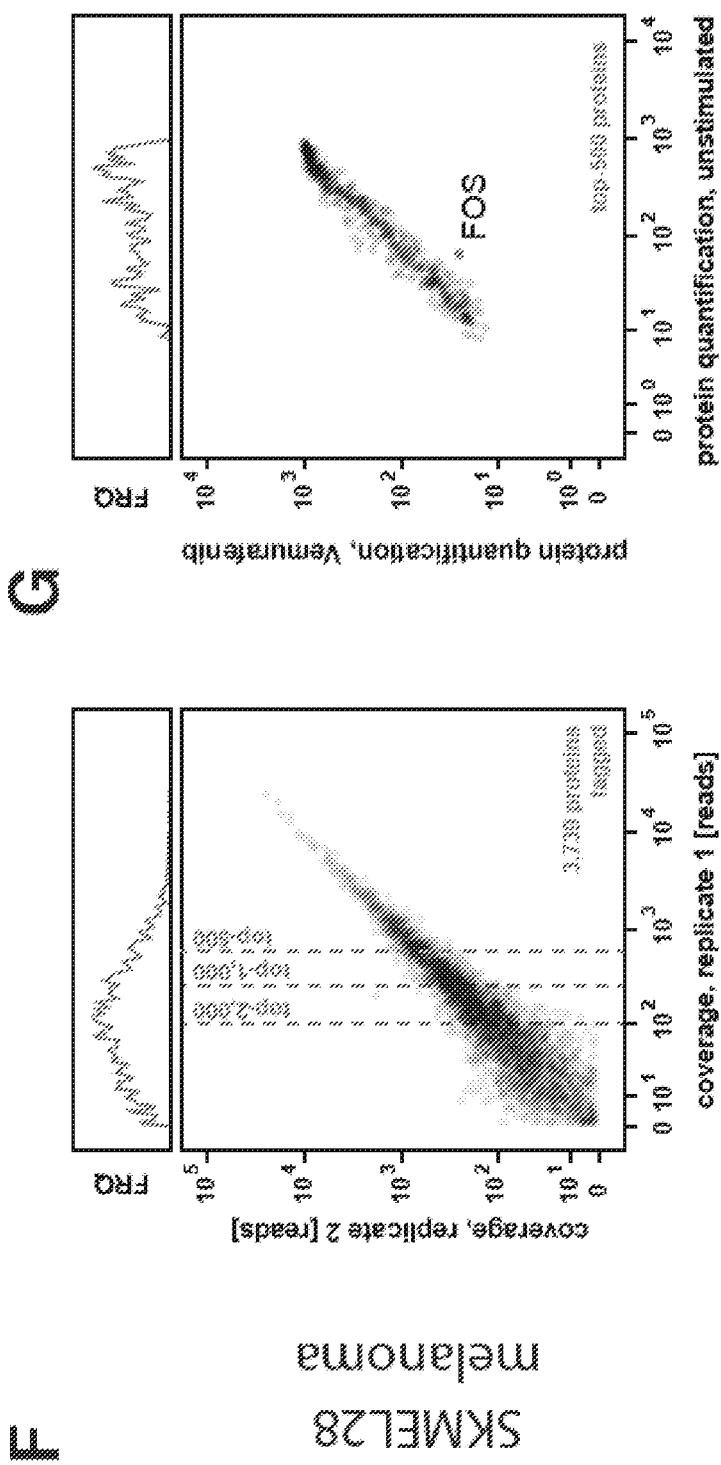
FIG. 42F-G

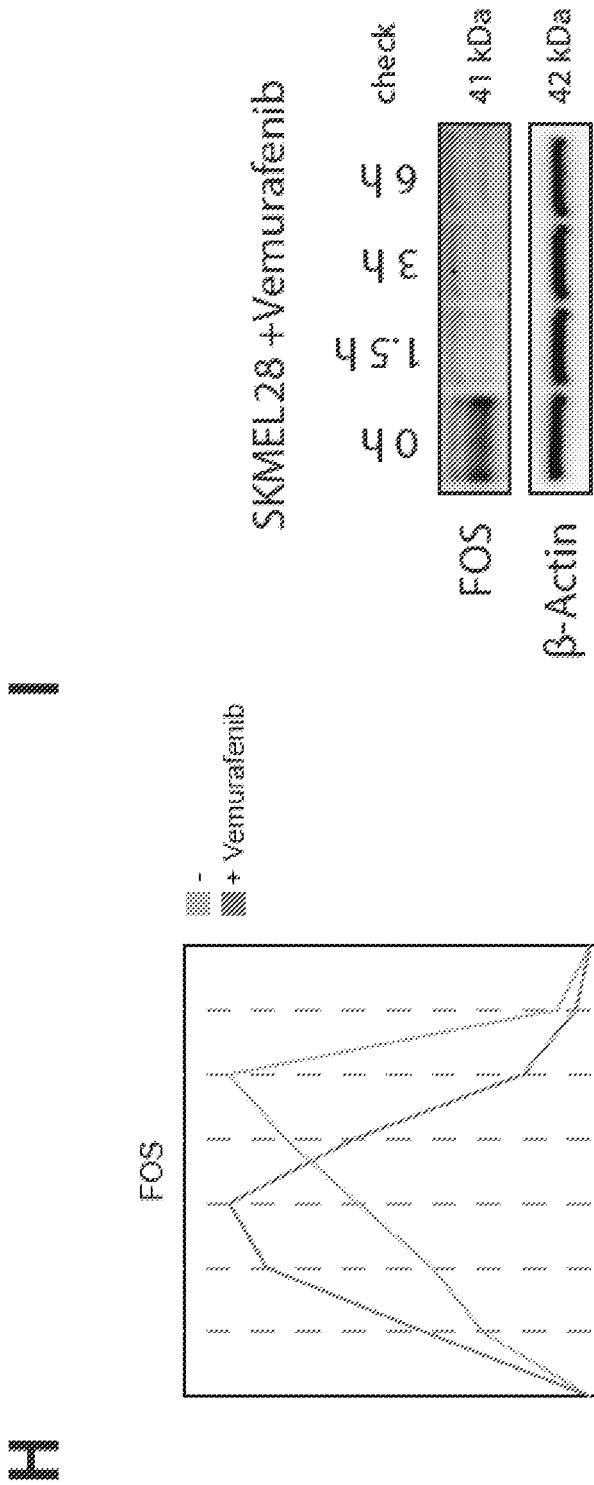
FIG. 42H-I

SEQUENCING-BASED PROTEOMICS

CROSS-REFERENCE TO RELATED APPLICATIONS

This application is a national stage entry of International Application No. PCT/US2019/029488 filed Apr. 26, 2019, which claims the benefit of U.S. Provisional Application Nos. 62/663,712, filed Apr. 27, 2018 and 62/751,314, filed Oct. 26, 2018. The entire contents of the above-identified applications are hereby fully incorporated herein by reference.

STATEMENT REGARDING FEDERALLY SPONSORED RESEARCH

This invention was made with government support under grant Nos. HL141201, HG009761, MH100706 and MH110049 awarded by the National Institutes of Health. The government has certain rights in the invention.

REFERENCE TO AN ELECTRONIC SEQUENCE LISTING

The contents of the electronic sequence listing (BROD_2090WP_ST25.txt"; Size is 13,257,876 bytes and it was created on Apr. 23, 2019) is herein incorporated by reference in its entirety.

TECHNICAL FIELD

The subject matter disclosed herein is generally directed to proteomics. More specifically, the invention is directed to methods for quantification and localization of proteins expressed in a cell.

BACKGROUND

Large-scale RNA sequencing or gene perturbation screens are currently used to identify novel candidate genes involved in biological processes, followed by classical biochemistry to validate single hits at the protein level. Standard validation methods known in the art, such as western blot, co-immunoprecipitation, or immunofluorescence microscopy, are laborious and rely on high-quality antibodies against the protein in question. Thus, a rapid, unbiased technology to assess protein abundance, localization, modification, and interaction on a proteome-wide scale would be very beneficial.

The present invention, therefore, provides such an approach, leveraging the power of deep sequencing in combination with the CRISPR/Cas9 system to create a sequencing-based proteomics method. Through the methods of the invention, answers to fundamentally important biological questions, particularly relating to innate immune signaling, cell cycle biology, and cellular drug response on the systems level, may be obtained. Sequencing-based proteomics provides a tractable, high-throughput method to access information stored at the protein level in cells, and to uncover unknown pathways or potential drug targets, which otherwise would require extensive research on single protein components.

SUMMARY

In one aspect, the invention provides a cell library for use in detecting the distribution of protein levels in single cells comprising a plurality of cells, wherein each cell comprises a polynucleotide sequence encoding a detectable marker integrated into the genome of the cell in frame with a protein coding gene selected from a set of target genes, wherein the library comprises more than one cell tagged at each target gene, whereby each gene in the set of genes is tagged with a detectable marker in single cells of the library. Thus, each cell expresses a fusion protein between the target gene and the detectable marker that is under control of the endogenous target gene locus. In certain embodiments, the detectable marker is a gene encoding for a fluorescent protein, or a protease, or an epitope, or an enzyme. In certain embodiments, the polynucleotide sequence further comprises a codon-neutral unique molecular identifier (UMI) sequence or a non-coding UMI after the detectable marker coding sequence, preferably, wherein the library is sequence-verified, such that each UMI identifies a tagged target gene (e.g., the polynucleotide sequence encoding a detectable marker further contains randomized bases that allow counting of independent integration events into the same genomic locus and identification of the tagged gene). The UMI may be integrated into the sequence of the detectable marker.

In certain embodiments, the polynucleotide sequence further encodes a selectable marker expressed as a separate protein. In certain embodiments, the sequence encoding the selectable marker is separated from the sequence encoding the fusion protein by an internal ribosome entry site (IRES) or a 2A peptide. In certain embodiments, the sequence encoding the selectable marker is operably linked to a separate regulatory element. In one embodiment, the selectable marker is an antibiotic resistance gene. In yet another embodiment, the selectable marker encodes for an enzyme that regulates expression of another selectable marker, (e.g., cre recombinase turning on or off a loxP-flanked reporter).

In certain embodiments, the polynucleotide sequence encoding a detectable marker further comprises a sequence encoding a protease cleavage site and a cleavable marker, wherein the sequence is in frame with the detectable marker sequence. Thus, the polynucleotide sequence is arranged such that the fusion protein expresses both the detectable marker and cleavable marker. Upon the fusion protein coming into contact with a protease specific for the cleavage site, cleavage of the fusion protein results in loss of only the cleavable marker from the fusion protein (see, e.g., FIG. 13 where the cleavable marker is a MYC epitope). In certain embodiments, the cleavable marker is a gene encoding for an epitope, or a protease, or a fluorescent protein, or an enzyme. In preferred embodiments, the cleavable marker is an epitope. As used herein, the term "cleavable marker" refers to any additional marker that can be cleaved from the fusion protein. In certain embodiments, the "cleavable marker" is only cleavable because it is outside of the protease cleavage site. The cleavable marker can be cleaved from the fusion protein, but is not cleaved per se. The marker should be different from the detectable marker.

In certain embodiments, a recombinant protease localized to a cellular compartment can be introduced to the library of cells at a time point where detection of protein expression for tagged proteins is desired. In certain embodiments, each cell is configured for expression of a recombinant protease localized to a cellular compartment. The cellular compartment may include, but is not limited to nuclear, cytoplasmic, mitochondrial, peroxisomal, endoplasmic reticulum (ER), golgi, lysosomal, membrane, or cytoskeleton compartments. Thus, localization of tagged proteins can be determined by detection of cleaved fusion proteins. The protease may comprise at least one nuclear export signal, nuclear localization signal, peroxisome localization signal, ER localization signal, golgi localization signal, lysosome localization signal, or mitochondrial localization signal.

In certain embodiments, the polynucleotide sequence encoding a detectable marker further comprises a T7 RNA polymerase promoter. In another embodiment, the polynucleotide sequence encoding a detectable marker further encodes for a linker peptide. The linker peptide may be any linker known in the art (e.g., gly-ser linker). The linker peptide may be between the detectable marker and tagged gene, between the detectable marker and cleavage site, between the cleavage site and cleavable marker, or between the cleavable marker and the selectable marker. In another embodiment, each cell comprises a sequence encoding a guide sequence specific for the tagged target gene, whereby detection of the sequence indicates the tagged target gene. In other embodiments, the library comprises eukaryotic cells, or the eukaryotic cells are mammalian, insect, yeast, or plant cells. In another embodiment, the cells of the library were generated from cells configured to express a CRISPR enzyme. In another embodiment, the CRISPR enzyme is inducible or transiently delivered as a protein. In another embodiment, the cells of the library were generated from cells obtained from a transgenic animal configured to express a CRISPR enzyme.

In another aspect, the present invention provides for a cell library for use in detecting protein interactions between a protein of interest and a set of target proteins, said library comprising a plurality of cells, wherein each cell comprises a first polynucleotide sequence encoding a first complementary protein integrated into the genome of the cell in frame with the protein of interest or comprises a first polynucleotide sequence encoding a fusion protein of the first complementary protein and protein of interest, wherein each cell comprises a second polynucleotide sequence encoding a second complementary protein integrated into the genome of the cell in frame with a protein coding gene selected from a set of target genes, wherein the library comprises more than one cell tagged at the protein of interest and a target gene and wherein an interaction between the protein of interest and a target gene can be detected with a detectable marker, whereby each gene in the set of target genes is tagged with a second complementary protein in single cells of the library. As used herein, "complementary protein" refers to a protein that complements another complementary protein, such that the complementary proteins create a functional or detectable unit (e.g, split fluorescent marker, split enzyme, epitopes binding, oligonucleotide linked antibodies, inactive marker and activating enzyme, protease and protease-cleavable epitope, FRET pair of fluorescent proteins). In certain embodiments, the second polynucleotide sequence further comprises a codon-neutral unique molecular identifier (UMI) sequence or a non-coding UMI after the detectable marker coding sequence, preferably, wherein the library is sequence-verified, such that each UMI identifies a tagged target gene. In certain embodiments, the first and second complementary proteins may comprise protein complementary assay (PCA) fragments; or one of the first or second complementary proteins may comprise a permuted inactive reporter and the other complementary protein comprises TEV; or the first and second complementary proteins may comprise a different epitope tag; or one of the first or second complementary proteins comprises one or more TEV cleavage sites followed by one or more epitopes and the other complementary protein comprises TEV. In certain embodiments, interactions may be detected by proximity ligation using oligo linked affinity ligands specific for the epitope tags (e.g., antibodies). In certain embodiments, the TEV cleavage site might be mutated to slow down cleavage in order to make cleavage more specific. The ligation products may be detected using a detectable probe as described herein. The PCA fragments may comprise split fluorescent protein fragments or split TEV fragments. In other embodiments, the first polynucleotide sequence may encode an epitope for use in a proximity ligation assay, or a recognition site for measurement of interaction by TEV cleavage of nearby target sites. In one embodiment, the second polynucleotide sequence comprises a selectable marker operably linked to a separate regulatory element; or wherein the polynucleotide sequence comprises an IRES or a 2A peptide, whereby the selectable marker is expressed as a separate protein. In another embodiment, the selectable marker is an antibiotic resistance gene. In another embodiment, the second polynucleotide sequence comprises a T7 RNA polymerase promoter. In another embodiment, each cell comprises a sequence encoding a guide sequence specific for the tagged target gene, whereby detection of the sequence indicates the tagged target gene. In other embodiments, the library comprises eukaryotic cells, such as mammalian, insect, yeast, or plant cells. In another embodiment, the cells of the library were generated from cells configured to express a CRISPR enzyme. In another embodiment, the CRISPR enzyme is inducible or transiently delivered as a protein. In another embodiment, the cells of the library were generated from cells obtained from a transgenic animal configured to express a CRISPR enzyme.

In another aspect, the present invention provides for a cell library for use in detecting protein modifications comprising a plurality of cells, wherein each cell stably expresses a fusion protein comprising a protein modification binding protein fused to a first complementary protein, wherein each cell comprises a polynucleotide sequence encoding a second complementary protein integrated into the genome of the cell in frame with a protein coding gene selected from a set of target genes, wherein the library comprises more than one cell tagged at each target gene and wherein binding of a protein modification binding protein to a target gene can be detected with a detectable marker, whereby each gene in the set of target genes is tagged with a second complementary protein in single cells of the library. The complementary proteins may include, e.g, a split fluorescent marker, split enzyme, epitopes binding, oligonucleotide linked antibodies, inactive marker and activating enzyme, protease and protease-cleavable epitope, or FRET pair of fluorescent proteins. In certain embodiments, the polynucleotide sequence further comprises a codon-neutral unique molecular identifier (UMI) sequence or a non-coding UMI after the detectable marker coding sequence, preferably, wherein the library is sequence-verified, such that each UMI identifies a tagged target gene. In certain embodiments, the first and second complementary proteins may comprise protein complementary assay (PCA) fragments; or one of the first or second complementary proteins may comprise a permuted inactive reporter and the other complementary protein comprises TEV; or the first and second complementary proteins may comprise a different epitope tag; or one of the first or second complementary proteins comprises one or more TEV cleavage sites followed by one or more epitopes and the other complementary protein comprises TEV. In certain embodiments, interactions may be detected by proximity ligation using oligo linked affinity ligands specific for the epitope tags (e.g., antibodies). In certain embodiments, the TEV cleavage site might be mutated to slow down cleavage in order to make cleavage more specific. The ligation products may be detected using a detectable probe as described herein. The PCA fragments may comprise split fluorescent protein fragments or split TEV fragments. In other embodiments, the first polynucleotide sequence may encode an epitope for use in a proximity ligation assay, or a recognition site for measurement of interaction by TEV cleavage of nearby target sites. In one embodiment, the polynucleotide sequence comprises a selectable marker operably linked to a separate regulatory element; or wherein the polynucleotide sequence comprises an IRES or a 2A peptide, whereby the selectable marker is expressed as a separate protein. In another embodiment, the selectable marker is an antibiotic resistance gene. In another embodiment, the polynucleotide sequence comprises a T7 RNA polymerase promoter. In another embodiment, each cell comprises a sequence encoding a guide sequence specific for the tagged target gene, whereby detection of the sequence indicates the tagged target gene. In another embodiment, the library comprises eukaryotic cells, such as mammalian, insect, yeast, or plant cells. In another embodiment, the cells of the library were generated from cells configured to express a CRISPR enzyme. In another embodiment, the CRISPR enzyme is inducible or transiently delivered as a protein. In another embodiment, the cells of the library were generated from cells obtained from a transgenic animal configured to express a CRISPR enzyme.

In any embodiment described herein, the tagged protein may be tagged at the N-terminus or C-terminus depending on the protein to be tagged. For example, a membrane protein may be advantageously tagged on an extracellular or intracellular domain. In any embodiment described herein, the detectable marker comprises a fluorescent protein or an epitope tag. The epitope tag may be detected by binding of a fluorescently tagged antibody or any binding molecule (e.g., aptamer).

In another aspect, the invention provides for a scalable method of constructing a cell library for use in proteomics comprising: introducing to a population of cells configured for expression of a CRISPR enzyme a plurality of polynucleotide sequences, wherein each cell receives one or more polynucleotide sequences comprising: a first guide sequence or a polynucleotide sequence configured for expression of the guide, wherein the first guide sequence is sequence specific for a target sequence in a protein coding gene selected from a set of target genes, a donor polynucleotide sequence comprising a CRISPR target site and a sequence encoding a detectable marker, preferably, comprising a codon-neutral unique molecular identifier (UMI) sequence or a non-coding UMI after the detectable marker coding sequence, and a second guide sequence or a polynucleotide sequence configured for expression of the guide sequence, wherein the second guide sequence is specific for the CRISPR target site, wherein the target sequence and target site are cleaved by the CRISPR enzyme such that the donor polynucleotide sequence is integrated in frame into the target sequence in the protein coding gene by NHEJ; and selecting for cells comprising the donor polynucleotide sequence integrated in frame into a target sequence in a protein coding gene from the set of target genes, whereby the cell library comprises cells singly tagged at every target gene. The CRISPR enzyme may be inducible or transiently provided as a protein. In certain embodiments, the cells are obtained from a transgenic animal configured to express a CRISPR enzyme.

In another aspect, the present invention provides for a scalable method of constructing a cell library for use in proteomics comprising: introducing to a population of cells configured for expression of a CRISPR enzyme a plurality of polynucleotide sequences, wherein each cell receives one or more polynucleotide sequences comprising: a guide sequence or a polynucleotide sequence configured for expression of the guide sequence specific for a target sequence in a protein coding gene selected from a set of target genes, and a donor polynucleotide sequence encoding a detectable marker gene; and selecting for cells comprising the donor polynucleotide sequence integrated in frame into a target sequence in a protein coding gene from the set of target genes, whereby the cell library comprises cells singly tagged at every target gene. The CRISPR enzyme may be inducible or transiently delivered as a protein. In certain embodiments, the cells are obtained from a transgenic animal configured to express a CRISPR enzyme.

In another aspect, the present invention provides for a scalable method of constructing a cell library for use in proteomics comprising: introducing to a population of cells a plurality of polynucleotide sequences, wherein each cell receives one or more polynucleotide sequences comprising: a polynucleotide sequence configured for expression of a CRISPR enzyme, a guide sequence or a polynucleotide sequence configured for expression of the guide sequence specific for a target sequence in a protein coding gene selected from a set of target genes, a donor polynucleotide sequence encoding a detectable marker gene; and selecting for cells comprising the donor polynucleotide sequence integrated in frame into a target sequence in a protein coding gene from the set of target genes, whereby the cell library comprises cells singly tagged at every target gene.

In another aspect, the present invention provides for a scalable method of constructing a cell library for use in proteomics comprising: introducing to a population of cells a plurality of ribonucleoprotein complexes (RNP) comprising a CRISPR enzyme and a plurality of polynucleotide sequences, wherein each cell receives one or more polynucleotide sequences comprising: a guide sequence specific for a target sequence in a protein coding gene selected from a set of target genes, a donor polynucleotide sequence encoding a detectable marker gene; and selecting for cells comprising the donor polynucleotide sequence integrated in frame into a target sequence in a protein coding gene from the set of target genes, whereby the cell library comprises cells singly tagged at every target gene.

In certain embodiments, the one or more of the polynucleotide sequences are introduced by one or more vectors. In certain embodiments, the donor polynucleotide sequence comprises a codon-neutral unique molecular identifier (UMI) sequence or a non-coding UMI after the detectable marker coding sequence.

In certain embodiments, the donor polynucleotide sequence is a PCR product. The PCR product may comprise a phosphorylation modification on each 5' end. The PCR product may comprise one or more PTO modifications, preferably, one, two, three, or more PTO modifications on each 5' end. In certain embodiments, the PCR product is 5' phosphorylated and protected by two PTO modifications at both 5' termini.

In certain embodiments, the PCR product may be obtained by amplifying a template with primer pairs comprising codon neutral unique molecular identifiers (UMI). The primers may further comprise a 5' phosphorylation modification or PTO modifications.

In certain embodiments, selecting cells comprises sorting for the 0.05-50% most positive cells for the detectable marker. In one embodiment, selecting cells comprises sorting for the 1% most positive cells for the detectable marker.

In certain embodiments, the donor polynucleotide sequence may further comprise a selectable marker gene operably linked to a separate regulatory element and selecting comprises selecting cells comprising the selectable marker. The selectable marker may be an antibiotic resistance gene and selecting comprises treating the cells with an antibiotic.

In certain embodiments, the donor polynucleotide sequence further comprises a sequence encoding a protease cleavage site and a cleavable marker, wherein the sequence is in frame with the detectable marker sequence. In certain embodiments, each cell may be configured for expression of a recombinant protease specific for the protease cleavage site and localized to a cellular compartment. The cellular compartment may include, but is not limited to nuclear, cytoplasmic, mitochondrial, peroxisomal, endoplasmic reticulum (ER), golgi, lysosomal, membrane, or cytoskeleton compartments. The recombinant protease may be induced or delivered after library generation. The protease may comprise at least one nuclear export signal, nuclear localization signal, peroxisome localization signal, ER localization signal, golgi localization signal, lysosome localization signal, or mitochondrial localization signal. In some specific embodiments, the expression of a localized protease, for example including, but not limited to, TEV protease, is induced or introduced (e.g., transfection) after generating the library, such that the library is split into sub-pools and the protease is either induced or transfected with a TEV plasmid or another protease.

In certain embodiments, the donor polynucleotide sequence further comprises a T7 RNA polymerase promoter.

In certain embodiments, the guide sequences of the present invention may be synthesized, generated by in vitro transcription or expressed from a vector as described herein.

In another embodiment, the population of cells comprises eukaryotic cells, such as mammalian, insect, yeast, or plant cells. In another embodiment, the CRISPR enzyme is inducible. In another embodiment, the method comprises maintaining the library of cells.

In another aspect, the invention provides a method of determining the distribution of protein levels in a population of cells, said method comprising: sorting a library of cells according to any of claims 1 to 15 into at least two groups based on expression of the detectable marker in each cell; and nucleic acid sequencing of the cells in each group, wherein the tagged target genes in each group are determined. In certain embodiments, the sequencing comprises PCR amplification of the UMIs with primers specific to the polynucleotide sequence encoding a detectable marker, optionally, a nested PCR, and sequencing the PCR products (e.g., lyse cells with proteinase K, heat inactivate, pipet into PCR reaction with primers PATTERNS-seq-fwd/rev). In one embodiment, the sequencing comprises transcription of the tagged gene by T7 polymerase, cDNA production, and sequencing of the cDNA. In another embodiment, the sequencing comprises tagmentation with Tn5, optional linear amplification (LAM), PCR amplification, optionally, nested PCR, and sequencing of the amplified DNA. In certain embodiments, a hyperactive Tn5 is used (see, e.g., Picelli et al., Tn5 transposase and tagmentation procedures for massively scaled sequencing projects, Genome Res. 2014. 24:2033-2040). In another embodiment, the sequencing comprises PCR amplification of a genomically integrated guide expression cassette. In another embodiment, the expression level of a tagged target protein is determined by fitting a distribution to the representation of that target gene in the plurality of sorted and sequenced expression bins, wherein the distribution can be a normal, log-normal, or other defined distribution. In another embodiment, the library of cells is treated with a perturbation prior to determining expression of proteins. In another embodiment, the perturbation comprises a small molecule, protein, RNAi, CRISPR system, TALE system, Zn finger system, meganuclease, pathogen, allergen, recombinant virus, temperature, salt, lipid, biomolecule, a pool of any perturbation thereof, or any combination thereof. In another embodiment, the localization of proteins is determined by further sorting the cells based on cleavage of the cleavable marker by the protease localized to a cellular compartment; or wherein the localization of proteins is determined by comparing the distribution of protein levels of tagged genes between sorted cells and sorted nuclei obtained from the library, optionally, the nuclei are fixed (e.g., with paraformaldehyde (PFA), formaldehyde, or glutaraldehyde).

In another aspect, the invention provides a method of determining protein interactions in a population of cells, said method comprising: sorting a library of cells into at least two groups based on the signal of the detectable marker in each cell (i.e., the detectable marker is interaction dependent); and nucleic acid sequencing of the cells in each group, wherein the tagged target genes in each group are determined, wherein the library of cell comprises a plurality of cells wherein each cell comprises a first polynucleotide sequence encoding a first complementary protein integrated into the genome of the cell in frame with the protein of interest or comprises a first polynuycleotide sequence encoding a fusion protein of the first complementary protein and protein of interest, wherein each cell comprises a second polynucleotide sequence encoding a second complementary protein integrated into the genome of the cell in a frame with a protein coding gene selected from a set of target genes, wherein the library comprises more than one cell tagged at a target gene, whereby an interaction between the protein of interest and a target gene can be detected with a detectable marker. The signal of the detectable marker is dependent upon interaction of a target gene with a gene of interest, such that complementation can occur. In certain embodiments, the sequencing comprises PCR amplification of the UMIs with primers specific to the polynucleotide sequence encoding a detectable marker, optionally, a nested PCR, and sequencing the PCR products. In one embodiment, the sequencing comprises transcription of the tagged gene by T7 polymerase, cDNA production, and sequencing of the cDNA. In another embodiment, the sequencing comprises tagmentation with Tn5, optional LAM, PCR amplification, optionally, nested PCR, and sequencing of the amplified DNA. In another embodiment, the sequencing comprises PCR amplification of a genomically integrated guide expression cassette. In another embodiment, the expression level of a tagged target protein is determined by fitting a distribution to the representation of that target gene in the plurality of sorted and sequenced expression bins, wherein the distribution can be a normal, log-normal, or other defined distribution. In another embodiment, the library of cells is treated with a perturbation prior to determining protein interactions. In another embodiment, the perturbation comprises a small molecule, protein, RNAi, CRISPR system, TALE system, Zn finger system, meganuclease, pathogen, allergen, recombinant virus, temperature, salt, lipid, biomolecule, a pool of any perturbation thereof, or any combination thereof.

In another aspect, the present invention provides for a method of determining protein modifications in a population of cells, said method comprising: sorting a library of cells into at least two groups based on the signal of the detectable marker in each cell; and nucleic acid sequencing of the cells in each group, wherein the tagged target genes in each group are determined, wherein the library of cell comprises a plurality of cells, wherein each cell stably expresses a fusion protein comprising a protein modification binding protein fused to a first complementary protein, wherein each cell comprises a polynucleotide sequence encoding a second complementary protein integrated into the genome of the cell in a frame with a protein coding gene selected from a set of target genes, wherein the library comprises more than one cell tagged at a target gene and wherein binding of a protein modification binding protein to a target gene protien can be detected with a detectable marker. The invention provides a method of determining protein modifications in a population of cells, said method comprising: sorting a library of cells into at least two groups based on the signal of the fluorescent marker in each cell; and sequencing each group, wherein the tagged target genes in each group are determined, wherein the library of cells comprises a plurality of cells, wherein each cell stably expresses a fusion protein comprising a protein modification binding protein fused to a first complementary protein, wherein each cell comprises a polynucleotide sequence encoding a second complementary protein integrated into the genome of the cell in frame with a protein coding gene selected from a set of target genes, wherein the library comprises more than one cell tagged at each target gene and wherein binding of a protein modification binding protein to a target gene protein can be detected with a detactable marker. In certain embodiments, the sequencing comprises PCR amplification of the UMIs with primers specific to the polynucleotide sequence encoding a detectable marker, optionally, a nested PCR, and sequencing the PCR products. In one embodiment, the sequencing comprises transcription of the tagged gene by T7 polymerase, cDNA production, and sequencing of the cDNA. In another embodiment, the sequencing comprises tagmentation with Tn5, optional LAM, PCR amplification, optionally, nested PCR, and sequencing of the amplified DNA. In another embodiment, the sequencing comprises PCR amplification of a genomically integrated guide expression cassette. In another embodiment, the expression level of a tagged target protein is determined by fitting a distribution to the representation of that target gene in the plurality of sorted and sequenced expression bins, wherein the distribution can be a normal, log-normal, or other defined distribution. In another embodiment, the library of cells is treated with a perturbation prior to determining protein modifications. In another embodiment, the perturbation comprises a small molecule, protein, RNAi, CRISPR system, TALE system, Zn finger system, meganuclease, pathogen, allergen, recombinant virus, temperature, salt, lipid, biomolecule, a pool of any perturbation thereof, or any combination thereof.

In another aspect, the invention provides a method for sequencing integration sites of a donor sequence inserted into the genome of a cell comprising: lysing cells with proteinase K, wherein the proteinase K is not heat inactivated; performing tagmentation of genomic DNA with Tn5 loaded with adaptors, wherein the adaptors comprise a priming site; performing linear amplification with a first primer specific for the donor sequence; performing PCR with a second primer specific for the donor sequence downstream of the first primer and a reverse primer specific for the adaptor priming site; and constructing and sequencing a sequencing library from the PCR products. In another aspect, the invention provides a method for sequencing integration sites of a donor sequence inserted into the genome of a cell comprising: lysing cells with proteinase K, wherein the proteinase K is not heat inactivated; performing tagmentation of genomic DNA with Tn5 loaded with adaptors, wherein the adaptors comprise a priming site; performing a PCR with a first primer specific for the donor sequence and a second primer specific for the adaptor priming site; optionally, performing a second nested PCR using the product of the first PCR as a template; and sequencing the PCR products. In certain embodiments, detergent may be used when lysing the cells (e.g., Triton X-100, NP-40). In certain embodiments, the Tn5 is a hyperactive Tn5. In certain embodiments, the method further comprises purifying the sample using a silica column, beads, or detaching Tn5 by adding SDS. In certain embodiments, the method further comprises heat-denaturing the sample.

In another aspect, the present invention provides for a scalable system for analysis of proteins in a cell comprising: a universal donor construct; a cell population configured for expression of a CRISPR system; and sequencing reagents, wherein the system provides for a population of cells tagged with the donor construct at one or more integration sites and wherein the system can determine the site of integration. The CRISPR system may be delivered to the cell on one or more vectors. The CRISPR system may be delivered to the cell as a ribonucleic acid complex (RNP). The CRISPR system may be stably expressed by the cell population. The donor construct may comprise a nucleotide sequence encoding a detectable marker and a selectable marker. The donor construct may further comprise a nucleotide sequence encoding a T7 promoter. The donor construct may further comprise a nucleotide sequence encoding an epitope tag. The donor construct may further comprise a nucleotide sequence encoding a protease cleavage site and a cleavable epitope tag. The system may further comprise a protease specific for the protease cleavage site localized to a cellular compartment. The donor construct may further comprise a codon-neutral unique molecular identifier (UMI) sequence.

In another aspect, the present invention provides for a donor construct for tagging a target gene in a cell comprising a nucleotide sequence encoding: a CRISPR target site, a detectable marker, a resistance gene, and a codon-neutral unique molecular identifier (UMI) sequence. In certain embodiments, the donor construct further comprises a protease cleavage site and a cleavable epitope tag (i.e, an epitope tag outside of the protease cleavage site). In certain embodiments, the donor construct further comprises a T7 promoter. In certain embodiments, the donor construct is a plasmid, vector, PCR product, or synthesized polynucleotide sequence. The plasmid may be linearized (e.g., using CRISPR in the cell). The vector may be a viral vector that produces a DNA donor template by replication of the viral vector (e.g., AAV).

In another aspect, the present invention provides for a plurality of donor constructs.

In another aspect, the invention provides for a kit comprising vectors for tagging a population of cells; or a kit comprising a library of tagged cells, reagents and protocols for sorting cells and sequencing tag integration sites. Thus, a user could stimulate or perturb the library of cells, sort and sequence as described herein.

In certain embodiments, the library according to any embodiments herein, comprises a sequence encoding a detectable marker and a sequence encoding a protease, wherein the sequence is in frame with the detectable marker sequence. The library of cells may be configured for expression of a reporter gene localized to a cellular compartment described herein, wherein said reporter comprises a cleavage site for the protease and cleavage results in a detectable signal.

In certain embodiments, the system according to any embodiment herein, comprises a donor construct comprising a nucleotide sequence encoding a protease in frame with a detectable marker. In certain embodiments, the system further comprises one or more reporter constructs configured for expression of a reporter gene comprising a localization signal for a cellular compartment, wherein said reporter comprises a cleavage site for the protease and cleavage results in a detectable signal.

In another aspect, the invention provides for a method of determining the localization of a target protein comprising: a) tagging a population of cells with the donor constructs to obtain a library of cells tagged at one or more target proteins; b) introducing one or more of the reporter constructs to the library of cells; c) sorting the cells based on the signal of the reporter gene; and d) identifying the tagged target proteins.

In certain embodiments, the methods of determining the distribution of protein levels may be used for identifying cell cycle regulated proteins. Cell cycle regulated proteins may be distributed in single cells in different sorted bins.

In certain embodiments, the methods of determining the distribution of protein levels, protein interactions and protein modifications may be used for identifying or confirming drug targets that are not regulated at the transcript level. For example, drugs with unknown targets can be administered to the library of cells and changes in protein levels, protein interactions, or protein modifications can indicate an unknown target for the drug.

In certain embodiments, the methods of determining the distribution of protein levels, protein interactions and protein modifications may further comprise transferring the library to an in vivo model (e.g., nude mouse) and recovering the cells before the step of sorting. In certain embodiments, drugs are screened in vivo and the protein distribution levels are determined in the recovered cells.

In certain embodiments, the CRISPR enzyme or CRISPR system according to any embodiment herein comprises Cas9 or Cas12.

In another aspect, the invention provides for a scalable method of constructing a cell library for use in proteomics comprising: a) introducing to a population of cells a plurality of polynucleotide sequences, wherein each cell receives one or more polynucleotide sequences comprising: i) a polynucleotide sequence configured for expression of a nuclease system specific for a target sequence in a protein coding gene selected from a set of target genes, and ii) a donor polynucleotide sequence encoding a detectable marker gene; and b) selecting for cells comprising the donor polynucleotide sequence integrated in frame into a target sequence in a protein coding gene from the set of target genes, whereby the cell library comprises cells singly tagged at every target gene. In certain embodiments, the nuclease system comprises a CRISPR system, TALEN system, Zn finger system, or meganuclease system. In certain embodiments, the donor polynucleotide sequence comprises a codon-neutral unique molecular identifier (UMI) sequence or a non-coding UMI after the detectable marker coding sequence.

These and other aspects, objects, features, and advantages of the example embodiments will become apparent to those having ordinary skill in the art upon consideration of the following detailed description of illustrated example embodiments.

BRIEF DESCRIPTION OF THE DRAWINGS

FIG. 4—Shows mNeon integration events using primer pairs upstream of the targeting region and within the mNeon gene. Shown are representative results of tagged ACTG1, HIST1H4C, and TUBB genes.

FIG. 16—Shows bar graphs depicting that the TEV S219P mutant allows localization-dependent cleavage.

FIG. 20—Shows results of deep sequencing, demonstrating that 80% of reads contain mNeon marker sequence (left); single cells can be counted using the tagmentation positions as UMIs (middle); Right side shows protein abundance estimation for independent proteins following FACS sorting and sequencing with and without Bortezomib.

FIG. 22A-FIG. 22E—Large-scale tagging of protein-coding genes. FIG. 22A shows a schematic representation of the generation of pooled RNP complexes starting from an oligo array template (Step 1), pooled NHEJ-mediated gene tagging leading to in-frame integration of an mNeonGreen-2A-NeoR cassette into a plurality of genes (Step 2), and Tagmentation-based Tag Integration Site Sequencing (TTISS, Step 3). FIG. 22B shows representative results of TTISS data aligned to the human genome. Scale denotes number of reads aligned. FIG. 22C shows the per-gene coverage of two replicate experiments of genome-scale gene tagging measured by TTISS. FIG. 22D shows the distribution of independent clone counts per target locus in the tagging library as determined from silent UMI sequences. FIG. 22E shows representative confocal microscopic images and TTISS sequencing results of single-cell clones grown out of a polyclonal library of tagged cells. Scale-bars, 20 μm.

FIG. 23A-FIG. 23J—Large-scale protein quantification by sequencing. FIG. 23A shows a schematic representation of Sequencing-Based Proteomics (SBP)-based protein quantification. A library of cells expressing fluorescently tagged proteins is sorted into expression bins. Sequencing the tag integration sites in each bin allows to assess the distribution of protein expression among single cells. FIG. 23B shows representative histograms of protein expression levels in single cells quantified by SBP. N1, N2 denote biological replicates from the sorting stage. FIG. 23C shows the correlation of mean protein expression measurements obtained by SBP among replicates at different protein representation cutoffs. R denotes Pearson correlation coefficients. FIG. 23D shows single-cell variance of protein expression measurements obtained by SBP. FIG. 23E shows the representation of RRM2 in sorted bins among two SBP replicates. FIG. 23F shows the distribution of single-cell RRM2 expression levels in a clonal tagged cell line measured by FACS. FIG. 23G shows a schematic representation of transiently expressed cell-cycle reporters used for identifying cell-cycle regulated proteins. FIG. 23H shows mean protein expression measurements obtained by SBP from cell-cycle phase enriched cells. FIG. 23I shows validation of predicted cell-cycle regulated RRM2 expression by FACS analysis after Hoechst DNA staining. FIG. 23J shows validation of predicted cell-cycle regulated RRM2 expression using immuno-blotting of synchronized cells released for the denoted amounts of time after double-Thymidine block (left panel), or cells enriched for cell-cycle phases using FACS sorting on PI signal (right panel).

FIG. 24A shows the mean protein expression measurements obtained by SBP from drug-treated versus untreated control cells. Significant outlier proteins are denoted as dots, and non-significant outliers are marked (See Methods). FIG. 24B shows the mean transcript expression measurements obtained by RNA-sequencing from drug-treated versus untreated control cells. The selection of genes shown is matched to the proteins quantified in (A) using SBP. Outliers from SBP protein quantification are marked in colored circles. FIG. 24C shows the relative protein expression measurements obtained by TMT labeling whole proteome mass spectrometry from drug-treated versus untreated control cells. Non-significant outliers are marked. Replicates were combined for plotting by summation of raw reporter intensities. FIG. 24D shows validation of predicted drug-regulated proteins using immuno-blotting of cells at indicated time points after drug treatment. FIG. 24E shows validation of predicted drug-regulated proteins using indicated clonal mNeon-tagged reporter cell lines stimulated for six hours and analyzed by FACS. Actinomycin D (ActD) or Cycloheximide was applied one hour before drug stimulation.

FIG. 25A-FIG. 25C—SBP-mediated protein localization measurement. FIG. 25A shows a schematic of SBP-mediated protein localization assessment. FIG. 25B shows protein quantification results from whole cells (X-axis) versus purified nuclei (Y-axis). The dashed line indicates the cutoff of nuclear localization calling for downstream validation. FIG. 25C shows validation of SBP nuclear localization prediction based on literature consensus.

FIG. 26A shows a schematic of the NHEJ-mediated tagging process. A protein-coding gene is cleaved using Cas9 at the PAM motif closest to the stop codon. Either a PCR product is inserted in-frame, or a donor plasmid is co-linearized in the cell using Cas9 to be inserted in-frame. Cas9 and the gRNA are either expressed from a plasmid, or delivered using pre-assembled RNP complexes. FIG. 26B shows that the endogenous TUBB gene was tagged in-frame with mNeonGreen using indicated Cas9 delivery method and type of donor DNA. mNeon-positive cells were quantized over the course of two weeks using FACS. FIG. 26C shows that the endogenous TUBB gene was tagged in-frame with each of six indicated fluorescent proteins using RNP delivery, and cells were expanded under Puromycin selection for one week. Brightness over autofluorescence was assessed by FACS using indicated filter sets. Grey histograms indicate tagged cells, while black histograms indicate untransfected control cells. FIG. 26D shows that 22 protein-coding genes were tagged with mNeon coupled to each of three different resistance genes. Cells were expanded for 10 days under selection pressure with the corresponding antibiotics indicated, and the number of surviving cells was quantified using FACS.

The dashed line indicates a log-normal distribution fitted by calculating the mean and variance of log-transformed expression values. KLdiv indicates the Kullback-Leibler divergence for each fit, and values higher than 0.2 are marked to highlight clones diverging from a log-normal distribution. The same clones shown in FIG. 28 were trypsinized and analyzed using FACS.

Figure 30A:
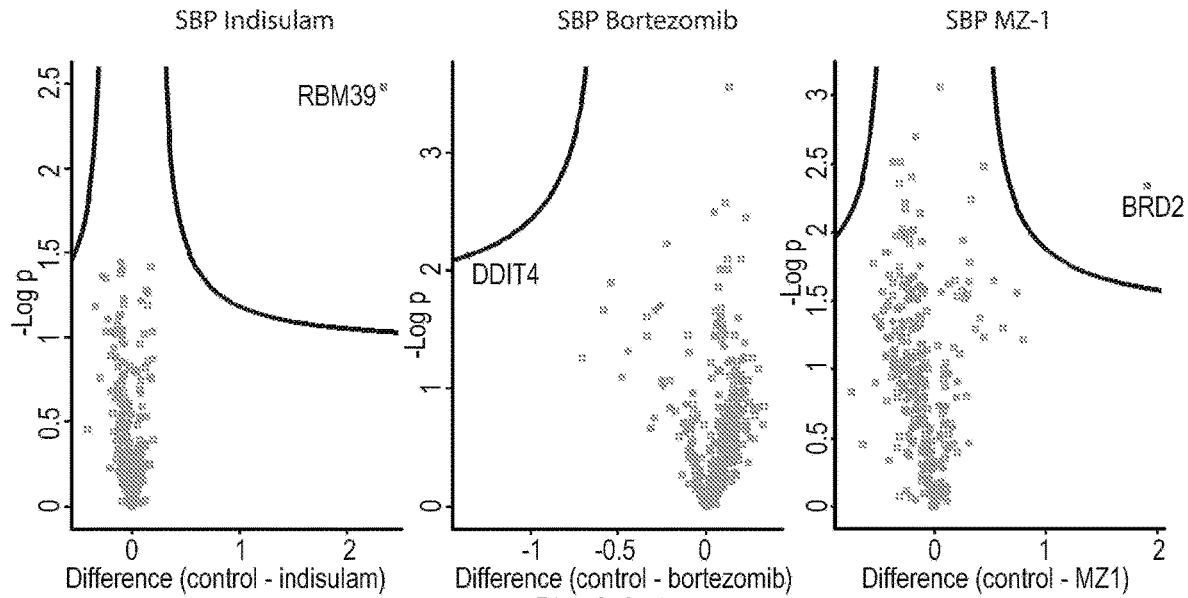
Figure 30B:
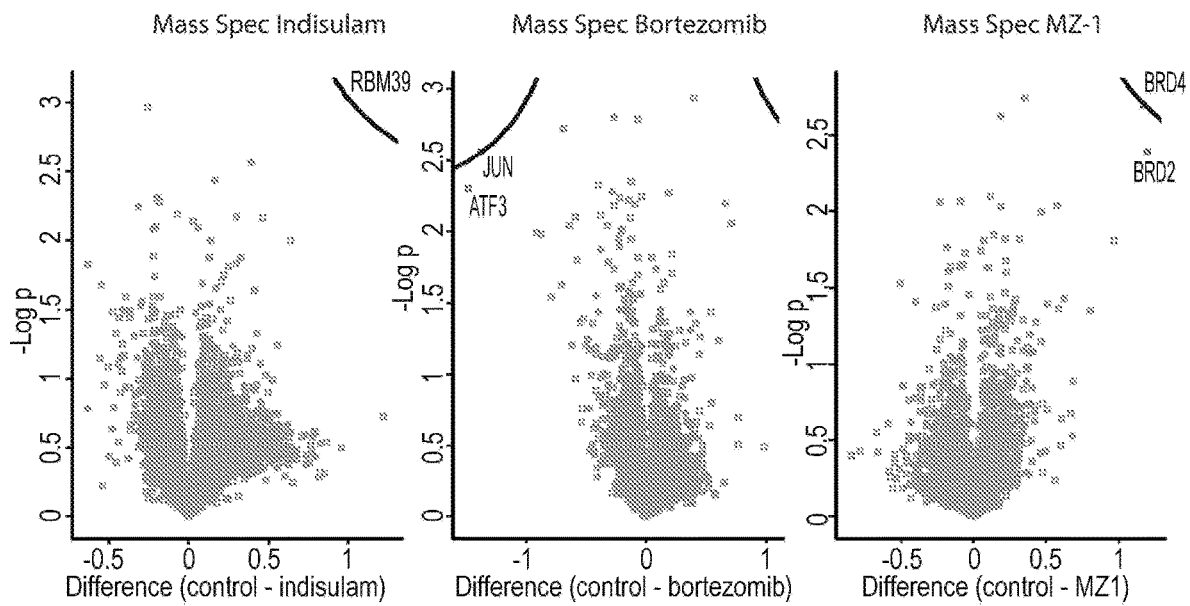

FIG. 30A-FIG. 30B—Statistical analysis of quantitative proteomics data. FIG. 30A shows SBP protein quantification data from two replicate screens that were median-subtracted and tested for drug regulated proteins (see Methods). The mean difference between conditions is plotted on the x-axis versus the −log P value on the y-axis. The two outliers RBM39 and BRD2 were identified to be statistically significant, as they are located above the black line indicating the significance threshold at an FDR of 5%. FIG. 30B shows TMT mass spectrometry protein quantification data that was filtered for missing values, log-2-transformed, median-subtracted, and tested for drug regulated proteins (see Methods). No outliers were identified to be statistically significant.

Figure 24A:
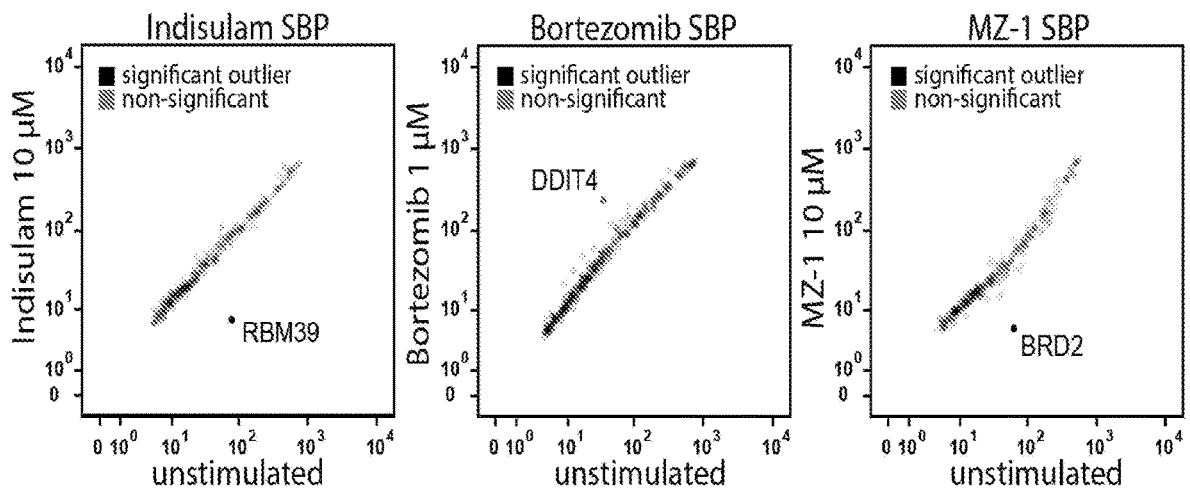
FIG. 24A-FIG. 24E—Unbiased drug target identification by SBP.

FIG. 31A-FIG. 31B—SBP single-UMI screening results and independent replicate screening results. FIG. 31A shows the drug responses of individual clones in the tagging library plotted after UMI-based analysis of the SBP screen presented in FIG. 24a. Of note, all hits are represented by two independent UMI clones, and one additional hit (SIGIRR (SEQ ID NO: 69339)) was found to be represented by a single UMI, but could not be validated (data not shown). FIG. 31B shows mean protein expression measurements obtained by SBP from drug-treated versus untreated control cells as an independent biological replicate employing the same screening conditions as in FIG. 24a.

Figure 32A:
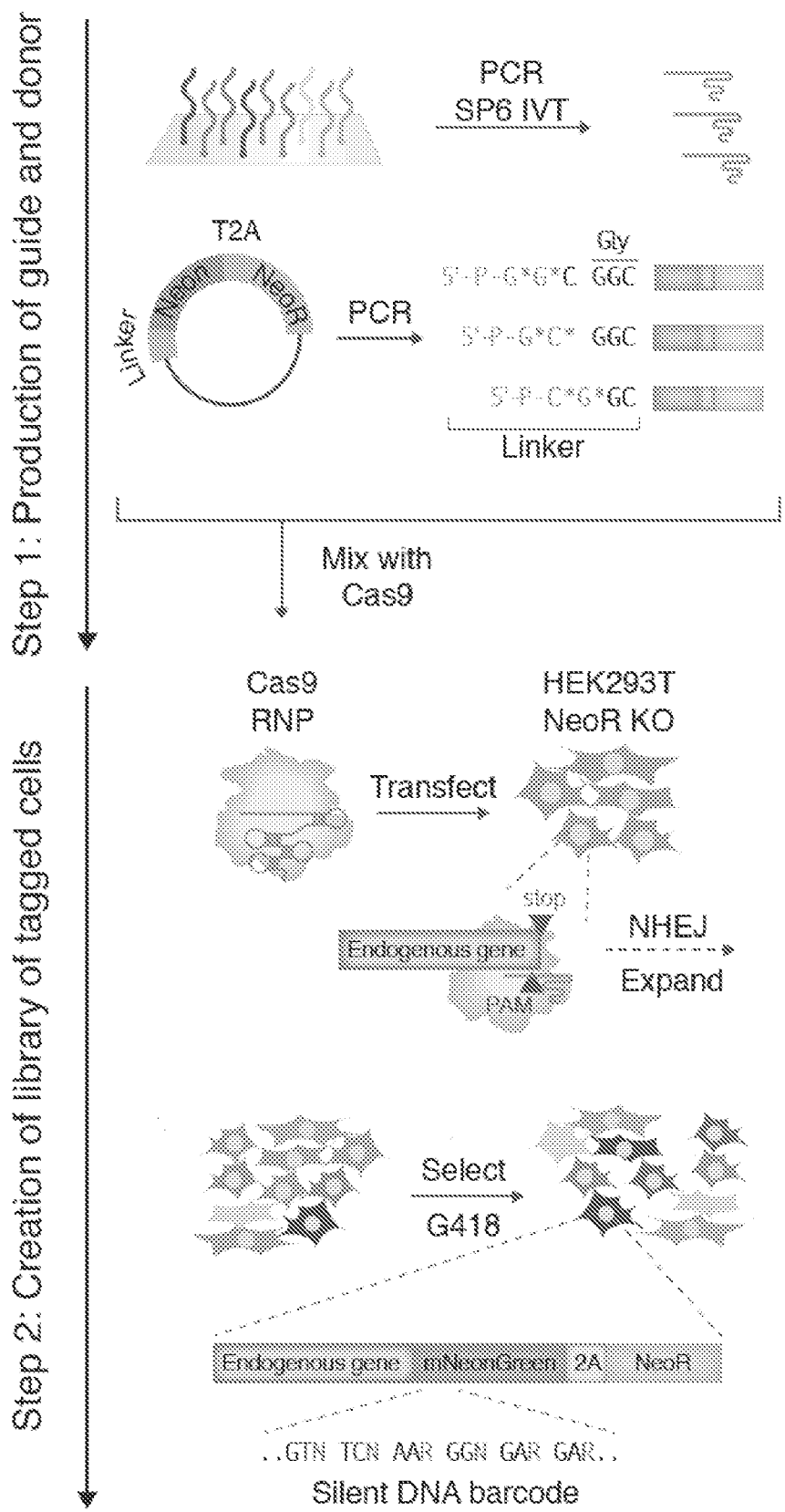
Figure 32A:
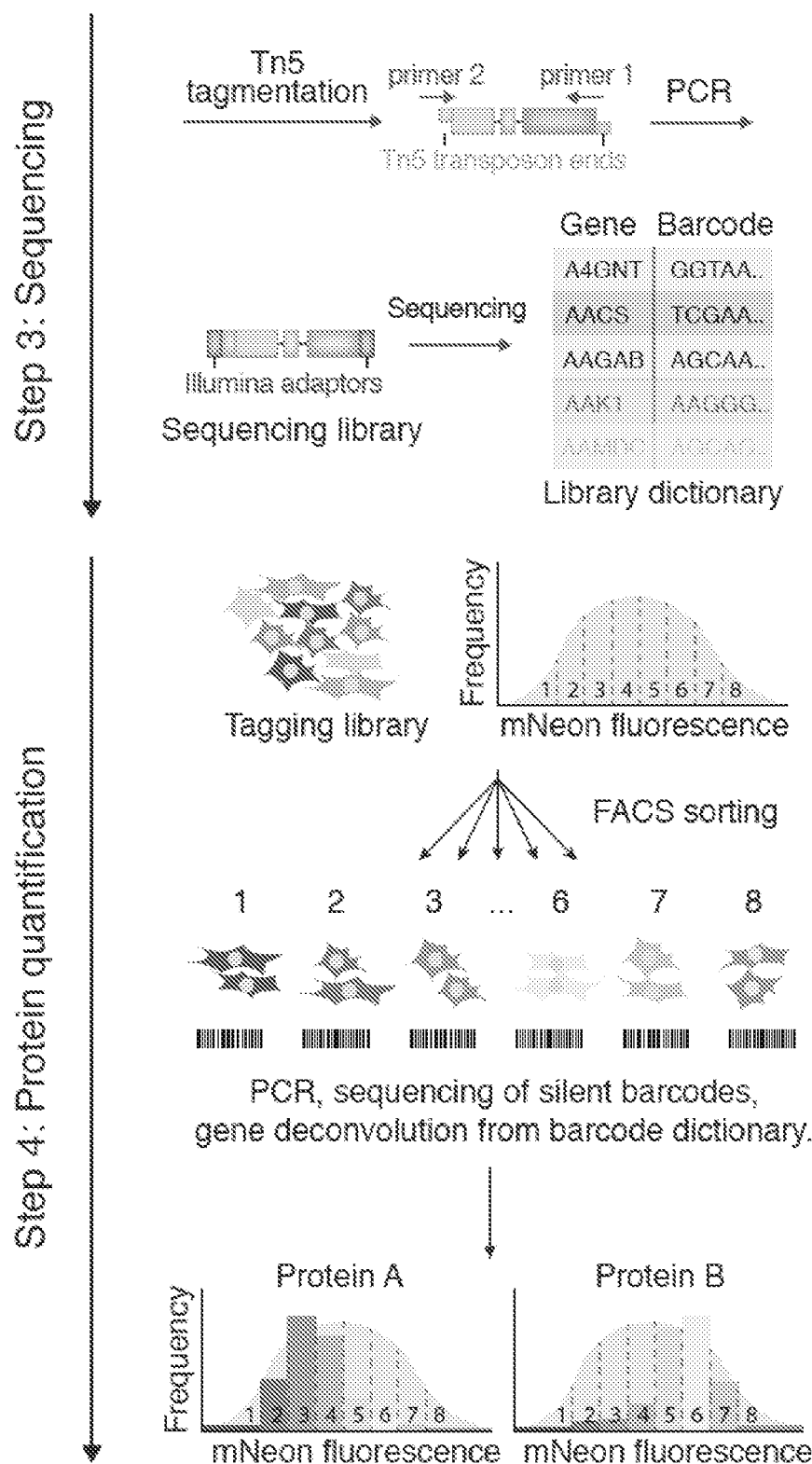
Figure 32B:
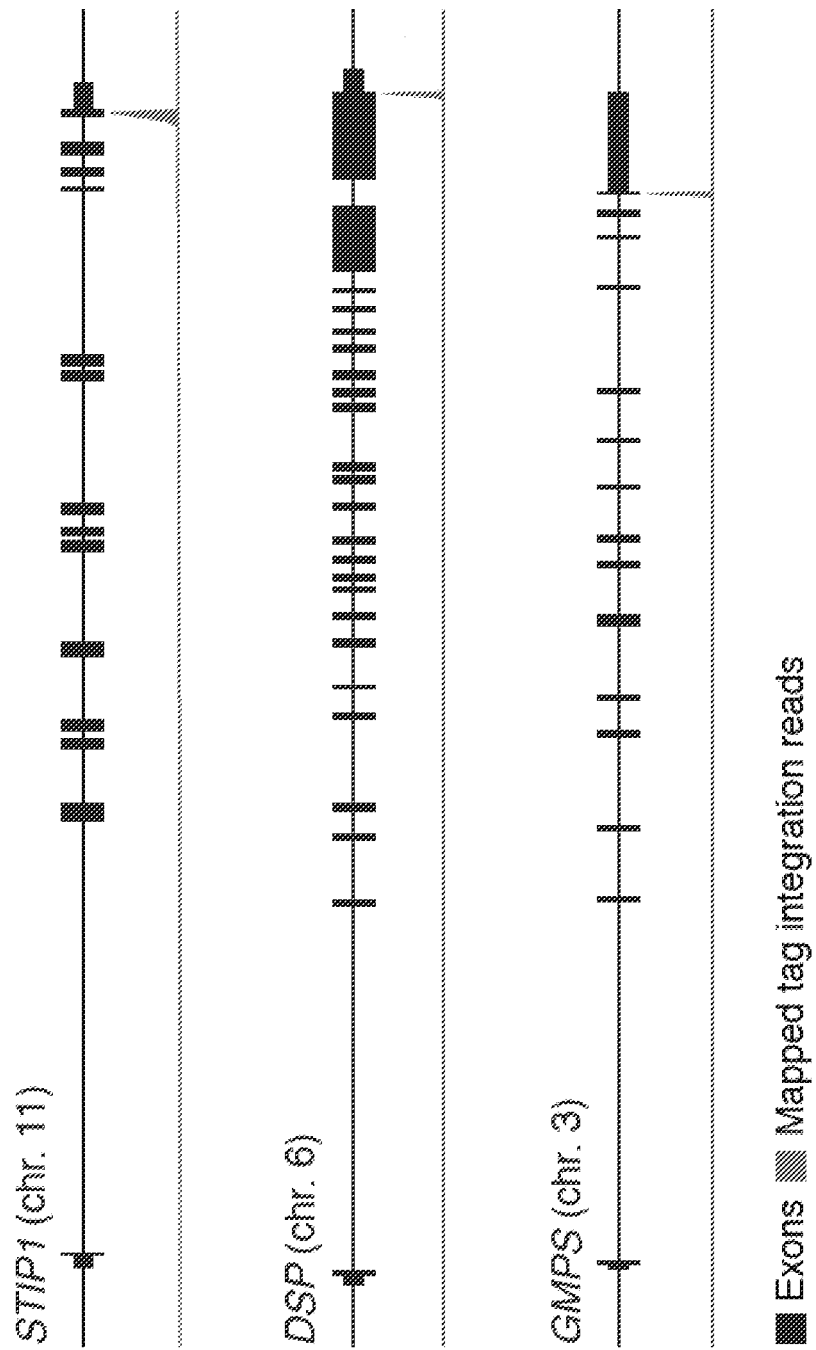
Figure 32F:
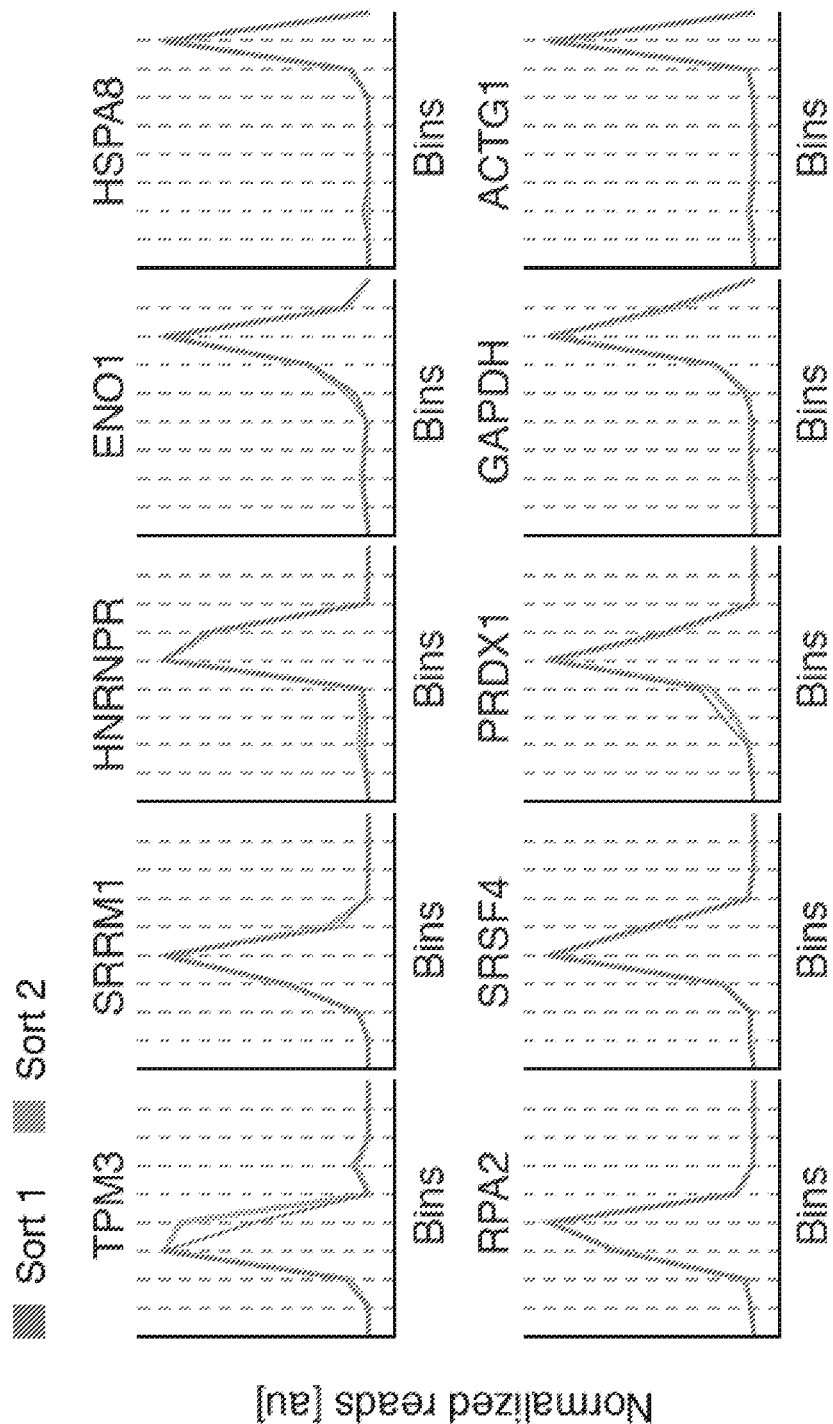
Figure 32G:
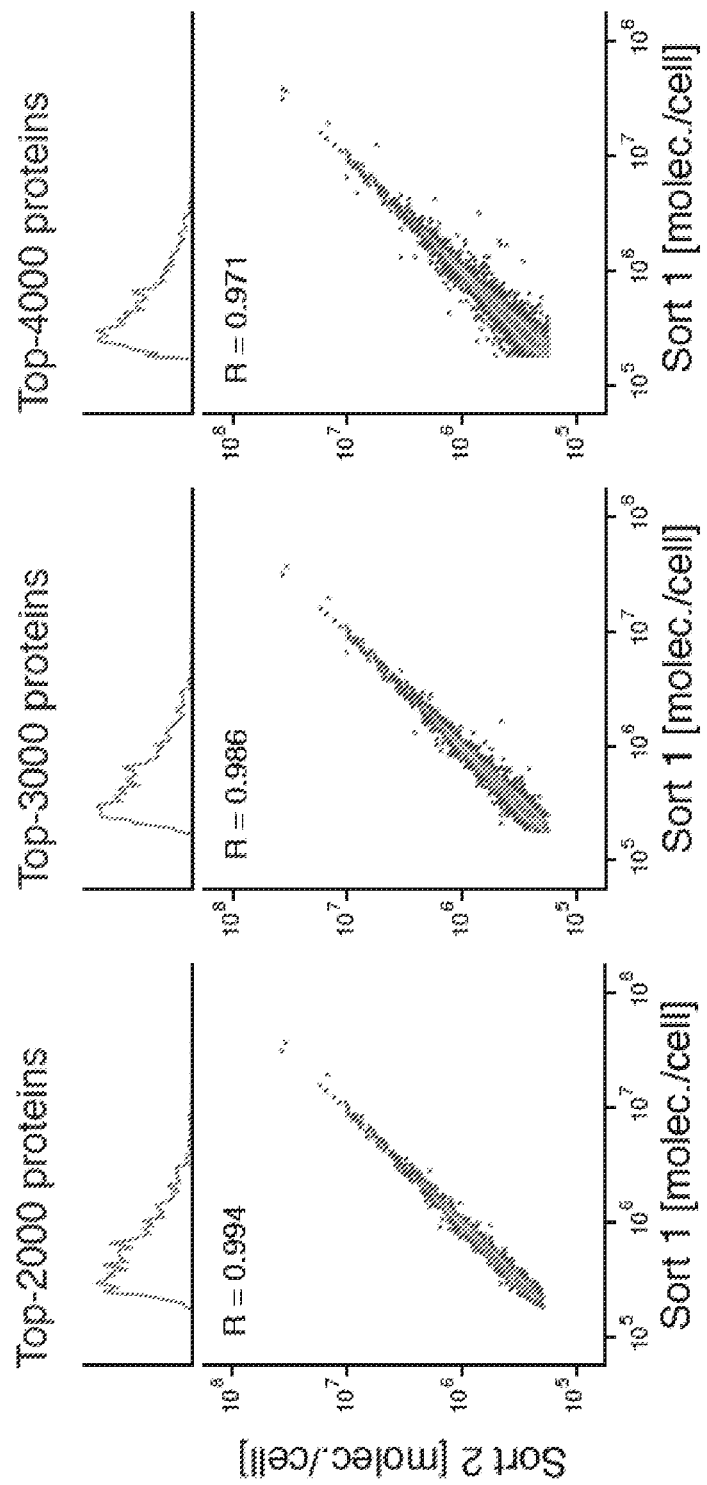

FIG. 32A-FIG. 32G—PATTERNS allows large-scale tagging of protein-coding genes and quantification of protein abundance. FIG. 32A shows PATTERNS workflow. Schematic representation of the generation of pooled RNP complexes starting from an oligo array template (Step 1), pooled NHEJ-mediated gene tagging leading to in-frame integration of an mNeonGreen-2A-NeoR cassette bearing a silent barcode (SEQ ID NO:69340) into a plurality of genes (Step 2), Tagmentation-based Tag Integration Site Sequencing (TTISS) to create a barcode dictionary (Step 3), and protein quantification through FACS sorting into eight bins and subsequent sequencing of silent barcodes in each bin (Step 4). A library of cells expressing fluorescently tagged endogenous proteins is sorted into eight expression bins. Quantitatively sequencing silent tag-specific barcodes in each bin allows inferring distributions of protein expression among single cells. FIG. 32B Examples of tag insertion densities in four protein-coding genes. TTISS read coverage is shown. FIG. 32C Breakdown of targeted protein-coding loci represented in the combined library of tagged cells. FIG. 32D Per-gene coverage in two replicate tagging libraries as measured by TTISS. FIG. 32E Empirical fluorescence distribution after FACS sorting the library of tagged cells and binning into 8 bins. FIG. 32F Representative protein abundance distributions from two library sorting replicates. FIG. 32G Correlation of measured mean protein levels between screening replicates for different protein representation cutoffs. R denotes Pearson correlation coefficient.

Figure 33A:
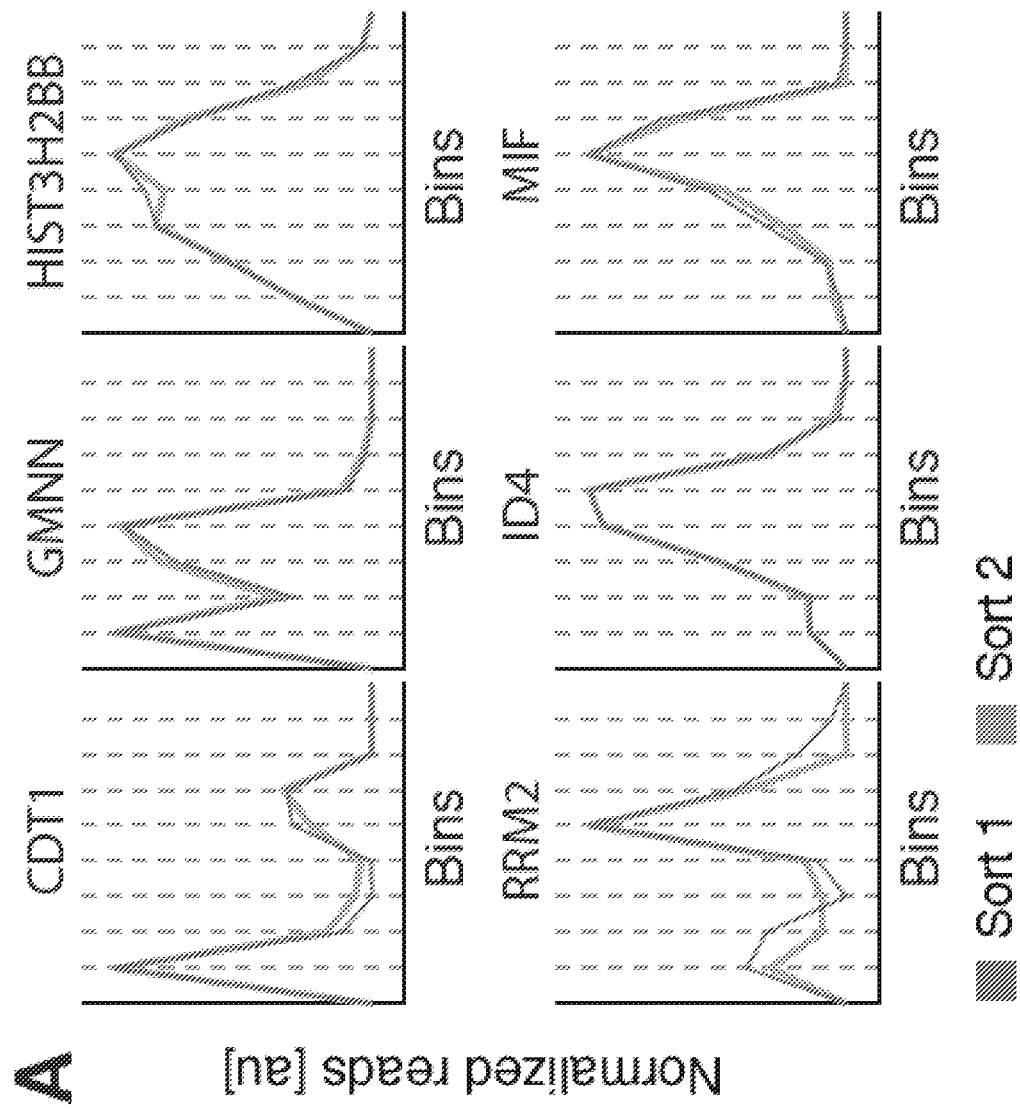
Figure 33D:
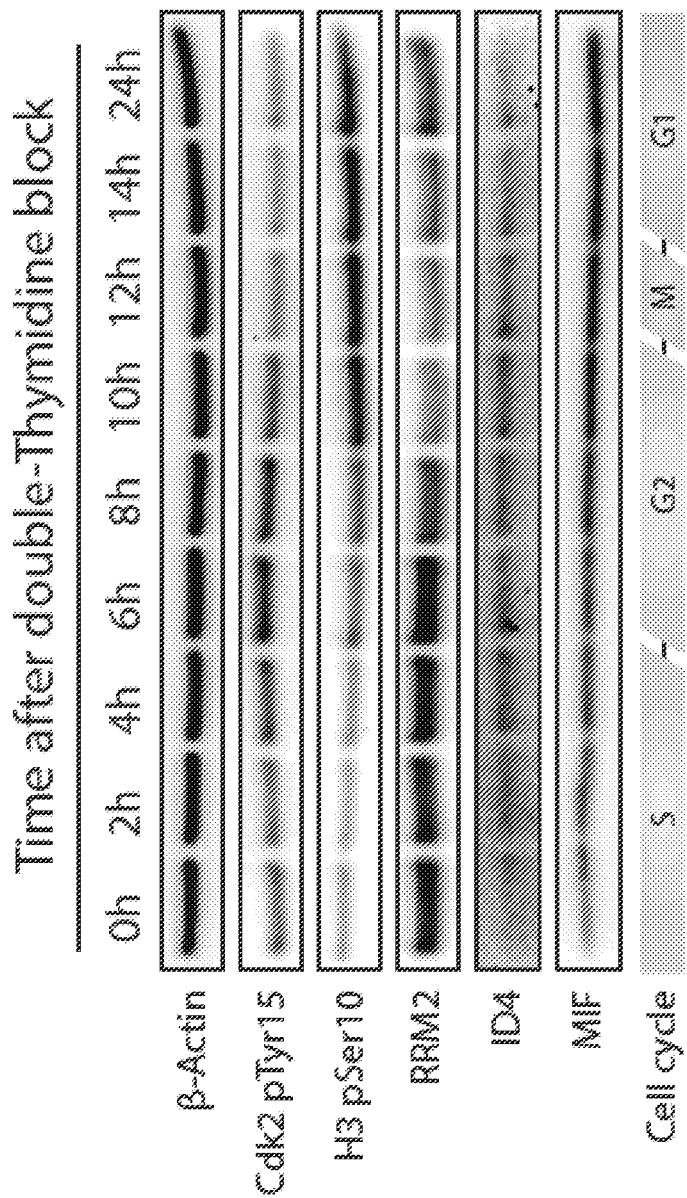

FIG. 33A-FIG. 33D—PATTERNS can be used to obtain single-cell distributions of protein abundance. FIG. 33A Examples of single-cell protein abundance distributions with broadened or bifurcated shape in two screening replicates. FIG. 33B Validation of bifurcated RRM2 abundance distribution measured in a tagged cell line by FACS. FIG. 33C Correlation of RRM2 levels with DNA content (Hoechst) validates RRM2 as a cell cycle-regulated protein. FIG. 33D Assessment of cell-cycle regulation of RRM2, ID4, and MIF by immuno-blotting of cells released for denoted amounts of time after double-Thymidine block.

Figure 34D:
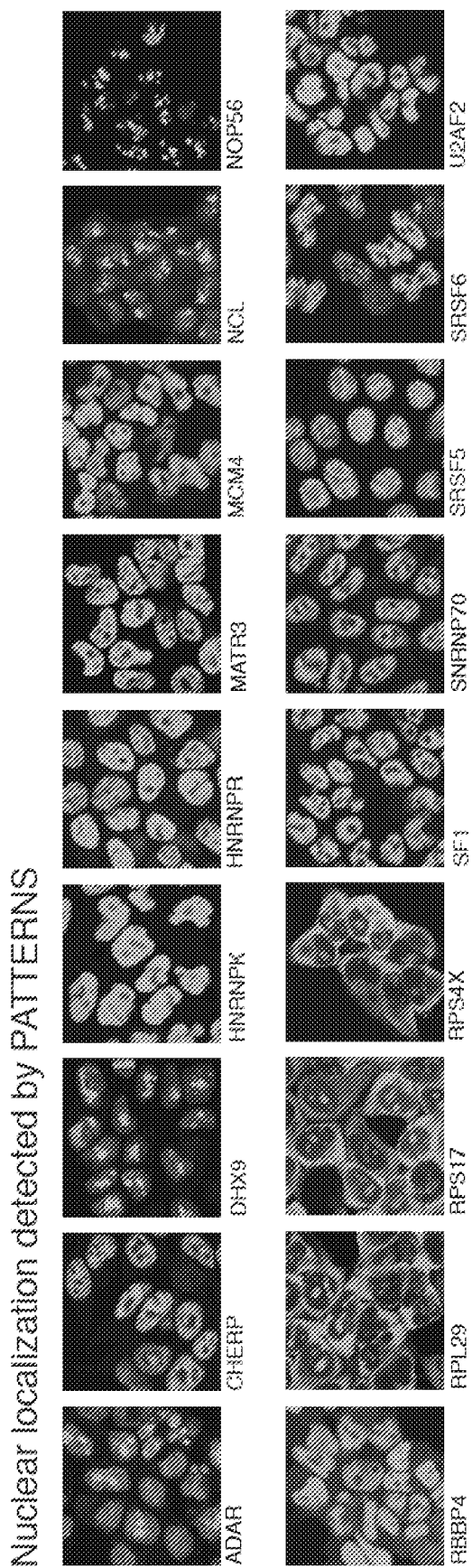
Figure 34E:
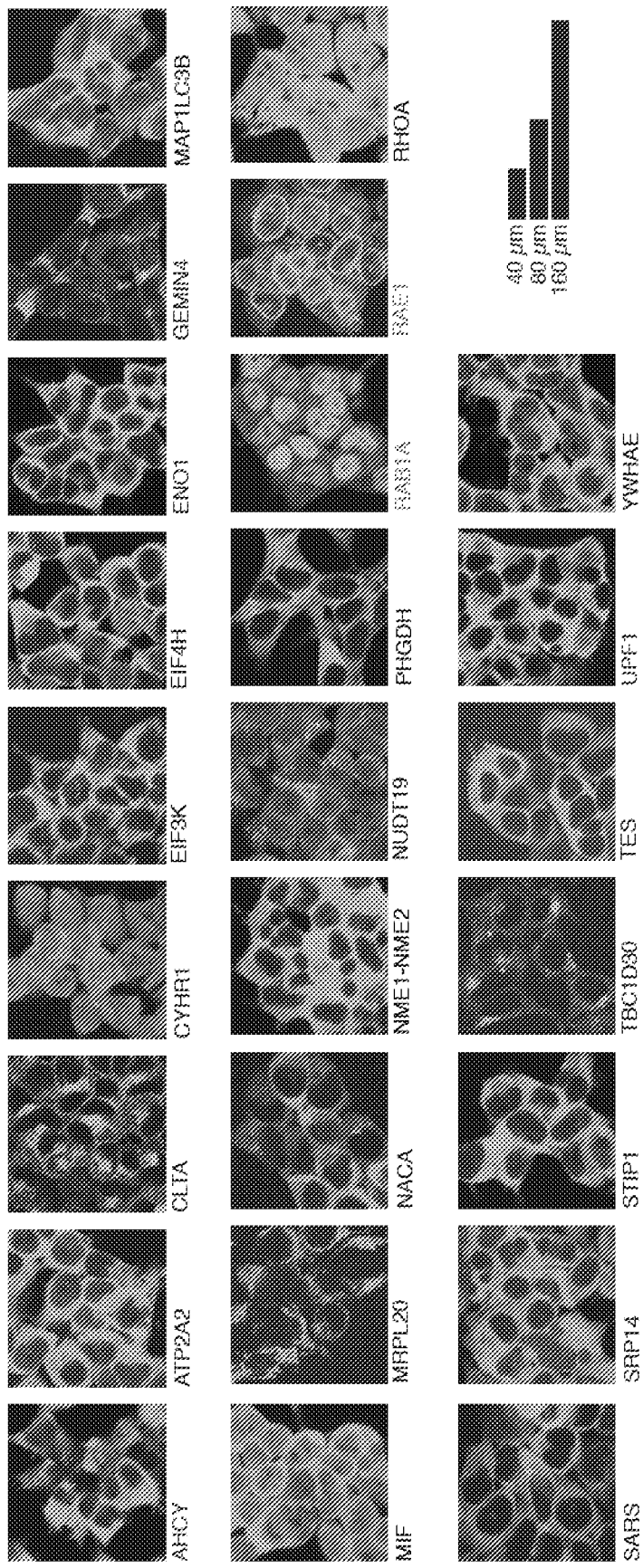

FIG. 34A-FIG. 34E—PATTERNS-mediated protein localization determination. FIG. 34A Schematic of PATTERNS-mediated protein localization assessment. FIG. 34B Protein quantification results from whole cells (X-axis) versus purified nuclei (Y-axis). The dashed line indicates the cutoff for nuclear localization calling. Histone proteins are marked. FIG. 34C Agreement between nuclear localization prediction methods based on PATTERNS and three published datasets using three different methods for nuclear protein localization detection. FIG. 34D, E Validation of nuclear (D) and non-nuclear (E) localization predictions by confocal microscopy of 43 clonal cell lines in which indicated proteins are tagged with mNeonGreen. The scale bars in (E) apply to both panels (D) and (E).

Figure 35I:
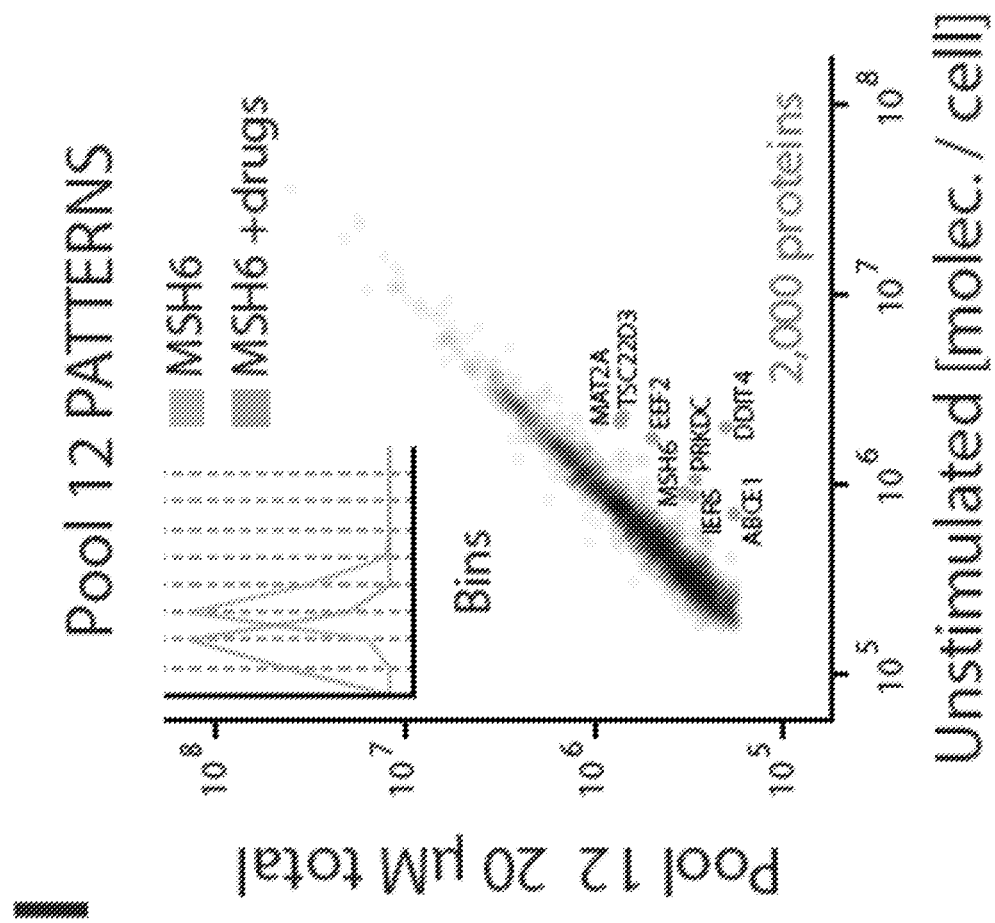

FIG. 35A-FIG. 35K—Unbiased drug target identification by PATTERNS. FIG. 35A Mean protein level measurements obtained by PATTERNS from Bortezomib-treated versus untreated control cells. Significant outlier proteins are denoted as dots; non-significant outliers are marked (See Methods). FIG. 35B Mean transcript expression measurements obtained by RNA-sequencing from Bortezomib-treated versus untreated control cells. The selection of genes shown is matched to the proteins quantified in (A) using PATTERNS. FIG. 35C Relative protein abundance measurements obtained by TMT labeling whole proteome mass spectrometry from Bortezomib-treated versus untreated control cells. Non-significant outliers are marked. Two TMT labelling replicate samples were combined for plotting by summation of raw reporter intensities. FIG. 35D Validation of predicted Bortezomib-regulated proteins using immuno-blotting of cells at indicated time points after drug treatment. FIG. 35E Quantification of proteins using PATTERNS upon application of a pool of 80 compounds at 20 µM total concentration for 6 h. Inset depicts single-cell protein abundance distribution of RBM39 with or without drug stimulation. FIG. 35F Mean transcript expression measurements obtained by RNA-sequencing from Indisulam-treated versus untreated control cells. The selection of genes shown is matched to the proteins quantified in (E) using PATTERNS. FIG. 35G Relative protein abundance measurements obtained by TMT labeling whole proteome mass spectrometry from Indisulam-treated versus untreated control cells. Non-significant outliers are marked. Two TMT labelling replicate samples were combined for plotting by summation of raw reporter intensities. FIG. 35H Validation of a predicted Indisulam-regulated protein using immunoblotting of cells at indicated time points after drug treatment. FIG. 35I Quantification of proteins using PATTERNS upon application of a second pool of 80 compounds at 20 µM total concentration for 6 h. Inset depicts single-cell protein abundance distribution of MSH6 with or without drug stimulation. FIG. 35J MSH6-mNeonGreen expression after application of single compounds at 125 nM for 6 h. Three hit compounds are annotated by name, all of which are known to target human Hsp90. FIG. 35K MSH6-mNeonGreen (left panel) and PRKDC-mNeonGreen (right panel) expression in single reporter cells at indicated time points after application of hit compound SNX-2112 at 125 nM.

Figure 36:
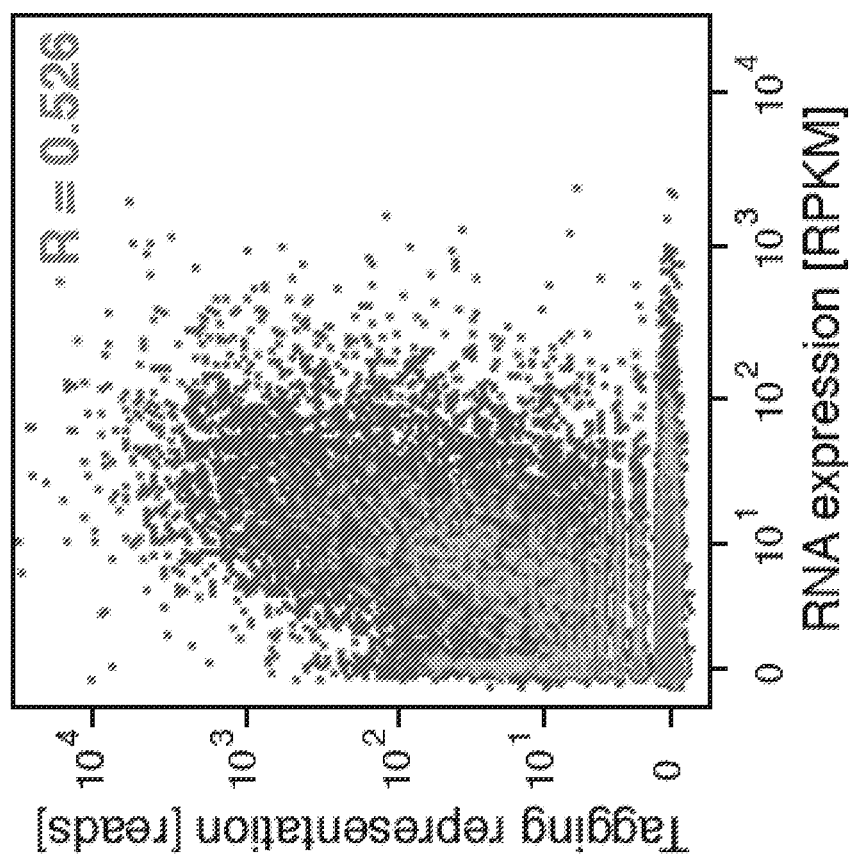

FIG. 36—Tagging library representation. Correlation of tagging library representation with RNA-seq gene expression data. Pearson R is denoted.

Figure 37A:
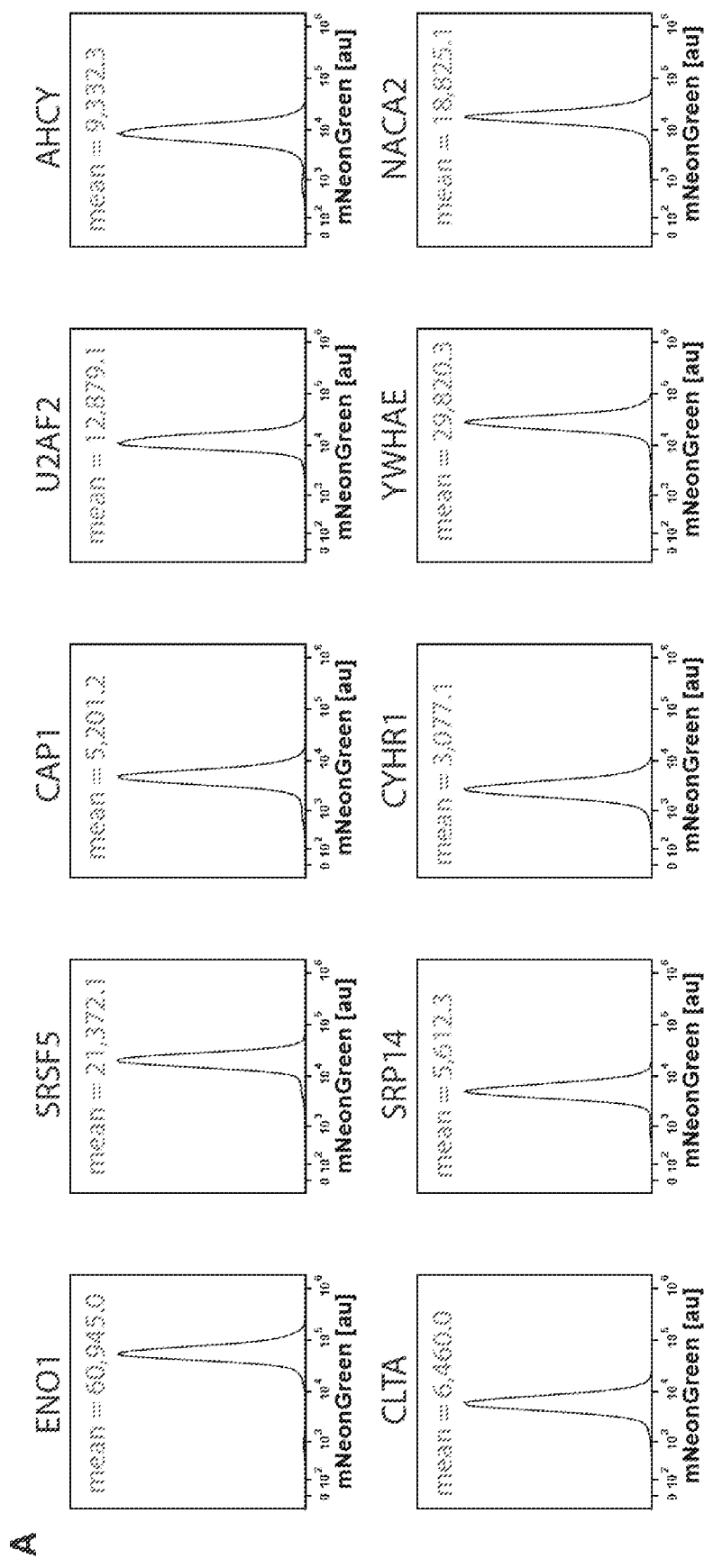

FIG. 37A-FIG. 37F—Absolute gauging of protein levels for FACS-sorted bins. FIG. 37A FACS histograms for ten mNeonGreen-myc-tagged cell lines used for gauging. FIG. 37B Immunoblotting results from defined cell numbers of tagged cell lines along with a defined myc-tagged protein standard. FIG. 37C Linear regression between mean florescence intensity of endogenously tagged proteins measured by FACS and band intensity quantification from blots shown in (B). FIG. 37D Linear regression between protein standard band intensity quantification from blots shown in (B) and absolute loaded molecule numbers. FIG. 37E Combined estimated relationship between mean fluorescence measured by FACS and the number of tagged protein molecules per cell. Note that the combined formula relies on an assumed proportionality of mean fluorescence measured by FACS and fluorescent protein abundance. FIG. 37F Estimation of the average number of mNeonGreen molecules per cell among bins of cells that were FACS-sorted for Tag-Seq proteome analysis, and re-analyzed using the same FACS analyzer as in (A). Fluorescent standard beads were included as controls in both runs to ensure reproducible sensitivity of the FACS analyzer (not shown).

Figure 38C:
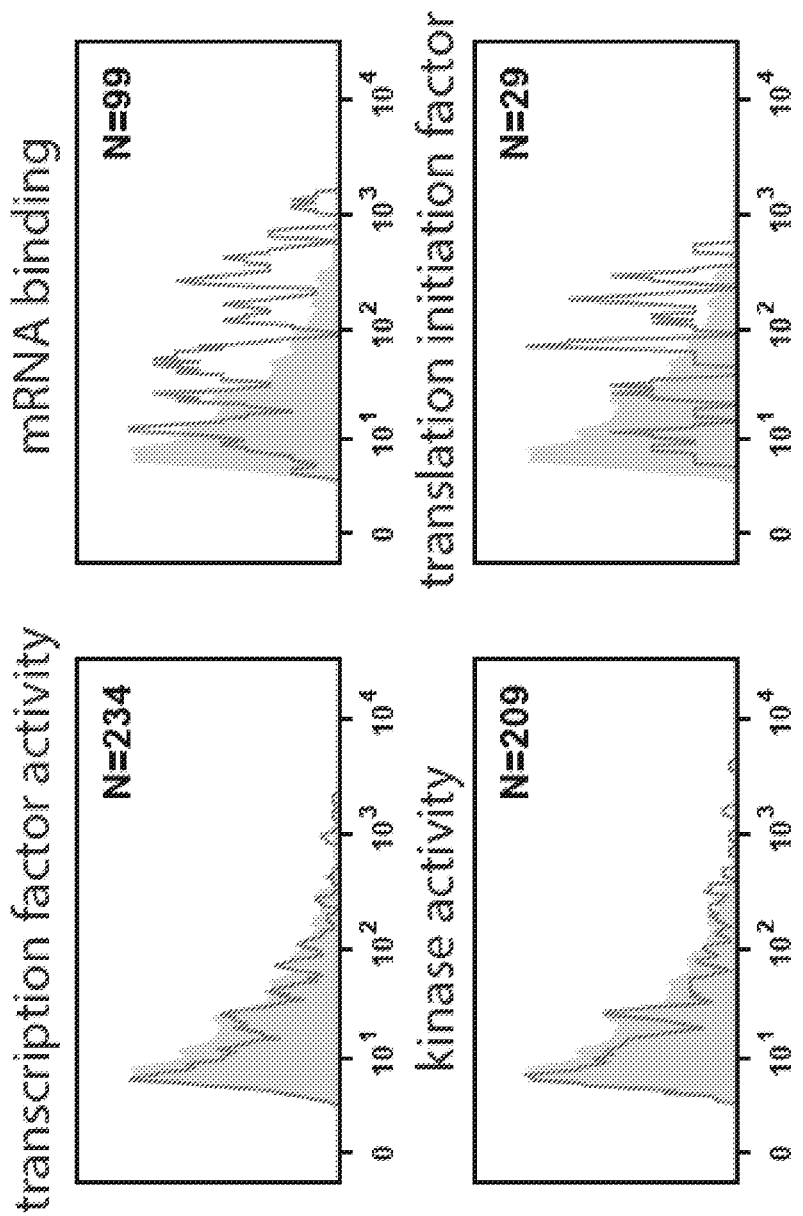

FIG. 38A-FIG. 38C—Additional protein quantification. FIG. 38A Correlation of measured mean protein expression levels between independent tagging libraries for different protein representation cutoffs. R denotes Pearson correlation coefficient. FIG. 38B Correlation of measured mean protein expression levels to RNA-seq gene expression data. FIG. 38C Comparison of protein abundance distributions of four protein families by GO molecular function annotation. Grey histograms denote the abundance distribution of all proteins covered.

Figure 39F:
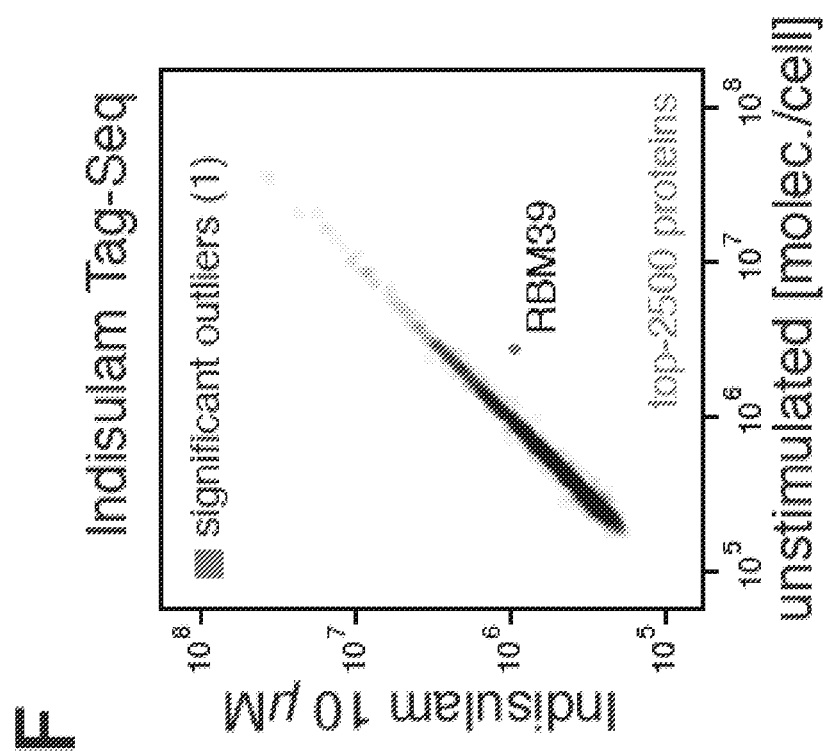

FIG. 39A-FIG. 39F—Additional drug screening results. FIG. 39A Mean protein expression measurements obtained by Tag-Seq from drug-treated versus untreated control cells. Significant outlier proteins are denoted as dots, non-significant outliers are marked (See Methods). FIG. 39B Mean transcript expression measurements obtained by RNA-sequencing from drug-treated versus untreated control cells. The selection of genes shown is matched to the proteins quantified in (A) using Tag-Seq. Outliers from Tag-Seq protein quantification are marked as colored dots. FIG. 39C Relative protein expression measurements obtained by TMT labeling whole proteome mass spectrometry from drug-treated versus untreated control cells. Non-significant outliers are marked. Replicates were combined for plotting by summation of raw reporter intensities. FIG. 39D Validation of predicted drug-regulated proteins using immuno-blotting of cells at indicated time points after drug treatment. FIG. 39E Validation of predicted drug-regulated proteins using indicated clonal mNeon-tagged reporter cell lines stimulated for six hours and analyzed by FACS. FIG. 39F Treatment of tagged library with Indisulam alone and then performing PATTERNS.

Figure 40A:
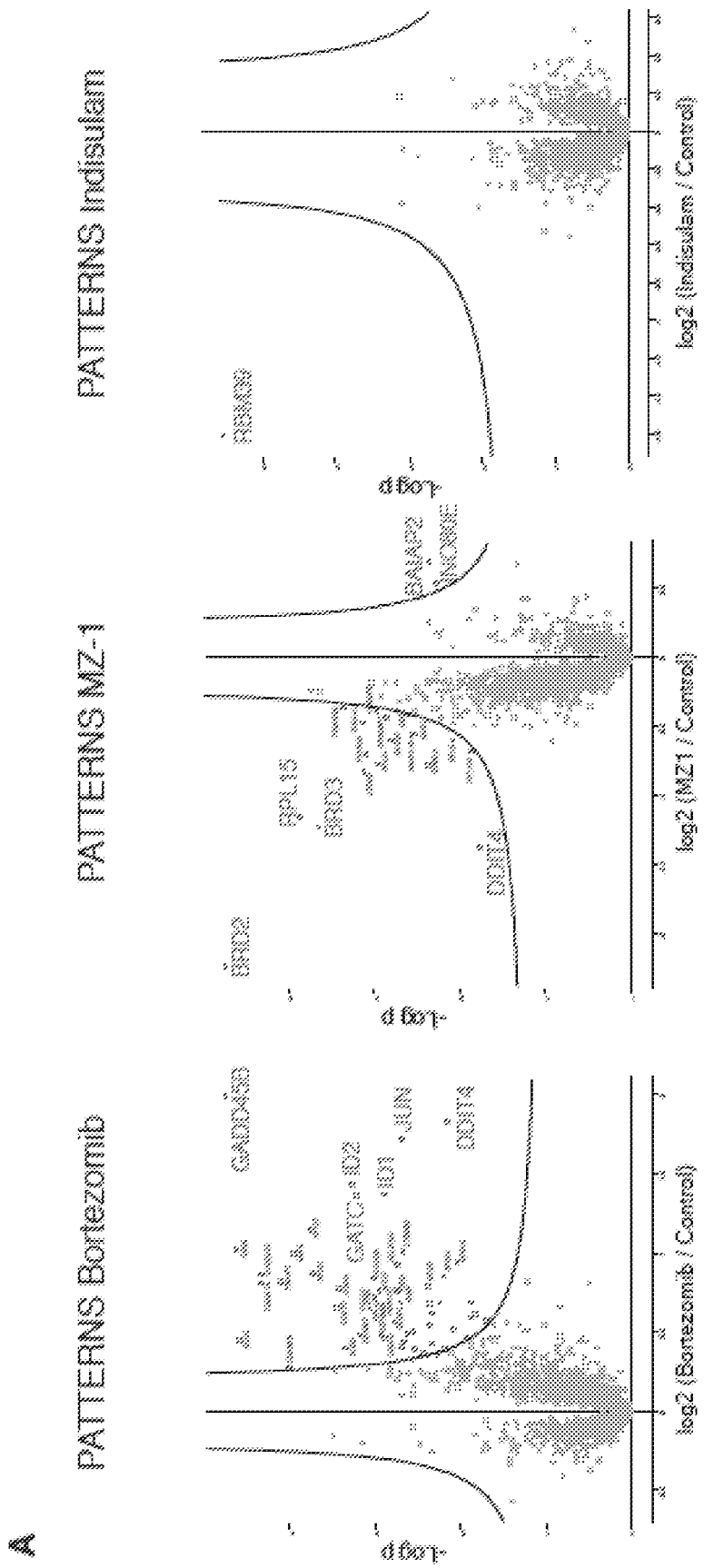
Figure 40B:
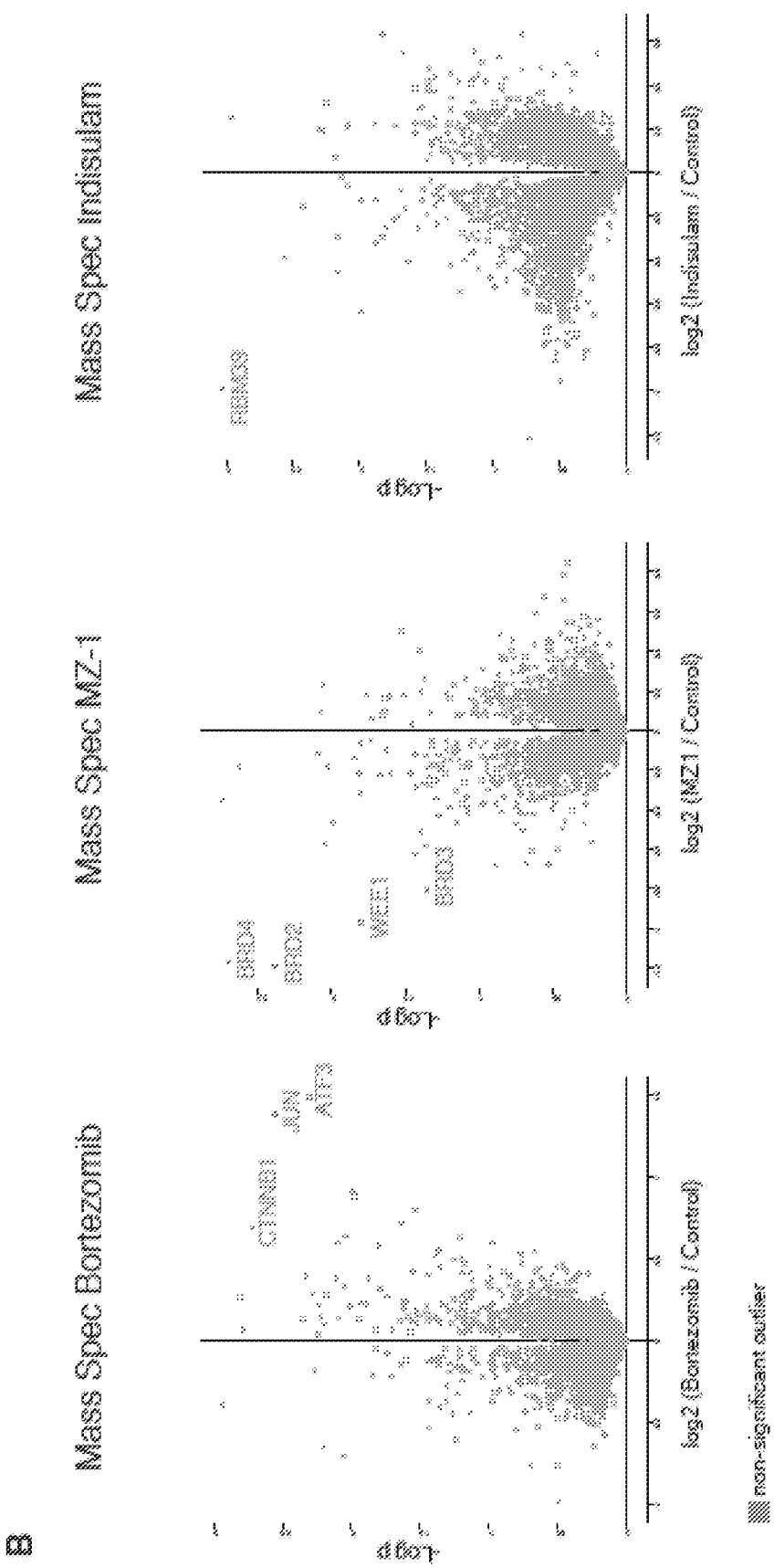

FIG. 40A-FIG. 40B—Statistical analysis of quantitative proteomics data. FIG. 40A shows Tag-seq (SBP) protein quantification data from two replicate screens that were median-subtracted and tested for drug regulated proteins (see Methods). The mean difference between conditions is plotted on the x-axis versus the −log P value on the y-axis. The two outliers RBM39 and BRD2 were identified to be statistically significant, as they are located above the black line indicating the significance threshold at an FDR of 5%. FIG. 40B shows TMT mass spectrometry protein quantification data that was filtered for missing values, log-2-transformed, median-subtracted, and tested for drug regulated proteins (see Methods). No outliers were identified to be statistically significant.

Figure 41:
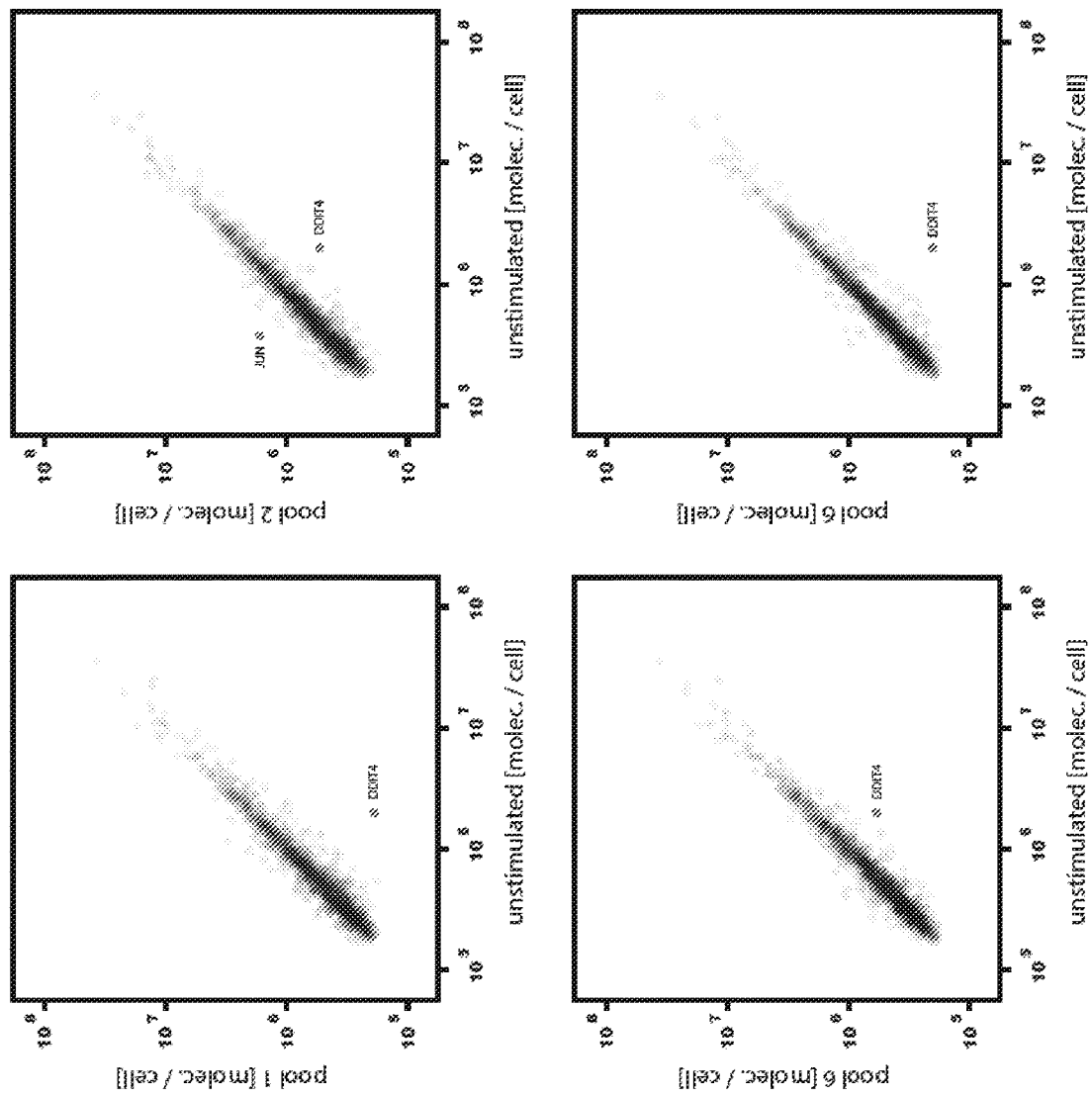
Figure 41:
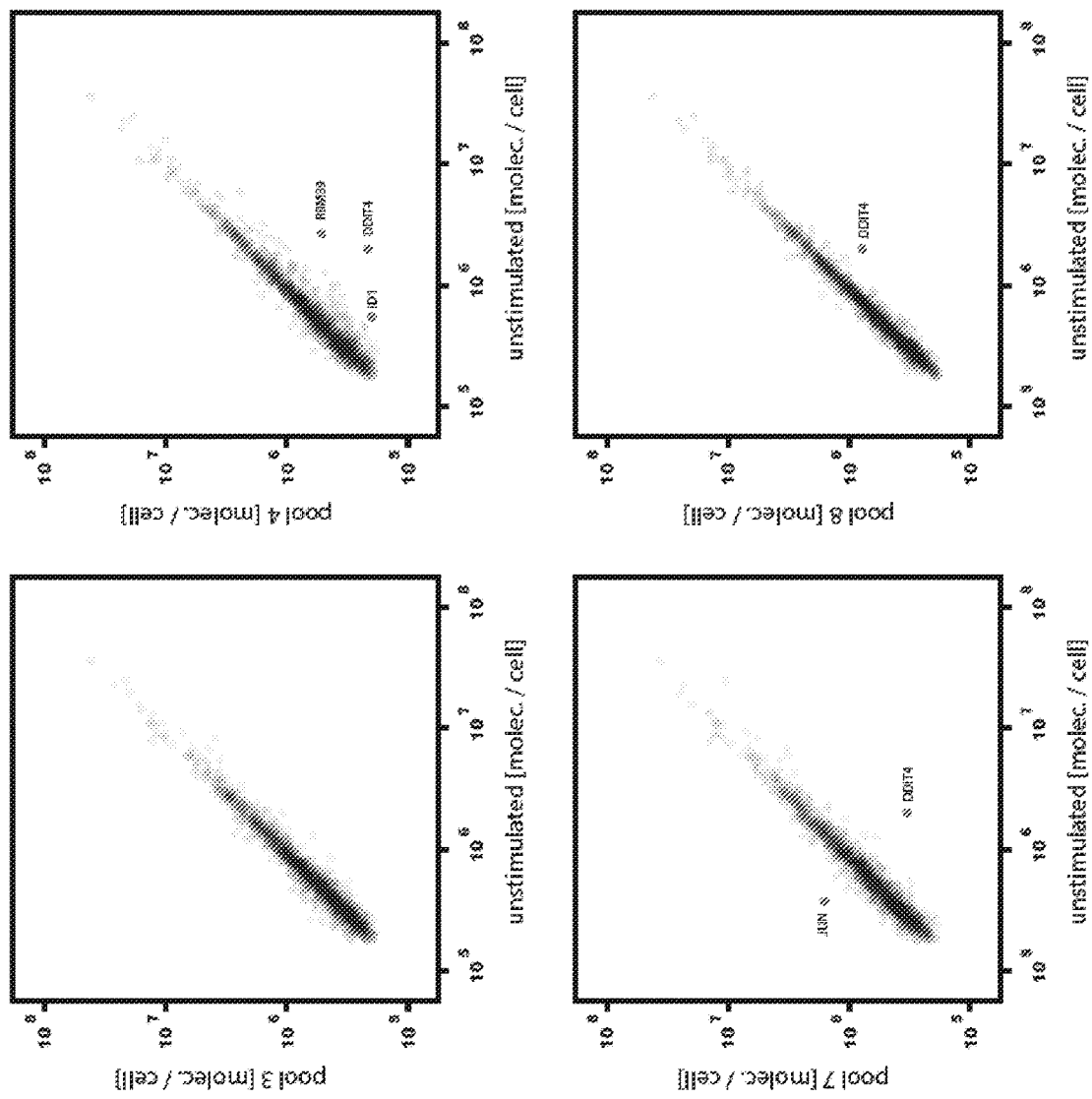
Figure 41:
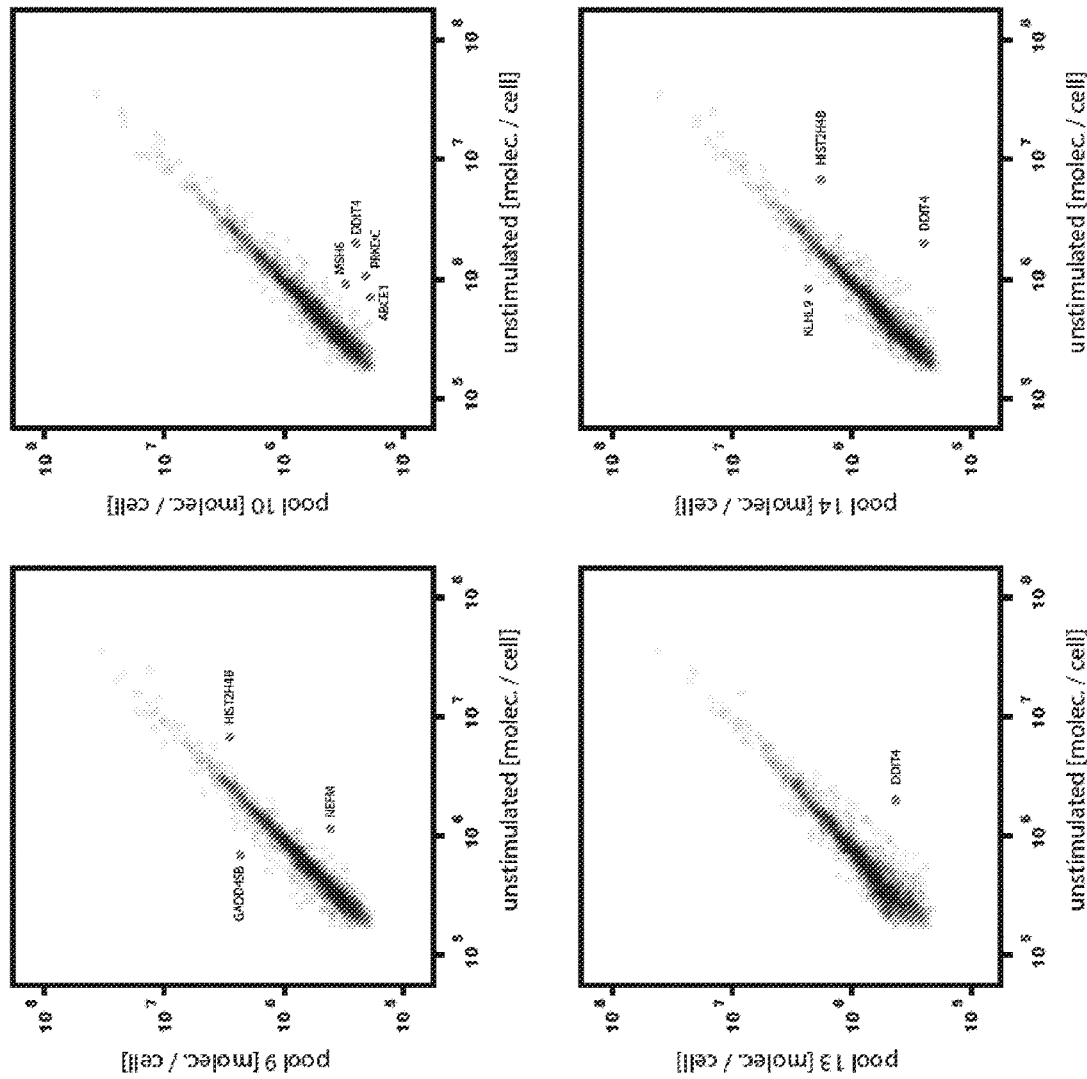

FIG. 41—Raw results from pooled drug screening. Tag-Seq proteome quantification upon application of 22 independent pools of up to 80 compounds each at 10 μM total concentration per pool for 6 h. Outlier proteins are marked.

FIG. 42A-FIG. 42I—Employing Tag-Seq in additional cell lines. FIG. 39A Seven cell lines were electroporated with Cas9 RNPs targeting the human TUBB gene locus and an mNeonGreen-NeoR donor DNA (see Materials and Methods section for details). Cells were expanded for ten days in G418-containing media and analyzed by FACS. Percentages indicate the fraction of cells whose green fluorescence exceeded the threshold indicated by the dashed line. FIG. 39B Representation of tagged genes in a polyclonal THP1 monocyte tagging library. FIG. 39C Quantification of 400 proteins in THP-1 monocytes with or without PMA stimulation. FIG. 39D Single-cell distributions of PMA-regulated proteins. FIG. 39E Western blot validation of predicted regulated proteins in (C). FIG. 39F Representation of tagged genes in a polyclonal SKMEL28 melanoma cell tagging library. FIG. 39G Quantification of 500 proteins in melanoma cells with or without Vemurafenib treatment. FIG. 39H Single-cell distributions of Vemurafenib-regulated proteins. FIG. 39I Western blot validation of predicted regulated proteins in (G).

DETAILED DESCRIPTION OF THE EXAMPLE EMBODIMENTS

General Definitions

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, $2^{nd}$ edition (1989) (Sambrook, Fritsch, and Maniatis); Molecular Cloning: A Laboratory Manual, $4^{th}$ edition (2012) (Green and Sambrook); Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratory Manual (1988) (Harlow and Lane, eds.): Antibodies A Laboratory Manual, $2^{nd}$ edition 2013 (E. A. Greenfield ed.); Animal Cell Culture (1987) (R.I. Freshney, ed.); Benjamin Lewin, Genes IX, published by Jones and Bartlett, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology $2^{nd}$ ed., J. Wiley & Sons (New York, N.Y. 1994), March, Advanced Organic Chemistry Reactions, Mechanisms and Structure $4^{th}$ ed., John Wiley & Sons (New York, N.Y. 1992); and Marten H. Hofker and Jan van Deursen, Transgenic Mouse Methods and Protocols, $2^{nd}$ edition (2011)

As used herein, the singular forms "a", "an", and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−10% or less, +/−5% or less, +/−1% or less, and +/−0.1% or less of and from the specified value, insofar such variations are appropriate to perform in the disclosed invention. It is to be understood that the value to which the modifier "about" or "approximately" refers is itself also specifically, and preferably, disclosed.

Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention. For example, in the appended claims, any of the claimed embodiments can be used in any combination.

All publications, published patent documents, and patent applications cited in this application are indicative of the level of skill in the art(s) to which the application pertains. All publications, published patent documents, and patent applications cited herein are hereby incorporated by reference to the same extent as though each individual publication, published patent document, or patent application was specifically and individually indicated as being incorporated by reference.

Overview

Many known cellular signaling pathways process information by modulating protein abundance, localization, or post-translational modifications (Liu, Y., Beyer, A. & Aebersold, R. On the Dependency of Cellular Protein Levels on mRNA Abundance. Cell 165, 535-550, doi: 10.1016/j.cell.2016.03.014 (2016); and Payne, S. H. The utility of protein and mRNA correlation. Trends Biochem Sci 40, 1-3, doi: 10.1016/j.tibs.2014.10.010 (2015)), but our ability to assess these changes in a high-throughput manner is hampered by the lack of a scalable method for monitoring a large number of proteins. Current methods for large-scale protein analysis largely rely on either affinity reagents like antibodies or aptamers, tagged protein overexpression, or mass spectrometry. However, high-quality affinity reagents do not exist for all human proteins and are expensive to validate (Egelhofer, T. A. et al. An assessment of histone-modification antibody quality. Nat Struct Mol Biol 18, 91-93, doi: 10.1038/nsmb. 1972 (2011); and Meliopoulos, V. A. & Schultz-Cherry, S. Although it's painful: The importance of stringent antibody validation. PLOS Pathog 14, e1006701, doi: 10.1371/journal.ppat.1006701 (2018)), tagged overexpression is prone to cause artifacts, and mass spectrometry is technically challenging and has limited sensitivity (Aebersold, R. & Mann, M. Mass-spectrometric exploration of proteome structure and function. Nature 537, 347-355, doi: 10.1038/nature19949 (2016)). Early studies in yeast and mammals have shown the value of a genome-scale library of GFP strains as a transformative resource that yields key biological insights (Huh, W. K. et al. Global analysis of protein localization in budding yeast. Nature 425, 686-691, doi: 10.1038/nature02026 (2003); and Cohen, A. A. et al. Dynamic proteomics of individual cancer cells in response to a drug. Science 322, 1511-1516, doi: 10.1126/science.1160165 (2008)), but those strains could not be studied in a pooled setting, requiring individual cultures and microscopy for detection. A refined understanding of molecular phenotypes requires scalable and quantitative methods for directly monitoring dynamic changes in protein abundance and localization.

At present, studying cellular signaling pathways at the systems level broadly relies on high-throughput gene transcription measurements by RNA sequencing. However, despite the fact that most cellular signaling pathways store and process information at the protein level by modulating protein abundance, localization, or post-translational modifications, currently no method exists for monitoring these important parameters in living cells at a proteome-wide scale.

To address these challenges, Applicants developed a Sequencing-Based Protein analysis method for mammalian cells (FIG. 22a, FIG. 32a), which combines polyclonal CRISPR-assisted gene tagging, FACS-mediated binning of tagged cells into expression levels, and efficient tag integration sequencing to enable large-scale proteomics. As used herein, "Sequencing-Based Protein analysis" (SBP) is also referred to as "PATTERNS" and "Tag-Seq" and the terms are used interchangeably. Here Applicants describe PATTERNS (Proteome Analysis Through Tagging Endogenous pRoteiNs and Sequencing), a novel approach to analyzing protein dynamics. Using CRISPR-mediated NHEJ, Applicants integrated fluorescent barcoded tags into protein-coding genes to create a library of human cells containing more than 11,000 endogenously tagged proteins. Applicants then used this library to develop a sequencing-based proteomics method (PATTERNS) that combines the scalability of flow cytometry and next-generation DNA sequencing to dynamically monitor the levels, single-cell distributions, and localizations of up to 4,000 proteins. Applicants show that PATTERNS successfully identifies cell-cycle regulated proteins and distinguishes between nuclear and non-nuclear localization of tagged proteins. Additionally, Applicants applied PATTERNS in multiple human cell lines to discover small-molecule drug targets that are not regulated at the transcript level. PATTERNS is an accessible protein analysis approach that offers a novel approach to studying proteome dynamics.

The sequence based proteomics approach described herein provides a main advantage of scalability in that any number of target genes can be used. The approach can also be used with any tagged library of cells. For example, a cell library where a set of target genes are tagged with a fluorescent maker.

Specific embodiments disclosed herein provide methods for quantification and localization of proteins in a cell, identification of protein interactions in a cell and identification of protein modifications in a cell, particularly a human cell. The methods described herein for sequencing-based proteomics utilize the CRISPR system to tag endogenous genes, along with deep DNA sequencing as an alternative to mass spectrometry, the current standard for analysis of the proteome. In certain embodiments, the present invention utilizes a genome-wide CRISPR guide sequence library to integrate sequences encoding a detectable marker (e.g., a fluorescent tag) into all endogenous protein-coding genes in a particular cell or cell type. Due to stochastic delivery of the target-specific guide sequences, most cells will have only one random gene tagged, but every gene will be covered by many independent single cells. The resulting library of protein-tagged cells can be FACS-sorted into bins according to expression levels of the reporters used, and the identity is then decoded by barcoded deep-sequencing. In other words, single cells are tagged at single endogenous genes and a library of cells is generated where each gene is tagged in a plurality of single cells in a population of cells. The population of cells can then be used for determining protein levels by sorting cells based on levels of the detectable marker and providing a sequencing readout of tagged genes. The sequencing-based proteomics (SBP) approach allows for rapid, global measurements of protein expression. The sequencing-based proteomics (SBP) approach can also be used to compare changes in protein levels, protein interactions or protein modifications as a result of a perturbation (e.g., chemical, genetic, or pathogens). Mean protein levels for a library can be determined before perturbation by sorting the library and sequencing. Changes in protein levels can then be determined in response to a perturbation. In certain embodiments, a tagged library can be introduced to an in vivo model and changes in protein levels can be determined by sorting and sequencing recovered cells. In certain embodiments, tagged libraries can be used to monitor protein levels over time by detecting expression of the tagged proteins in live cells. In certain embodiments, tagged cells can be binned and resorted to assess noise distribution per protein in live cells over time.

In an exemplary embodiment, the present invention can be used for exploring innate immune signaling by stimulating cells with pathogen-associated molecules and then subjecting them to proteomic analysis to generate a map of the relevant signaling pathways. In another exemplary embodiment, the present invention can be used for exploring differentiation programs by stimulating cells to differentiate and then subjecting them to proteomic analysis to generate a map of the relevant signaling pathways. Similarly, sequencing-based proteomics can be used to record proteome fingerprints of an array of drugs, which may provide new insight into their mechanisms of action. These methods may be used to better understand the fundamental role of the proteome in human health and disease.

The technology can also be extended to assess protein localization, modification, or protein-protein interactions on a proteome-wide scale by employing tags with localization- or interaction-dependent properties. The methods of the invention can thus be applied for analysis of immune signaling (e.g., innate and adaptive immune signaling), cell cycle biology, differentiation programs, and drug responses. In comparison to the well-established high-throughput mRNA sequencing, the SBP technology is expected to require lower sequencing depth, since read numbers per gene do not correlate with gene expression. The unique advantages of SBP will enable the analysis of high numbers of experimental conditions in parallel using currently available sequencing power.

Another advantage of the technology is that it does not only measure the average expression of a given protein in a population of cells, but it also reveals the distribution of protein expression among individual cells in a population; instead of mean expression obtained for each protein. This information could yield important insights into the mechanisms of signal processing in populations of cells. The methods also provide for routine quantification of 2000-4000 proteins, and semi-absolute quantification (estimated number of molecules per cell). The methods are also applicable to diverse cell lines.

Donor Constructs

In certain embodiments, a donor construct is integrated into a host cell genome to obtain a cell tagged at an endogenous gene. In certain embodiments, a donor construct is a polynucleotide sequence that can be used to integrate a detectable marker gene into an endogenous protein coding gene resulting in a fusion protein between the endogenous protein coding sequence and the detectable marker, such that the fusion protein is under the control of the endogenous regulatory sequences. Thus, tagged proteins are not overexpressed.

In certain embodiments, the donor construct comprises a nucleotide sequence encoding a detectable marker and, optionally, any one or more of a CRISPR target site, a codon-neutral unique molecular identifier (UMI) sequence, a selectable marker (e.g., resistance gene) operably linked to a regulatory sequence, a T7 promoter and, a protease cleavable marker or a protease.

CRISPaint (CRISPR-assisted insertion tagging) has been previously developed and allows precise and efficient integration of large heterologous DNA cassettes into eukaryotic genomes (Schmid-Burgk J L, et al., CRISPaint allows modular base-specific gene tagging using a ligase-4-dependent mechanism. Nat Commun. 2016 Jul. 28; 7:12338. doi: 10.1038/ncomms12338). In certain embodiments, the donor construct comprises a universal donor DNA as described and, optionally, is provided as minicircle DNA. In certain embodiments, a CRISPR-Cas9 system is used to introduce a double-strand break (DSB) at a user-defined genomic location and the universal donor is cleaved simultaneously to be integrated at the genomic DSB.

In some embodiments, the CRISPR system as described herein is used to integrate a polynucleotide sequence encoding a detectable marker. In certain embodiments, integration is by NHEJ, wherein CRISPR is used to cleave a donor construct and genomic target site and the genomic target site is repaired with the donor construct integrated.

In certain embodiments, the donor construct may comprise a nucleotide sequence encoding a CRISPR target site. The CRISPR target site may be a frame selector site, whereby cleaving with different frame selector guide sequences can select the proper frame for integration in frame with an endogenous protein coding sequence. Thus, processing the donor construct at three possible positions allows flexible reading-frame selection.

In certain embodiments, cells tagged with the donor construct are selected by measuring the detectable marker. The detectable marker may be used to detect expression from the endogenous protein coding locus. The detectable marker may also be used to select for tagged cells. In one embodiment, the most positive cells for the detectable marker are selected. In one embodiment, the top 0.5-5% expressing cells are selected. In certain embodiments, the top 0.5, 1, 2, 3, 4, 5, 6, 7, 8, 9, 10, up to 50% are selected. In certain embodiments, cells tagged with the donor construct are selected by selecting for the selectable marker. The selectable marker may be a resistance gene (e.g., selecting by contacting the cells with an antibiotic).

In certain embodiments, the donor construct may comprise a barcode sequence. The barcode sequence may be a unique molecular identifier (UMI). In certain embodiments, the present invention provides for a plurality of donor constructs each comprising a detectable marker and a codon-neutral UMI. Each donor construct may include a different UMI. The UMI can allow counting of every tagging event, as each donor construct will have a different UMI. In certain embodiments, if a population of cells is tagged at a number of endogenous genes with donor constructs including a UMI it is possible to count how many times each of the genes is tagged in different cells of the population. In certain embodiments, this information can be used to obtain more reliable protein expression data, ensuring independent tagging events in order to avoid clonal bias. In preferred embodiments, the UMI indicates the number of cells tagged at a target exhibiting a certain level of expression. In certain embodiments, a cut off may be chosen, such that the expression of a target is only considered if the expression is determined for a target in more than one cell. For example, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90, or more than 100 tagged cells.

Nucleic acid barcode, barcode, unique molecular identifier, or UMI refer to a short sequence of nucleotides (for example, DNA or RNA) that is used as an identifier for an associated molecule, such as a target molecule and/or target nucleic acid. A UMI is a type of barcode sequence and thus, barcode and UMI can be used interchangeably. A nucleic acid barcode or UMI can have a length of at least, for example, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90, or 100 nucleotides, and can be in single- or double-stranded form. In the present examples, silent UMIs having 9 and 14 bases are disclosed. In certain embodiments, longer silent DNA barcoding makes the method more scalable, fast, accessible, cheap, and reproducible e.g., 14 or more bases).

In certain embodiments, the UMI can be used to identify the tagged gene. A barcode dictionary can be generated for the library of tagged cells ("library") by sequencing the library and determining the UMI associated with each integration site. In certain embodiments, each tagging event is identified by a unique UMI and the identity of the tagged gene in each FACS sorted bin can be identified by sequencing the UMI's only. As used herein, barcode dictionary refers to a listing of all of the UMIs in a library and the tagged gene associated with each barcode. In the case of the same gene tagged in different cells in a library, multiple barcodes will correspond to a tagged gene. The presence of UMIs associated with the same tagged gene in different cells but sequenced in different bins can be used to determine differential expression of the gene in different single cells. For example, the same gene may be differentially expressed in different cells because the gene is a cell-cycle regulated gene, as discussed further herein.

The term "unique molecular identifiers" (UMI) generally refers to a sequencing linker or a subtype of nucleic acid barcode used in a method that uses molecular tags to detect and quantify unique amplified products. In certain embodiments, the UMI or barcode used in the present invention refers to a different UMI for each donor construct, such that each UMI is associated with a tagging event at a target gene in a single cell.

Unique molecular identifiers are a subtype of nucleic acid barcode that can be used, for example, to normalize samples for variable amplification efficiency. In certain embodiments, an UMI with a random sequence of between 4 and 20 base pairs is added to a template (e.g., donor construct), which is amplified and sequenced. In preferred embodiments, the UMI is added to the 5' end of the template. Sequencing allows for high resolution reads, enabling accurate detection of true variants (e.g., true tagging event). As used herein, a "true tagging event" will be present in every amplified product originating from the original clone as identified by aligning all products with a UMI. Each clone amplified will have a different random UMI that will indicate that the amplified product originated from that clone (i.e., each represents a tagging event). Background caused by the fidelity of the amplification process can be eliminated because true variants will be present in all amplified products and background representing random error will only be present in single amplification products (See e.g., Islam S. et al., 2014. Nature Methods No: 11, 163-166). Not being bound by a theory, the UMI's are designed such that assignment to the original can take place despite up to 4-7 errors during amplification or sequencing.

In certain embodiments, the donor constructs comprise a codon-neutral UMI (e.g., a silent DNA barcode). In certain embodiments, the UMI of the present invention is codon-neutral. A codon neutral UMI allows for each donor construct to have a unique barcode nucleotide sequence, but express the same amino acid sequence for the integrated donor sequence. The UMI may include 3, 4, 5, 6, 7, 8, 9, 10, 11, 12, 13, 14, 15, 16, 17, 18, 19, 20 or more random nucleotide bases. In certain embodiments, the random bases are included in the third base of each codon (i.e., wobble base pair). An example of codon neutral UMI is incorporation of 9 codon-neutral random bases into the forward primer of the donor. An example forward primer for a mNeon donor (H and N stand for random bases):/5phos/ G*G*C GGH TCN GGN GGN AGY GGN GGN GGN TCN GTGAGCAAGGGCGAGGAGGATAAC (SEQ ID NO:69332). In certain embodiments, software can be used that counts tagging events, while ignoring sequencing errors or uneven cellular expansion events that look like individual tagging events. In certain embodiments, the codon-neutral UMI is inserted in the sequence of the detectable marker.

In certain embodiments, target molecules and/or target nucleic acids can be labeled with multiple nucleic acid barcodes in combinatorial fashion, such as a nucleic acid barcode concatemer. Typically, a nucleic acid barcode is used to identify a target molecule and/or target nucleic acid as being from a particular discrete volume, having a particular physical property (for example, affinity, length, sequence, etc.), or having been subject to certain treatment conditions. Target molecule and/or target nucleic acid can be associated with multiple nucleic acid barcodes to provide information about all of these features (and more).

In certain embodiments, the T7 promoter may be used for T7 polymerase extension for determining integration site of the donor construct and/or identification of a UMI.

In certain embodiments, the donor construct includes a protease cleavage site and a cleavable epitope tag that can be used to determine localization if a localization specific protease is expressed. The protease cleavage site and cleavable epitope tag is encoded in frame with the fusion protein. The cleavable epitope tag and protease cleavage site may be used to determine localization of the protein fusion protein by co-expressing proteases specifically localized to a region of the cell (e.g., nuclear, cytoplasmic, mitochondrial, peroxisomal, ER, golgi, lysosomal, membrane, or cytoskeleton). In certain embodiments, the donor construct includes a protease that can be used to determine localization if a localization specific protease reporter construct is expressed. The protease is encoded in frame with the fusion protein. The protein protease fusion protein can be used to determine localization by co-expressing cleavable reporter proteins specifically localized to a region of the cell (e.g., nuclear, cytoplasmic, mitochondrial, peroxisomal, ER, golgi, lysosomal, membrane, or cytoskeleton). The cleavable reporter protein provides a detectable marker upon cleavage.

In certain embodiments, the donor construct may comprise the detectable marker and any combination of the above elements. For example, the donor construct may comprise a detectable marker and any of a selectable marker, UMI, T7 promoter, CRISPR target site, and protease cleavage site and epitope tag or protease.

In certain embodiments, the donor construct is obtained by PCR amplification of a template DNA molecule using 5' forward primers each comprising a codon neutral UMI. Each primer can include a different codon neutral UMI, while the rest of the primer sequence is the same. Applicants generated donor sequences by performing three separate PCRs using primers Donor-mNeon-UMI-PTO-fwd +0/+1/+2 and Donor-NeoR-PTO-rev (Table 1) and template plasmid pCRISPaint-mNeon-T2A-NeoR (Schmid-Burgk J L, et al., CRISPaint allows modular base-specific gene tagging using a ligase-4-dependent mechanism. Nat Commun. 2016 Jul. 28; 7:12338. doi: 10.1038/ncomms12338). In certain embodiments, the donor construct is modified to increase stability or to increase efficiency of integration into a genomic locus. In certain embodiments, the donor construct is modified by a 5' and/or 3' phosphorylation modification. In certain embodiments, the donor construct is modified by one or more internal or terminal PTO modifications. Phosphorothioate (PTO) modifications are used to generate nuclease resistant oligonucleotides. In PTO oligonucleotides, a non-bridging oxygen is replaced by a sulfur atom. Therefore, PTOs are also known as "S-oligos". Phosphorothioate can be introduced to an oligonucleotide at 5'- or 3'-end to inhibits exonuclease degradation and internally to limit the attack by endonucleases. In certain embodiments, the donor construct is obtained using PCR amplification and 5' phosphorylation is introduced using 5' phosphorylated primers.

In certain embodiments, the donor construct is a plasmid, vector, PCR product, viral genome, or synthesized polynucleotide sequence. The donor construct may be a plasmid and the plasmid may be cut to form the linear donor construct. The donor may be linearized with a restriction enzyme or a CRISPR system. The donor construct may be linearized in vitro. The donor construct plasmid may be introduced into a cell according to any method described herein (e.g., transfection) and linearized inside the cell to be tagged (e.g., CRISPR). The donor construct may be introduced by a vector. For example, replication of a recombinant adeno associated virus (AAV) can be used to generate a DNA donor construct. The donor construct may also be a PCR product amplified from a template DNA molecule. The donor construct may also be a synthesized polynucleotide sequence. The synthesized polynucleotide sequence can be amplified by PCR to generate the donor construct.

The term "vector" generally denotes a tool that allows or facilitates the transfer of an entity from one environment to another. More particularly, the term "vector" as used throughout this specification refers to nucleic acid molecules to which nucleic acid fragments may be inserted and cloned, i.e., propagated. Hence, a vector is typically a replicon, into which another nucleic acid segment may be inserted, such as to bring about the replication of the inserted segment in a defined host cell or vehicle organism.

A vector thus typically contains an origin of replication and other entities necessary for replication and/or maintenance in a host cell. A vector may typically contain one or more unique restriction sites allowing for insertion of nucleic acid fragments. A vector may also preferably contain a selection marker, such as, e.g., an antibiotic resistance gene or auxotrophic gene (e.g., URA3, which encodes an enzyme necessary for uracil biosynthesis or TRP1, which encodes an enzyme required for tryptophan biosynthesis), to allow selection of recipient cells that contain the vector. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art.

Expression vectors are generally configured to allow for and/or effect the expression of nucleic acids (e.g., CRISPR system) introduced thereto in a desired expression system, e.g., in vitro, in a host cell, host organ and/or host organism. For example, expression vectors may advantageously comprise suitable regulatory sequences.

Vectors may include, without limitation, plasmids (which refer to circular double stranded DNA loops which, in their vector form are not bound to the chromosome), episomes, phagemids, bacteriophages, bacteriophage-derived vectors, bacterial artificial chromosomes (BAC), yeast artificial chromosomes (YAC), P1-derived artificial chromosomes (PAC), transposons, cosmids, linear nucleic acids, viral vectors, etc., as appropriate. A vector can be a DNA or RNA vector. A vector can be a self-replicating extrachromosomal vector or a vector which integrates into a host genome, hence, vectors can be autonomous or integrative.

The term "viral vectors" refers to the use as viruses, or virus-associated vectors as carriers of the nucleic acid construct into the cell. Constructs may be integrated and packaged into non-replicating, defective viral genomes like adenovirus, adeno-associated virus (AAV), or herpes simplex virus (HSV) or others, including retroviral and lentiviral vectors, for infection or transduction into cells. The vector may or may not be incorporated into the cells genome. The constructs may include viral sequences for transfection, if desired. Alternatively, the construct may be incorporated into vectors capable of episomal replication, e.g., EPV and EBV vectors.

Methods for introducing nucleic acids, including vectors, expression cassettes, expression vectors, and RNPs into cells (transfection or transformation) are known to the person skilled in the art, and may include calcium phosphate co-precipitation, electroporation, micro-injection, protoplast fusion, lipofection, exosome-mediated transfection, transfection employing polyamine transfection reagents, bombardment of cells by nucleic acid-coated tungsten micro projectiles, viral particle delivery, etc.

Detectable Markers

In certain embodiments, the detectable marker is a fluorescent protein such as green fluorescent protein (GFP), enhanced green fluorescent protein (EGFP), red fluorescent protein (RFP), blue fluorescent protein (BFP), cyan fluorescent protein (CFP), yellow fluorescent protein (YFP), miRFP (e.g., miRFP670, see, Shcherbakova, et al., Nat Commun. 2016; 7: 12405), mCherry, tdTomato, DsRed-Monomer, DsRed-Express, DSRed-Express2, DsRed2, AsRed2, mStrawberry, mPlum, mRaspberry, HcRed1, E2-Crimson, mOrange, mOrange2, mBanana, ZsYellow1, TagBFP, mTagBFP2, Azurite, EBFP2, mKalama1, Sirius, Sapphire, T-Sapphire, ECFP, Cerulean, SCFP3A, mTurquoise, mTurquoise2, monomelic Midoriishi-Cyan, TagCFP, niTFP1, Emerald, Superfolder GFP, Monomeric Azami Green, TagGFP2, mUKG, mWasabi, Clover, mNeonGreen, Citrine, Venus, SYFP2, TagYFP, Monomeric Kusabira-Orange, mKOK, mK02, mTangerine, mApple, mRuby, mRuby2, HcRed-Tandem, mKate2, mNeptune, NiFP, mkeima Red, LSS-mKate1, LSS-mkate2, mBeRFP, PA-GFP, PAmCherry 1, PATagRFP, TagRFP6457, IFP1.2, iRFP, Kaede (green), Kaede (red), KikGR1 (green), KikGR1 (red), PS-CFP2, mEos2 (green), mEos2 (red), mEos3.2 (green), mEos3.2 (red), PSmOrange, Dronpa, Dendra2, Timer, AmCyan1, or a combination thereof. In certain embodiments, the detectable marker is a cell surface marker. In other instances, the cell surface marker is a marker not normally expressed on the cells, such as a truncated nerve growth factor receptor (tNGFR), a truncated epidermal growth factor receptor (tEGFR), CD8, truncated CD8, CD19, truncated CD19, a variant thereof, a fragment thereof, a derivative thereof, or a combination thereof. In certain embodiments, the detectable marker is an epitope tag. An epitope tag may include, but is not limited to, Flag, CBP, GST, HA, HBH, MBP, Myc, polyHis, S-tag, SUMO, TAP, TRX, SpyTag, StrepTag, Ollas, or V5.

In certain embodiments, the signal of the detectable marker may be detected or enhanced by using a fluorescently labeled antibody, antibody fragment, nanobody, or aptamer. The binding agent may be specific to the detectable marker.

Selectable Markers

In some embodiments, the polynucleotide sequence may further comprise a selectable marker that is expressed as a separate protein from the tagged target gene, detectable marker fusion protein. The selectable marker may be operably linked to a separate regulatory element, or separated from the fusion protein sequence by an IRES or ribosomal skipping site.

In certain embodiments, the detectable marker is separated from the marker gene by a ribosomal skipping site. Ribosomal 'skipping' refers to generating more than one protein during translation where a specific sequence in the nascent peptide chain prevents the ribosome from creating the peptide bond with the next proline. Translation continues and gives rise to a second chain. This mechanism results in apparent co-translational cleavage of the polyprotein. This process is induced by a '2A-like', or CHYSEL (cis-acting hydrolase element) sequence. In other words, a normal peptide bond is impaired at the site, resulting in two discontinuous protein fragments from one translation event. 2A peptides are 18-22 amino-acid (aa)-long viral oligopeptides that mediate "cleavage" of polypeptides during translation in eukaryotic cells. The designation "2A" refers to a specific region of the viral genome and different viral 2As have generally been named after the virus they were derived from. The first discovered 2A was F2A (foot-and-mouth disease virus), after which E2A (equine rhinitis A virus), P2A (porcine teschovirus-1 2A), and T2A (thosea asigna virus 2A) were also identified. (see, e.g., Liu et al., Systematic comparison of 2A peptides for cloning multi-genes in a polycistronic vector. Sci Rep. 2017; 7:2193).

Selectable markers are known in the art and enable screening for targeted integrations, i.e., a protein present in the cell and to which a tag is attached. A selectable marker useful in accordance with the invention may be any selectable marker appropriate for use in a eukaryotic cell, such as a mammalian cell, or more specifically a human cell. One of skill in the art will understand and be able to identify and use selectable markers in accordance with the invention. Suitable selection genes for use in mammalian cell expression include, but are not limited to, genes enabling for nutritional selection, such as the thymidine kinase gene (TK), glutamine synthetase gene (GS), tryptophan synthase gene (trpB) or histidinol dehydrogenase gene (hisD). Further, selection markers are antimetabolite resistance genes conferring drug resistance, such as the dihydrofolate reductase gene (dhfr) which can be selected for with hypoxanthine and thymidine deficient medium and further selected for with methotrexate, the xanthine-guanine phosphoribosyltransferase gene (gpt), which can be selected for with mycophenolic acid, the neomycin phosphotransferase gene (neo) which can be selected for with G418 in eukaryotic cell and neomycin or kanamycin in prokaryotic cells, the hygromycin B phosphotransferase (hyg, hph, hpt) gene which can be selected for with hygromycin, the puromycin N-acetyltransferase gene (pac) which can be selected with puromycin or the Blasticidin S deaminase gene (Bsd) which can be selected with blasticidin. In preferred embodiments, Bsd is used to select for tagged cells as tagging is improved as compared to selection with puro and hygro. Finally, genes encoding proteins that enables sorting e.g. by flow cytometry can also be used as selection markers, such as green fluorescent protein (GFP) (or any fluorescent protein discussed for detectable markers), the nerve growth factor receptor (NGFR) or other membrane proteins, or beta-galactosidase (LacZ).

Cell Libraries

In some embodiments, the invention provides cell libraries for use in detecting protein expression. Such libraries may comprise a plurality of cells, wherein each cell comprises a polynucleotide sequence that encodes a detectable marker integrated into the genome of the cell. The polynucleotide sequence may be integrated into the genome of the host cell in-frame with a protein coding gene. In certain embodiments, the library of tagged cells is sequenced prior to performing sequence based proteomics, such that each UMI or barcode can be associated with a target gene in the library. Thus, the library of tagged cells is sequenced verified and a barcode dictionary for the library is obtained. In certain embodiments, the library is used for proteomic experiments and barcodes can be identified for each sorted bin. Thus, the identity of each protein expressed in a single cell in each sorted bin can be identified by sequencing of the barcode. The level of expression is determined by the sorting and not by the number of UMI.

The protein coding gene may be selected from a set of target genes (see, e.g., Table 2). As described herein, the library comprises more than one cell tagged at each target gene, whereby each gene in the set of genes is tagged with a detectable marker in single cells of the library. In other words, while each cell contains only one tagged gene, multiple cells may have the same gene tagged, therefore each gene may be represented more than once in the library. Some specific embodiments provide for tagging of all protein coding genes at one time. Such a cell library enables identification and/or assessment or quantification of one or more proteins in a cell or cell type. In some embodiments, such a cell library identifies and/or assesses all proteins encoded by a particular cell or cell type. The set of target genes may comprise every protein coding gene in a cell (e.g., genome wide). The set of target genes may represent a specific pathway or gene signature, such that factors (e.g., drugs, pathogens, cytokines, time, interaction with microenvironment) that modulate the specific pathway or signature may be determined.

As described herein, a target gene may be any gene of interest or any gene for which expression analysis is desired. For example, a target gene as described herein may be a protein coding gene (e.g. every protein coding gene in a genome or a subset of protein coding genes of interest). In some embodiments, a target gene may be a gene that is to be down-regulated. In some embodiments, a target gene may be a gene that is to be up-regulated. One of skill in the art will understand the meaning of a target gene as presently claimed.

In some embodiments, the invention provides a library as herein discussed, wherein the targeting is of about 100 or more genes, or the targeting may be of about 1000 or more genes, or the targeting may be of about 20,000 or more genes. In some specific embodiments, the invention provides a library as herein discussed, wherein the targeting is of the entire proteome, or the entire collection of proteins or gene products of the cell or of a particular cell type. In some embodiments, the invention provides a cell library wherein every protein of an organism is represented at least once in the library. In other embodiments, every protein may be represented one time in a single cell, and represented multiple times in the library. In some embodiments, every target gene is tagged at more than one independent insertion position. In some embodiments, a library as described herein may contain a panel of target sequences focused on a relevant or desirable pathway. For example, a relevant or desirable pathway may be a biological pathway, such as an immune pathway or a cell division pathway. Other embodiments provide a cell library containing all proteins of any pathway of interest, as appropriate for the particular use or application.

In certain embodiments, each cell may comprise a sequence encoding a guide sequence specific for the tagged target gene, whereby detection of the sequence indicates the tagged target gene. A guide sequence may be generated or designed for any or all proteins in the proteome. In other embodiments, a barcode associated with a specific guide sequence is expressed in each cell. In certain embodiments, the barcode is expressed as a polyadenylated transcript. In certain embodiments, the transcript is expressed from the same construct as the guide sequence, whereby expression of the guide sequence correlates to expression of the barcode transcript. The barcodes may be determined by RNA sequencing of sorted cells and therefore can be associated with a target gene expression level. Barcoded transcripts for determining guide sequences introduced into a cell have been described (see, e.g., Dixit et al., "Perturb-Seq: Dissecting Molecular Circuits with Scalable Single-Cell RNA Profiling of Pooled Genetic Screens" 2016, Cell 167, 1853-1866; Adamson et al., "A Multiplexed Single-Cell CRISPR Screening Platform Enables Systematic Dissection of the Unfolded Protein Response" 2016, Cell 167, 1867-1882; and International publication serial number WO/2017/075294). In this way, tagging of every protein in the proteome of a cell or cell type as described herein will enable sequencing and subsequent identification of every protein, along with detection of the expression levels of all proteins.

In other embodiments, a library as described herein may comprise eukaryotic cells, such as mammalian, insect, yeast, plant, or synthetic cells. Any particular cell type may be used as desired or as appropriate for the particular application. In some embodiments, any cell type may include, but is not limited to, cells from any area, organ, muscle, tissue, or the like. In some embodiments, the cells of a library as described herein may be configured to express a CRISPR enzyme (e.g., cells stably expressing a transgene, cells from a CRISPR transgenic animal). The CRISPR enzyme may be part of the CRISPR system and may be introduced into the cell of the library by any means available and/or known in the art. CRISPR enzymes or systems as described herein may, in some embodiments, be introduced into a cell or cells in active form (i.e. as a ribonucleoprotein complex (RNP)), or may be introduced in a form that requires expression of the necessary components, such as on an expression vector. In other embodiments, a CRISPR enzyme as described herein may be inducible. In another embodiment, the cells were obtained from a transgenic animal configured to express a CRISPR enzyme.

In some embodiments, a cell suitable for construction of a library as described herein may be a cell having in its genome a nucleic acid construct encoding a CRISPR system as described herein. The CRISPR system may be incorporated into the cell from a construct comprising a nucleic acid encoding the CRISPR system. In such cases, the CRISPR system may be delivered and/or present on one construct and a guide sequence targeting the CRISPR system to a particular nucleic acid target may be delivered and/or present on a second construct. In some embodiments, the Cas nuclease and guide sequence may be operably linked and thus delivered together on a single construct.

In another aspect, the invention provides a cell library for use in detecting protein interactions between a protein of interest and a set of target proteins, said library comprising a plurality of cells, wherein each cell comprises a first polynucleotide sequence encoding a first complementary protein integrated into the genome of the cell in frame with the protein of interest, wherein each cell comprises a second polynucleotide sequence encoding a second complementary protein integrated into the genome of the cell in frame with a protein coding gene selected from a set of target genes, wherein the library comprises more than one cell tagged at each target gene, whereby each gene in the set of genes is tagged with a second complementary protein in single cells of the library. In certain embodiments, the first and second polynucleotide sequence may encode an epitope for use in a proximity ligation assay, a recognition site for measurement of interaction by TEV cleavage of nearby target sites or a protein complementation assay fragment as described herein. In one embodiment, the second polynucleotide sequence comprises a selectable marker operably linked to a separate regulatory element. In another embodiment, the selectable marker may be an antibiotic resistance gene as described herein. In another embodiment, the second polynucleotide sequence may comprise a T7 RNA polymerase promoter. In another embodiment, each cell comprises a sequence encoding a guide sequence specific for the tagged target gene, whereby detection of the sequence indicates the tagged target gene. In other embodiments, the library comprises eukaryotic cells, such as mammalian, insect, yeast, or plant cells. In other embodiments, the cells are configured to express a CRISPR enzyme, or the CRISPR enzyme is inducible. In another embodiment, the cells were obtained from a transgenic animal configured to express a CRISPR enzyme.

In another aspect, the invention provides a cell library for use in detecting protein modifications comprising a plurality of cells, wherein each cell stably expresses a fusion protein comprising a protein modification binding protein fused to a first complementary protein, wherein each cell comprises a polynucleotide sequence encoding a second complementary protein integrated into the genome of the cell in frame with a protein coding gene selected from a set of target genes, wherein the library comprises more than one cell tagged at each target gene, whereby each gene in the set of genes is tagged with a second complementary protein in single cells of the library. In other embodiments, the first and second polynucleotide sequence may encode an epitope for use in a proximity ligation assay, a recognition site for measurement of interaction by TEV cleavage of nearby target sites or a protein complementation assay fragment as described herein. In one embodiment, the polynucleotide sequence comprises a selectable marker operably linked to a separate regulatory element. In another embodiment, the selectable marker is an antibiotic resistance gene. In another embodiment, the polynucleotide sequence comprises a T7 RNA polymerase promoter. In another embodiment, each cell comprises a sequence encoding a guide sequence specific for the tagged target gene, whereby detection of the sequence indicates the tagged target gene. In another embodiment, the library comprises eukaryotic cells, such as mammalian, insect, yeast, or plant cells. In other embodiments, the cells are configured to express a CRISPR enzyme, or the CRISPR enzyme is inducible. In another embodiment, the cells were obtained from a transgenic animal configured to express a CRISPR enzyme.

In certain embodiments, the cell libraries may be monitored in live cells using live cell microscopy. In certain embodiments, cell libraries are analyzed using in situ sequencing of barcodes. In certain embodiments, live cells expressing a detectable marker are monitored and a video of the changes in expression of the detectable marker are recorded. In certain embodiments, phenotypic changes in cell morphology are also observed. The tagged genes in the cells may then be identified using in situ sequencing of barcodes. Methods of in situ sequencing are known in the art (see, e.g., Feldman, D. et al. Pooled optical screens in human cells. bioRxiv, doi: 10.1101/383943 (2018)). Other spatial organization methods applicable to the present invention include, but are not limited to, Rodriques et al., Slide-seq: A scalable technology for measuring genome-wide expression at high spatial resolution, Science 29 Mar. 2019: Vol. 363, Issue 6434, pp. 1463-1467; WO 2015/058052 "Spatial and Cellular Mapping of Biomolecules in situ by High-Throughput Sequencing"; and WO 2017/044893 "DNA Microscopy."

In certain embodiments, a cell library may be transferred to an in vivo organism and the recovered cells may be sorted and sequenced to determine protein levels, localization, interaction and modification. Typical mouse models include immunocompromised mouse models (e.g., nude mice). Cell libraries may be generated in tumor cells or immune cells and transferred to a mouse. Protein changes in response to treatment may be determined.

The term "immune cell" as used throughout this specification generally encompasses any cell derived from a hematopoietic stem cell that plays a role in the immune response. The term is intended to encompass immune cells both of the innate or adaptive immune system. The immune cell as referred to herein may be a leukocyte, at any stage of differentiation (e.g., a stem cell, a progenitor cell, a mature cell) or any activation stage. Immune cells include lymphocytes (such as natural killer cells, T-cells (including, e.g., thymocytes, Th or Tc; Th1, Th2, Th17, Th$\alpha\beta$, $CD4^+$, $CD8^+$, effector Th, memory Th, regulatory Th, $CD4^+/CD8^+$ thymocytes, CD4–/CD8– thymocytes, $\gamma\delta$ T cells, etc.) or B-cells (including, e.g., pro-B cells, early pro-B cells, late pro-B cells, pre-B cells, large pre-B cells, small pre-B cells, immature or mature B-cells, producing antibodies of any isotype, T1 B-cells, T2, B-cells, naïve B-cells, GC B-cells, plasmablasts, memory B-cells, plasma cells, follicular B-cells, marginal zone B-cells, B-1 cells, B-2 cells, regulatory B cells, etc.), such as for instance, monocytes (including, e.g., classical, non-classical, or intermediate monocytes), (segmented or banded) neutrophils, eosinophils, basophils, mast cells, histiocytes, microglia, including various subtypes, maturation, differentiation, or activation stages, such as for instance hematopoietic stem cells, myeloid progenitors, lymphoid progenitors, myeloblasts, promyelocytes, myelocytes, metamyelocytes, monoblasts, promonocytes, lymphoblasts, prolymphocytes, small lymphocytes, macrophages (including, e.g., Kupffer cells, stellate macrophages, M1 or M2 macrophages), (myeloid or lymphoid) dendritic cells (including, e.g., Langerhans cells, conventional or myeloid dendritic cells, plasmacytoid dendritic cells, mDC-1, mDC-2, Mo-DC, HP-DC, veiled cells), granulocytes, polymorphonuclear cells, antigen-presenting cells (APC), etc.

Protein Localization

In certain embodiments, the sequence encoding a detectable marker as described herein may further comprise a sequence encoding a protease cleavage site and a cleavable marker, wherein the sequence is in frame with the detectable marker sequence and upon cleavage at the protease cleavage site the cleavable marker is removed from the fusion protein. As used herein, a protease refers to a proteolytic enzyme that hydrolyses peptide bonds. Proteases bind to cleavage sites and hydrolyze peptide bonds to break down proteins. A protease in accordance with the invention may be any protease appropriate for the particular application, such as including, but not limited to TEV protease, thrombin, Rhinovirus protease, a SARS protease, caspases, engineered proteases, or any other protease that may provide similar activity or produce similar results. In certain embodiments, the cleavable marker is an epitope tag, such that the epitope can no longer be detected in tagged cells after removal of the epitope by cleavage at the protease site. An epitope tag may include, but is not limited to, Flag, CBP, GST, HA, HBH, MBP, Myc, polyHis, S-tag, SUMO, TAP, TRX, SpyTag, StrepTag, Ollas, or V5.

In some embodiments, localization of an expressed protein or expression product may be beneficial for methods as described herein. For example, in accordance with the invention, each cell of a library as described herein may be configured for expression of a recombinant protease or a protease reporter localized to a cellular compartment. The protease or reporter may be expressed or inducibly expressed by the cells or the protease or reporter may be introduced when detection of tagged proteins is desired. The protease or reporter may comprise any localization signal known in the art (see, e.g., Negi et al., LocSigDB: a database of protein localization signals. Database (Oxford). 2015; 2015: bav003. Published online 2015 Feb. 27. doi: 10.1093/database/bav003; and genome.unmc.edu/LocSigDB/) (e.g., nuclear export signal, nuclear localization signal, peroxisome localization signal, ER localization signal, golgi localization signal, lysosome localization signal, or mitochondrial localization signal). LocSigDB comprises sorting signal information for 533 distinct experimentally validated signals, along with the proteins that harbor them for eight distinct subcellular locations. In certain embodiments, one of ordinary skill in the art would know that more than one localization signal may be used. For example, two nuclear localization signals may be used to improve localization to the nucleus.

In certain embodiments, the sequence encoding a detectable marker as described herein may further comprise a sequence encoding a protease instead of the cleavable marker. In this case, the donor construct does not include a protease cleavage site and the fusion protein comprises the gene of interest, the detectable marker and the protease. To determine the localization of the fusion protein reporter constructs that will generate a detectable signal after cleavage by the protease are induced or introduced to the cells before determining protein localization. The reporter constructs can include any localization signal peptide as described herein. In certain embodiments, TEV is very active, such that low target expression of a fusion protein and overexpressed reporter may be easier to detect.

In certain embodiments, localization of tagged proteins is determined by isolating nuclei. The nuclei can be sorted by FACS based on expression of the detectable marker and nuclear protein expression can be compared to total protein expression determined by sorting whole cells. In certain embodiments, localization of tagged proteins is determined by fixing cells (e.g., paraformaldehyde (PFA)) in the library and isolating PFA-fixed nuclei. The PFA-fixed nuclei can be sorted by FACS based on expression of the detectable marker and nuclear protein expression can be compared to total protein expression determined by sorting whole cells. Methods of isolating nuclei is known in the art (see, e.g., Swiech et al., 2014, "In vivo interrogation of gene function in the mammalian brain using CRISPR-Cas9" Nature Biotechnology Vol. 33, pp. 102-106; Habib et al., 2016, "Div-Seq: Single-nucleus RNA-Seq reveals dynamics of rare adult newborn neurons" Science, Vol. 353, Issue 6302, pp. 925-928; Habib et al., 2017, "Massively parallel single-nucleus RNA-seq with DroNc-seq" Nat Methods. 2017 October; 14 (10): 955-958; and International patent application number PCT/US2016/059239, published as WO2017164936 on Sep. 28, 2017).

In some embodiments, localization of proteins may be determined by sorting the cells of a library as described herein. Sorting may be based on any appropriate means, such as including, but not limited to size, abundance, presence of a particular marker, such as a fluorescent marker, or other appropriate marker as described herein. In some embodiments, sorting may be based on cleavage of a cleavable marker as described herein. Cleavage may be performed by a protease, such as a TEV protease, as described herein. In some embodiments, a protease to be used for cleavage of a protein as described herein may be localized to a cellular compartment. Localization of a protease may be accomplished with the use or inclusion of a localization signal or tag, for example a nuclear localization signal or tag, or a nuclear export signal or tag. Localization of a protease as described herein may enable quantification of a particular protein or a collection of proteins, or the abundance thereof, from a particular cellular compartment in a cell. In some embodiments, quantification of a particular protein may be desired from a particular tissue type, or a particular cell type, or a particular species, or a particular cell process. The invention is not intended to be limited to a particular application or cell type, and such applications as described herein are all intended to be encompassed within the scope of the present invention.

Constructing Cell Libraries for Analysis of Proteins

In some embodiments, the invention provides methods of constructing a cell library for use in proteomics comprising introducing to a population of cells configured for expression of a CRISPR enzyme a plurality of vectors, wherein each cell receives one or more vectors. In some embodiments, a vector as described herein may comprise a polynucleotide sequence configured for expression of a guide sequence specific for a target sequence in a protein coding gene. In some other embodiments, the protein coding gene is selected from a set of target genes. As described herein, a target gene may be any gene of interest or any gene for which expression analysis is desired. In other embodiments, a target gene may be a gene that is to be downregulated or upregulated. Applicants constructed cell libraries using 23,095 single guide RNAs targeting a set of target genes (Table 2). The single guide RNAs were generated using DNA oligonucleotides (SEQ ID NOs: 46191-69285) as described further herein (methods).

In some embodiments, a polynucleotide sequence as described herein may comprise a CRISPR target site and a sequence encoding a detectable marker, and a polynucleotide sequence configured for expression of a guide sequence specific for the CRISPR target site, wherein the target sequence and target site are cleaved by the CRISPR enzyme such that the sequence encoding a detectable marker is integrated in-frame into the target sequence in the protein coding gene by non-homologous end joining (NHEJ). In some embodiments, a method as described herein may further comprise selecting for cells comprising the polynucleotide sequence encoding a detectable marker integrated in the target sequence in the protein coding gene, whereby the cell library comprises cells singly tagged at every target gene. Selecting as described herein may comprise any selection agent appropriate for the particular application. For example, puromycin selection may be employed in accordance with the invention, or any other selection agent, including, but not limited to, an antibiotic. Such a selection agent may be employed in the form of a selectable marker provided to the cells on a vector or other appropriate vehicle or delivery system. Antibiotic resistance genes may be introduced into a vector along with other elements as described herein, such as FLAG tag sequences, one or more CRISPR-Cas9 system genes, polynucleotides encoding a detectable marker as described herein. In one embodiment, the CRISPR enzyme may be inducible. In another embodiment, the cells were obtained from a transgenic animal configured to express a CRISPR enzyme.

In another aspect, the invention provides a method of constructing a cell library for use in proteomics comprising: introducing to a population of cells configured for expression of a CRISPR enzyme a plurality of vectors, wherein each cell receives one or more vectors comprising: a polynucleotide sequence configured for expression of a guide sequence specific for a target sequence in a protein coding gene selected from a set of target genes, a PCR product comprising a marker gene and a resistance gene; and selecting for cells comprising the polynucleotide sequence encoding a detectable marker integrated in the target sequence in the protein coding gene, whereby the cell library comprises cells singly tagged at every target gene. In some embodiments, the PCR product comprises a phosphorylation modification on 5' end, or comprises one or more PTO modifications (e.g., 5' end, 3' end, or internal). In another embodiment, the CRISPR enzyme is delivered to the population of cells transiently as a protein (e.g., RNP).

In another aspect, the invention provides a method of constructing a cell library for use in proteomics comprising: introducing to a population of cells a plurality of vectors, wherein each cell receives one or more vectors comprising: a polynucleotide sequence configured for expression of a CRISPR enzyme, a polynucleotide sequence configured for expression of a random guide sequence from the library, wherein the guide sequence is specific for a target sequence in a protein coding gene selected from a set of target genes, a PCR product comprising a marker gene and a resistance gene; and selecting for cells comprising the polynucleotide sequence encoding a detectable marker integrated in the target sequence in the protein coding gene, whereby the cell library comprises cells singly tagged at every target gene. In one embodiment, the sequence encoding a detectable marker further comprises a selectable marker gene operably linked to a separate regulatory element and selecting comprises selecting cells comprising the selectable marker. In another embodiment, the selectable marker is an antibiotic resistance gene and selecting comprises treating the cells with an antibiotic. In another embodiment, the sequence encoding a fluorescent marker further comprises a sequence encoding a protease cleavage site and a cleavable marker gene, wherein the sequence is in frame with the fluorescent marker sequence.

In some embodiments, each cell of a library as described herein may be configured for expression of a recombinant protease or reporter localized to a cellular compartment. For example, a protease useful for the invention as described herein may be a TEV protease from the Tobacco Etch Virus. One of skill in the art will recognize that any protease may be used for the methods as described herein, as long as the activity is in accordance with the particular application. In some embodiments, a protease appropriate for use with the invention may be any protease that has sequence specificity and is capable of controlled cleavage of a protein, such as a fusion protein, as described herein. Such a protease may be used in vitro or in vivo, and may be combined with other elements as described herein. A protease may have a localization signal, such as a nuclear localization signal (NLS) or a nuclear export signal (NES). Other localization signals are described herein (e.g., for nuclear, cytoplasmic, mitochondrial, peroxisomal, endoplasmic reticulum (ER), golgi, lysosomal, membrane, or cytoskeleton compartments). In certain embodiments, a protease mutant is used that inhibits auto-cleavage. The TEV mutants 219S and 219P for example inhibit auto-cleavage.

In some embodiments, the expression of localized TEV protease may be induced after generating a library as described herein. For example, the library may be split into sub-pools and transfected with a protease. For example, a TEV-NLS plasmid may be introduced into a library as described herein. In some embodiments, the protease may comprise at least one localization signal as described herein, in order to localize the activity of the desired protease.

In some embodiments, a polynucleotide sequence encoding a detectable marker as described herein may further comprise a T7 RNA polymerase promoter, or any other promoter appropriate for the particular application. Promoters are well known in the art, and one of skill will be able to select an appropriate promoter useful in accordance with the invention. Not being bound by a theory addition of a T7 promoter may be used to identify integration sites by sequencing. Methods of integration site sequencing are described herein.

In some embodiments, a population of cells as described herein may comprise any type of cells desired for the particular application. For example, in some embodiments, eukaryotic cells may be used to generate a cell library as described herein. Eukaryotic cells may be mammalian cells, insect cells, yeast cells, or plant cells, however any desirable cell type may be used as appropriate with the invention. In accordance with the invention, a cell to be used with the methods as described herein will be transformable using any appropriate methods, which will be recognized by one of skill in the art.

In some embodiments, a CRISPR enzyme as described herein may be inducible. In other words, a cell may be transformed with a functional or active CRISPR system, or the components or elements thereof, or cell may be provided or transformed or transduced with one or more polynucleotides encoding one or more elements of a CRISPR system as described herein. In certain embodiments, the CRISPR system is operably linked or under control of an inducible expression system (e.g., Tet on or Tet off systems).

In some embodiments, a method of producing a cell library as described herein may comprise a step of maintaining the library of cells. For example, as known in the art, appropriate media and/or nutrient additives, components such as antibiotics, vitamins, or the like, may be needed in order to maintain a cell library, and such steps may be used as appropriate in order to maintain a library in accordance with the invention. In some embodiments, media changes may be required to maintain cells, or cells may be frozen in appropriate buffers or solutions to maintain cell integrity. In some embodiments, storage or culture conditions may be altered or optimized as needed for the particular cell type or application. In some embodiments, a cell library as described herein may be copied as necessary for the particular application using methods known in the art. In certain embodiments, aliquots of a library may be frozen as is known in the art (e.g., frozen in liquid nitrogen). Not being bound by a theory, aliquots of the tagged library may be thawed and used in future experiments.

In certain embodiments, a method of tagging genes in cells uses a generic donor template that can be integrated at any target locus in the genome of a cell using homology independent based repair mechanisms. In certain embodiments, gene tagging uses a CRISPR system. In certain embodiments, gene tagging uses a system that alleviates the need for homology templates. Previous reports using zinc-finger nucleases, TALE effector nucleases or CRISPR-Cas9 technology have shown that plasmids containing an endonuclease cleavage site can be integrated in a homology-independent manner and any of these methods may be used for constructing the library of the present invention (see, e.g., Lackner, D. H. et al. A generic strategy for CRISPR-Cas9-mediated gene tagging. Nat. Commun. 6:10237 doi: 10.1038/ncomms10237 (2015); Auer, et al., Highly efficient CRISPR/Cas9-mediated knock-in in zebrafish by homology-independent DNA repair. Genome Res. 24, 142-153 (2014); Maresca, et al., Obligate ligation-gated recombination (ObLiGaRe): custom-designed nuclease-mediated targeted integration through nonhomologous end joining. Genome Res. 23, 539-546 (2013); and Cristea, S. et al., In vivo cleavage of transgene donors promotes nuclease-mediated targeted integration. Biotechnol. Bioeng. 110, 871-880 (2013)).

Furthermore, tagging of cells can use any method of tagging, including, but not limited to any homology based tagging or using any DNA targeting nuclease system, such as a CRISPR system, TALE system, Zn-finger nuclease system or meganucleases. DNA targeting proteins are described further herein. In certain embodiments, a library of cells is randomly tagged and clones expressing a protein of interest fusion protein can be selected for.

Cell Lines

In certain embodiments, the population of cells is derived from cells taken from a subject, such as a cell line. A wide variety of cell lines for tissue culture models are known in the art. Examples of cell lines include, but are not limited to, HT115, RPE1, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, CIR, Rat6, CVI, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-1 cells, BEAS-2B, bEnd.3, BHK-21, BR 293, BxPC3, C3H-10T1/2, C6/36, Cal-27, CHO, CHO-7, CHO-IR, CHO-K1, CHO-K2, CHO-T, CHO Dhfr–/–, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/ARI, EMT6/AR10.0, FM3, H1299, H69, HB54, HB55, HCA2, HEK-293, HeLa, Hepalc1c7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK II, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)).

Determining the Expression of Proteins

In another aspect, the invention provides a method of determining the distribution of protein levels or the expression of proteins in a population of cells. In some embodiments, such a method may comprise sorting a library of cells as described herein into at least two groups based on expression of a detectable marker in each cell as described herein. In some embodiments, nucleic acid sequencing may be performed for and/or of cells in each group, wherein the tagged target genes or tagged genes of interest in each group may be determined or evaluated. In some embodiments, evaluation as described herein may refer to analysis of protein expression or abundance. In some embodiments, sequencing as described herein may comprise transcription of a tagged gene using a polymerase appropriate for the particular application. For example, in some embodiments, a T7 polymerase may be used, or any other polymerase appropriate. Polymerases are well known and available in the art. In some embodiments, DNA replication or amplification with a T7 or other polymerase may be followed by production of cDNA using, for example, reverse transcription or other appropriate methods. Sequencing of the cDNA may then be performed. Any appropriate amplification and/or sequencing methods known in the art may be used in accordance with the invention.

In some embodiments, sequencing as described herein may comprise tagmentation using a transposase, such as a Tn5 transposase. Use of transposases is well known in the art and one of skill would be able to perform such methods. In some embodiments, linear amplification may be performed for applications in which deep sequencing is to be performed. Such methods may be appropriate or beneficial for template sequences that are present in low numbers. In some embodiments, PCR amplification and sequencing of the amplified DNA may be performed. Such methods are well known in the art.

Determining Protein Interactions

In some embodiments, the invention provides methods of determining protein interactions in a population of cells. Such a method may comprise sorting a library of cells as described herein into at least two groups. Sorting may be based on any desired criteria, including, but not limited to, a signal of a detectable marker in each cell as described herein (the detectable signal is dependent upon two proteins being in proximity such that the complementation proteins interact). In certain embodiments, the general method comprises 1) make a tagging library with a complementation protein fused to target genes, 2) introduce or express a bait protein of interest fused with a complementation protein (e.g., TEV or another interaction-dependent tag) and 3) sort the cells in which an interaction took place. Such detectable markers (complementation pairs) may be introduced into the cell using any means as described herein, and may be introduced on a vector or other appropriate vehicle or delivery system. In some embodiments, the delivery system may be a CRISPR system, as described herein. Nucleic acid sequencing may be performed on cells in each of the groups. In some embodiments, the tagged target genes in each group are determined. In one embodiment, the sequencing comprises transcription of the tagged gene by T7 polymerase, cDNA production, and sequencing of the cDNA. In another embodiment, the sequencing comprises tagmentation with Tn5, optional LAM, PCR amplification, and sequencing of the amplified DNA. In some embodiments, the library of cells may be treated with a perturbation prior to determining protein interactions as described herein. In some embodiments, the perturbation may comprise a small molecule, protein, RNAi, CRISPR system, pathogen, allergen, recombinant virus, temperature, salt, lipid, or biomolecule.

Determining Protein Modifications

In another aspect, the invention provides a method of determining protein modifications in a population of cells. In some embodiments, the method comprises sorting a library of cells as described herein into at least two groups based on the signal of the detectable marker in each cell as described herein (the detectable signal is dependent upon the modification binding protein binding to a target protein such that the complementation proteins interact). In certain embodiments, the general method comprises 1) make a tagging library with a complementation protein fused to target genes, 2) introduce or express a modification binding protein fused with a complementation protein (e.g., TEV or another interaction-dependent tag) and 3) sort the cells in which the modification is detected on a target protein. Sequencing may be performed for or on each group, wherein the tagged target genes in each group are determined. In some embodiments, the sequencing may comprise transcription of the tagged gene by T7 polymerase, cDNA production, and sequencing of the cDNA as described herein. In other embodiments, sequencing may comprise tagmentation with Tn5, PCR amplification, and sequencing of the amplified DNA as described herein. In other embodiments, the library of cells may be treated with a perturbation prior to determining protein modifications. In another embodiment, the perturbation comprises a small molecule, protein, RNAi, CRISPR system, pathogen, allergen, or biomolecule.

Complementation Systems

In certain embodiments, protein interactions and protein modifications are detected using a population of cells described herein. In certain embodiments, protein interactions and protein modifications are detected by using tagged proteins or fusion proteins that together form a protein complementation assay (PCA) (see, e.g., Rebois, R. V., et al., *Methods,* 2008. 45(3): p. 214-8). PCA is a method for the identification of protein-protein interactions in biological systems. In the PCA, the proteins of interest ("Bait" and "Prey") are each covalently linked to incomplete fragments of a third protein (e.g. a fluorescent protein), which acts as a "reporter". Interaction between the "bait" and the "prey" proteins brings the fragments of the "reporter" protein in close enough proximity to allow them to form a functional reporter protein whose activity can be measured. This principle can be applied to many different "reporter" proteins. Any protein that can be split into two parts and reconstituted non-covalently may be used in a PCA. The two parts are brought together by two interacting proteins fused to them ("bait" and "prey"). Usually enzymes which confer resistance to antibiotics, such as Dihydrofolate reductase or Beta-lactamase, or proteins that give colorimetric or fluorescent signals are used as reporters. When fluorescent proteins are reconstituted, the PCA is called Bimolecular fluorescence complementation assay. The most popular PCAs utilize split versions of the following proteins: Dihydrofolate reductase (DHFR), Beta-lactamase, Yeast Gal4 (as in the classical yeast two-hybrid system), Luciferase, Split TEV (Tobacco etch virus protease), Ubiquitin, GFP (split-GFP), LacZ (beta-galactosidase). In an embodiment, the reporter protein is TEV and the biosensor comprises a split version of TEV, i.e. two fragments/portions of TEV that can generate a functional TEV when the two fragments/portions are brought in close enough proximity. The active TEV can then generate a detectable signal by measurement of cleavage of nearby target sites. Functional reconstitution of TEV protease fragments can be monitored with 'proteolysis-only' reporters, which can be previously silent fluorescent and luminescent reporter proteins. Additionally, proteolytically cleavable inactive transcription factors can be combined with any downstream reporter gene of choice to yield 'transcription-coupled' reporter systems (see, e.g., Wehr et al., Nat Methods. 2006 December; 3 (12): 985-93).

Proximity ligation assays allow protein interactions to be detected using a nucleic acid readout (e.g., sequencing or PCR). Proximity ligation assays using epitope tags has been described (see, e.g., Gajadhar and Guha, A proximity ligation assay using transiently transfected, epitope-tagged proteins: application for in situ detection of dimerized receptor tyrosine kinases. Biotechniques. 2010 February; 48 (2): 145-52). In certain example embodiments, the constructs disclosed herein may further encode an epitope tag for use in detecting interactions or modifications by proximity ligation assays. Not being bound by a theory, epitope tags provides high sensitivity and specificity in detection by specific antigen binding molecules (e.g., antibodies, aptamers). In other words, epitope tags provide epitopes that can be bound strongly and specifically without non-specific binding. An epitope tag may include, but is not limited to, Flag, CBP, GST, HA, HBH, MBP, Myc, polyHis, S-tag, SUMO, TAP, TRX, SpyTag, StrepTag, Ollas, or V5. In certain embodiments, the proximity ligation assays used in the present invention utilize oligonucleotide linked antibodies specific for a first and second epitope as described herein. In certain embodiments, the antibodies bind to their epitope and if both antibodies are in proximity the oligonucleotides linked to each antibody can be ligated. In one embodiment, detection of the ligated product by sequencing or PCR indicates an interaction. In one embodiment, detection of the ligated product by use of a fluorescent probe or molecular beacon indicates an interaction. Detection of DNA using molecular probes or molecular beacons and sorting cells has been described (see, e.g., U.S. Pat. No. 6,692,965 and international publication number WO2005079462). In a preferred embodiment, molecular beacons are used to select for cells wherein a ligation product is generated. In certain embodiments, cells are fixed and permeabilized. The cells are then incubated with epitope specific oligonucleotide linked antibodies under conditions where ligation can occur. In certain embodiments, ligase is added to the cells. The fixed cells may then be incubated with a probe or molecular beacon. Cells may be sorted into groups based on the intensity of the signal and the tagged targets can be identified by sequencing.

In certain embodiments, the complementation system comprises a permuted inactive reporter (see, e.g., WO2007120522A3; and Eishingdrelo et al., A Cell-Based Protein-Protein Interaction Method Using a Permuted Luciferase Reporter. Current Chemical Genomics, 2011, 5, 122-128). In one embodiment, the assay design consists of two components: an inactive permuted reporter (e.g., luciferase) containing a Tobacco Etch Virus (TEV) protease cleavage sequence fused to one protein and the protease TEV fused to the second protein. Upon interaction between the proteins, the inactive permuted reporter (e.g., luciferase) is cleaved and the active reporter is reconstituted.

In certain embodiments, protein modification is detected by a complementation assay as described herein, wherein one of the complementation proteins comprises a protein modification binding protein or fragment thereof (e.g., a domain). Protein modification proteins may include any protein domain capable of binding to and/or distinguishing modified proteins. Modifications may include, but are not limited to phosphorylation, acetylation, methylation or ubiquitination. In an exemplary embodiment, domains capable of binding to phosphorylated tyrosine include SH2 domains. The SH2 (Src Homology 2) domain is a structurally conserved protein domain contained within the Src oncoprotein and in many other intracellular signal-transducing proteins. SH2 domains allow proteins containing those domains to dock to phosphorylated tyrosine residues on other proteins. SH2 domains are commonly found in adaptor proteins that aid in the signal transduction of receptor tyrosine kinase pathways. Phosphorylation of tyrosine residues in a protein occurs during signal transduction and is carried out by tyrosine kinases. In this way, phosphorylation of a substrate by tyrosine kinases acts as a switch to trigger binding to an SH2 domain-containing protein. Many tyrosine containing short linear motifs that bind to SH2 domains are conserved across a wide variety of higher Eukaryotes. In another exemplary embodiment, domains capable of binding methylated lysine include chromodomains. A chromodomain (chromatin organization modifier) is a protein structural domain of about 40-50 amino acid residues commonly found in proteins associated with the remodeling and manipulation of chromatin. Chromodomain-containing proteins bind methylated histones. In another exemplary embodiment, domains capable of binding acetylated lysine include bromodomains. A bromodomain is an approximately 110 amino acid protein domain that recognizes acetylated lysine residues, such as those on the N-terminal tails of histones. Bromodomains, as the "readers" of lysine acetylation, are responsible in transducing the signal carried by acetylated lysine residues and translating it into various normal or abnormal phenotypes. Their affinity is higher for regions where multiple acetylation sites exist in proximity. This recognition is often a prerequisite for protein-histone association and chromatin remodeling. The domain itself adopts an all-α protein fold, a bundle of four alpha helices each separated by loop regions of variable lengths that form a hydrophobic pocket that recognizes the acetyl lysine.

Sequencing of Integration Sites

In some embodiments, the invention provides a method for sequencing integration sites of a donor sequence inserted into the genome of a cell. In some embodiments, such a method may comprise lysing cells with proteinase K, detergent (e.g., Triton-X100) or another agent as appropriate. In some embodiments, the proteinase K may not be heat inactivated. In some embodiments, tagmentation may be performed on genomic DNA with a transposase such as Tn5 as described herein. In some embodiments, the transposase may be loaded with adaptors, and the adaptors may comprise a priming site. Linear amplification may be performed as described herein with a first primer specific for the donor sequence. PCR may be performed as described herein with a second primer specific for the donor sequence downstream of the first primer and a reverse primer specific for the adaptor priming site. Such a method may also comprise a step of constructing and sequencing a sequencing library as described herein. In some embodiments, kits are provided, comprising materials for tagging a population of cells according to the methods described herein.

Systems for Analysis of Proteins

In some embodiments, the invention provides a system for analysis of proteins. Such a system may comprise a universal donor construct. In some embodiments, a system as described herein may also comprise a cell population stably expressing a CRISPR system. In some embodiments, a system may comprise a construct for delivery of a CRISPR system to a cell as described herein. In further embodiments, a system may also comprise sequencing reagents.

The CRISPR system may be delivered to the cell on one or more vectors. The CRISPR system may be delivered to the cell as a ribonucleoprotein complex (RNP). The RNP complex may comprise recombinant CRISPR enzyme, guide sequences, and the donor construct. The RNP complexes may be delivered to a population of cells by transfection.

The donor construct may comprise a nucleotide sequence encoding a detectable marker and a selectable marker. The donor construct may further comprise a nucleotide sequence encoding a T7 promoter. The donor construct may further comprise a nucleotide sequence encoding an epitope tag. The donor construct may further comprise a nucleotide sequence encoding a protease cleavage site and an epitope tag. The system may further comprise a protease specific for the protease cleavage site localized to a cellular compartment. The system may comprise a donor construct for tagging a target gene in a cell comprising a nucleotide sequence encoding: a detectable marker, a resistance gene, a protease cleavage site and an epitope tag.

In accordance with the invention, a system may comprise one or more constructs for determining integration sites as described herein, indicating the location in the genome into which a nucleic acid encoding a detectable label was inserted. The constructs may comprise a T7 promoter.

Proteomics Analysis and Perturbation

In some embodiments, a cell library as described herein may be treated with a perturbation or agent prior to determining protein levels, protein interactions, or protein modifications. As used herein, a perturbation may refer to treatment with a small molecule, protein, RNAi, CRISPR system, TALE system, Zn finger system, meganuclease, pathogen, allergen, biomolecule, or environmental stress. Such methods may be performed in any manner appropriate for the particular application. The term "agent" broadly encompasses any condition, substance or agent capable of modulating one or more phenotypic aspects of a cell or cell population as disclosed herein. Such conditions, substances or agents may be of physical, chemical, biochemical and/or biological nature. The term "candidate agent" refers to any condition, substance or agent that is being examined for the ability to modulate one or more phenotypic aspects of a cell or cell population as disclosed herein in a method comprising applying the candidate agent to the cell or cell population (e.g., exposing the cell or cell population to the candidate agent or contacting the cell or cell population with the candidate agent) and observing whether the desired modulation takes place.

Agents may include any potential class of biologically active conditions, substances or agents, such as for instance antibodies, proteins, peptides, nucleic acids, oligonucleotides, small molecules, or combinations thereof, as described herein (see, e.g., Table 3).

The methods of proteomic analysis can be utilized for evaluating environmental stress and/or state, for screening of chemical libraries, and to screen or identify structural, syntenic, genomic, and/or organism and species variations. For example, a library of cells, can be exposed to an environmental stress, such as but not limited to heat shock, osmolarity, hypoxia, cold, oxidative stress, radiation, starvation, a chemical (for example a therapeutic agent or potential therapeutic agent) and the like. After the stress is applied, the library can be subjected to analysis, for example at various time points, and compared to a control, such as a mean protein level. By exposing a tagged cell library to different members of the chemical libraries, and performing the methods described herein, different members of a chemical library can be screened for their effect on proteins simultaneously in a relatively short amount of time, for example using a high throughput method.

In some embodiments, screening of test agents involves testing a combinatorial library containing a large number of potential modulator compounds. A combinatorial chemical library may be a collection of diverse chemical compounds generated by either chemical synthesis or biological synthesis, by combining a number of chemical "building blocks" such as reagents. For example, a linear combinatorial chemical library, such as a polypeptide library, is formed by combining a set of chemical building blocks (amino acids) in every possible way for a given compound length (for example the number of amino acids in a polypeptide compound). Millions of chemical compounds can be synthesized through such combinatorial mixing of chemical building blocks.

In certain embodiments, the present invention can be used to determine drug targets that are not regulated at the transcript level. For example, drugs that affect protein levels, modifications and interactions post transcription. In certain embodiments, a drug may not affect RNA levels, but affect protein levels, protein localization, protein interactions, or protein modifications.

The current invention comprehends the use of CRISPR technology for perturbation of cells to determine the effect of a perturbation on protein expression. In one embodiment, a library of tagged cells as described herein is perturbed at a single locus and the changes in protein expression is determined for the perturbed or other targets. In one embodiment, a library of tagged cells as described herein is perturbed at multiple loci in each cell of the population of cells and the changes in protein expression is determined for a combination of perturbed and other targets. Genes or loci targeted for perturbation may be selected by one skilled in the art based on knowledge of cellular pathways and cellular networks. The target may be a novel target. The novel target may be within a gene signature associated with a specific phenotype. One skilled in the art can apply the present invention to any target or combination of targets of interest. The current method provides for a standard predictable method of determining changes in protein expression for any perturbed target or combination of targets.

In certain embodiments, a CRISPR system is used to create an INDEL at a target gene. In other embodiments, epigenetic perturbation is performed by applying CRISPRa/i/x technology (see, e.g., Konermann et al. "Genome-scale transcriptional activation by an engineered CRISPR-Cas9 complex" Nature. 2014 Dec. 10. doi: 10.1038/nature14136; Qi, L. S., et al. (2013). "Repurposing CRISPR as an RNA-guided platform for sequence-specific control of gene expression". Cell. 152 (5): 1173-83; Gilbert, L. A., et al., (2013). "CRISPR-mediated modular RNA-guided regulation of transcription in eukaryotes". Cell. 154 (2): 442-51; Komor et al., 2016, Programmable editing of a target base in genomic DNA without double-stranded DNA cleavage, Nature 533, 420-424; Nishida et al., 2016, Targeted nucleotide editing using hybrid prokaryotic and vertebrate adaptive immune systems, Science 353 (6305); Yang et al., 2016, Engineering and optimizing deaminase fusions for genome editing, Nat Commun. 7:13330; Hess et al., 2016, Directed evolution using dCas9-targeted somatic hypermutation in mammalian cells, Nature Methods 13, 1036-1042; and Ma et al., 2016, Targeted AID-mediated mutagenesis (TAM) enables efficient genomic diversification in mammalian cells, Nature Methods 13, 1029-1035). Numerous genetic variants associated with disease phenotypes are found to be in non-coding region of the genome, and frequently coincide with transcription factor (TF) binding sites and non-coding RNA genes. Not being bound by a theory, CRISPRa/i/x approaches may be used to achieve a more thorough and precise understanding of the implication of epigenetic regulation. In one embodiment, a CRISPR system may be used to activate gene transcription. A nuclease-dead RNA-guided DNA binding domain, dCas9, tethered to transcriptional repressor domains that promote epigenetic silencing (e.g., KRAB) may be used for "CRISPRi" that represses transcription. To use dCas9 as an activator (CRISPRa), a guide sequence is engineered to carry RNA binding motifs (e.g., MS2) that recruit effector domains fused to RNA-motif binding proteins, increasing transcription. A key dendritic cell molecule, p65, may be used as a signal amplifier, but is not required.

In certain embodiments, other CRISPR-based perturbations are readily compatible with the present invention, including alternative editors such as CRISPR/Cpf1. In certain embodiments, Cpf1 is the CRISPR enzyme for introducing perturbations. Not being bound by a theory, Cpf1 does not require TracrRNA and is a smaller enzyme, thus allowing higher combinatorial perturbations to be tested.

In some embodiments, the invention provides a library of non-naturally occurring or engineered compositions contained within a plurality of cells, each cell comprising a polynucleotide sequence encoding a detectable marker integrated into the genome of the cell in-frame with a protein coding gene selected from a set of target genes, wherein the library comprises more than one cell tagged at each target gene, whereby each gene in the set of genes is tagged with a detectable marker in single cells of the library.

In some embodiments, the cells of a library as described herein may comprise a RNA targeting or DNA targeting CRISPR guide sequence comprising a guide sequence capable of hybridizing to a target RNA sequence of interest in a cell, an RNA targeting enzyme, wherein the RNA targeting enzyme comprises at least one mutation, such that the RNA targeting enzyme has no more than 5% of the nuclease activity of the RNA targeting enzyme not having the at least one mutation, wherein the gRNA is modified by the insertion of distinct RNA sequence(s) that bind to one or more adaptor proteins, and wherein the adaptor protein is associated with one or more functional domains, wherein the composition comprises one or more or two or more adaptor proteins, wherein the each protein is associated with one or more functional domains, and wherein the gRNAs comprise a genome wide library comprising a plurality of RNA targeting guide sequences.

In some embodiments, the invention provides a library as described herein, wherein the RNA targeting enzyme has a diminished nuclease activity of at least 97%, or 100% as compared with the RNA targeting enzyme not having the at least one mutation. In other embodiments, the invention provides a library as herein-discussed, wherein the adaptor protein is a fusion protein comprising the functional domain. Other embodiments provide a library as herein discussed, wherein the gRNA is not modified by the insertion of distinct RNA sequence(s) that bind to the one or two or more adaptor proteins. Some embodiments provide a library as herein discussed, wherein the one or two or more functional domains are associated with the RNA targeting enzyme. In other embodiments, the invention provides a library as herein discussed, wherein the cell population of cells is a population of eukaryotic cells. A eukaryotic cell in accordance with the invention may be a mammalian cell, a plant cell, or a yeast cell. The mammalian cell may be a human cell. Some embodiments of the invention may also provide a cell library comprising a population of embryonic stem (ES) cells.

In one aspect, the invention provides a method of generating a model eukaryotic cell comprising a gene with modified expression. Such a cell may be used for a cell library as described herein. A gene with modified expression may be a disease-causing gene, or a gene that contributes to a disease. As used herein, a disease gene is any gene associated an increase in the risk of having or developing a disease. In some embodiments, such a method may comprise (a) introducing one or more vectors encoding the components of the system described herein above into a eukaryotic cell, and (b) allowing a CRISPR complex to bind to a target polynucleotide so as to modify expression of a gene, thereby generating a model eukaryotic cell comprising modified gene expression.

The structural information provided herein allows for interrogation of guide sequence interaction with the target RNA and the RNA targeting enzyme permitting engineering or alteration of guide sequence structure to optimize functionality of the entire RNA targeting CRISPR-Cas system. For example, a guide sequence may be extended, without colliding with the RNA targeting protein by the insertion of adaptor proteins that can bind to RNA or DNA. These adaptor proteins can further recruit effector proteins or fusions that comprise one or more functional domains.

In some embodiments, the above elements may be comprised in a single composition or may be comprised in individual compositions. These compositions may advantageously be applied to a host cell or organism to elicit a functional effect at the genomic level.

One of skill in the art will understand that modifications to the guide sequence that allow for binding of the adapter+functional domain but not proper positioning of the adapter +functional domain (e.g., due to steric hindrance within the three-dimensional structure of the CRISPR complex) are modifications which are not intended. The one or more modified guide sequences may be modified by introduction of one or more distinct RNA sequences located 5' of the direct repeat, within the direct repeat, or located 3' of the guide sequence.

The modified guide sequence, the inactivated RNA targeting enzyme (with or without functional domains), and the binding protein with one or more functional domains, may each individually be comprised in a composition and administered to a host cell or organism individually or collectively. Alternatively, these components may be provided in a single composition for administration. Administration to a host cell or organism may be performed via viral vectors known in the art or described herein for delivery to a host (e.g., lentiviral vector, adenoviral vector, AAV vector, or the like). As explained herein, use of different selection markers (e.g., for lentiviral gRNA selection) and concentration of gRNA (e.g., dependent on whether multiple gRNAs are used) may be advantageous for eliciting an improved effect.

Using the provided compositions, one of skill in the art can advantageously and specifically target single or multiple loci with the same or different functional domains to elicit one or more genomic events. The compositions may be applied in a wide variety of methods for screening in libraries in cells and functional modeling in vivo (e.g., gene activation of lincRNA and identification of function; gain-of-function modeling; loss-of-function modeling; and/or the use the compositions of the invention to establish cell lines and transgenic animals for optimization and screening purposes).

The current invention comprehends the use of the compositions of the current invention to establish and utilize conditional or inducible CRISPR RNA targeting events. (see, e.g., Platt et al., ('ell (2014), dx.doi.org/10.1016/j.cell.2014.09.014, or PCT patent publications cited herein, such as WO 2014/093622 (PCT/US2013/074667). For example, a target cell as described herein may comprise an RNA targeting CRISPR enzyme conditionally or inducibly (e.g., in the form of Cre-dependent constructs) and/or the adapter protein conditionally or inducibly and, on expression of a vector introduced into the target cell, the vector expresses that which induces or gives rise to the condition of a RNA targeting enzyme expression and/or adaptor expression in the target cell. By applying the teachings and compositions of the current invention with the known method of creating a CRISPR complex, inducible gene expression affected by functional domains are also an aspect of the current invention. Alternatively, the adaptor protein may be provided as a conditional or inducible element with a conditional or inducible RNA targeting enzyme to provide an effective model for screening purposes, which advantageously only requires minimal design and administration of specific gRNAs for a broad number of applications.

Nuclease Systems

As described herein, the present invention provides cell libraries for use in detecting protein expression, protein localization, or for use in detecting protein interactions between a protein of interest and a set of target proteins, or for use in detecting protein modifications, along with methods and kits for constructing such libraries, and methods for determining the expression of proteins, protein localizations, protein interactions, or protein modifications in a population of cells, and methods for sequencing integration sites of a donor sequence inserted into the genome of a cell, wherein the cells of such libraries are configured to express a nuclease system, preferably a CRISPR system, more preferably Cas9 or Cas12. The integration system as described herein is based on non-homologous end joining repair at a target locus cut using a DNA targeting nuclease. Perturbation of cells in a library may also utilize a nuclease system described herein. In certain embodiments, the nuclease system may comprise a CRISPR system, a zinc finger nuclease system, a TALEN, or a meganuclease.

In general, a CRISPR-Cas or CRISPR system as used in herein and in documents, such as WO 2014/093622 (PCT/US2013/074667), refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). See, e.g, Shmakov et al. (2015) "Discovery and Functional Characterization of Diverse Class 2 CRISPR-Cas Systems", Molecular Cell, DOI: dx.doi.org/10.1016/j.molcel.2015.10.008.

In certain embodiments, a protospacer adjacent motif (PAM) or PAM-like motif directs binding of the effector protein complex as disclosed herein to the target locus of interest. In some embodiments, the PAM may be a 5' PAM (i.e., located upstream of 5' end of the protospacer). In other embodiments, the PAM may be a 3' PAM (i.e., located downstream of the 5' end of the protospacer). The term "PAM" may be used interchangeably with the term "PFS" or "protospacer flanking site" or "protospacer flanking sequence".

In a preferred embodiment, the CRISPR effector protein may recognize a 3' PAM. In certain embodiments, the CRISPR effector protein may recognize a 3' PAM which is 5'H, wherein His A, C or U.

In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. The term "target RNA" refers to a RNA polynucleotide being or comprising the target sequence. In other words, the target RNA may be a RNA polynucleotide or a part of a RNA polynucleotide to which a part of the gRNA, i.e. the guide sequence, is designed to have complementarity and to which the effector function mediated by the complex comprising CRISPR effector protein and a gRNA is to be directed. In some embodiments, a target sequence is located in the nucleus or cytoplasm of a cell.

In certain example embodiments, the CRISPR effector protein may be delivered using a nucleic acid molecule encoding the CRISPR effector protein. The nucleic acid molecule encoding a CRISPR effector protein, may advantageously be a codon optimized CRISPR effector protein. An example of a codon optimized sequence, is in this instance a sequence optimized for expression in eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667). Whilst this is preferred, it will be appreciated that other examples are possible and codon optimization for a host species other than human, or for codon optimization for specific organs is known. In some embodiments, an enzyme coding sequence encoding a CRISPR effector protein is a codon optimized for expression in particular cells, such as eukaryotic cells. The eukaryotic cells may be those of or derived from a particular organism, such as a plant or a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at kazusa.or.jp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g. 1, 2, 3, 4, 5, 10, 15, 20, 25, 50, or more, or all codons) in a sequence encoding a Cas correspond to the most frequently used codon for a particular amino acid.

In certain embodiments, the methods as described herein may comprise providing a Cas transgenic cell in which one or more nucleic acids encoding one or more guide RNAs are provided or introduced operably connected in the cell with a regulatory element comprising a promoter of one or more gene of interest. As used herein, the term "Cas transgenic cell" refers to a cell, such as a eukaryotic cell, in which a Cas gene has been genomically integrated. The nature, type, or origin of the cell are not particularly limiting according to the present invention. Also the way the Cas transgene is introduced in the cell may vary and can be any method as is known in the art. In certain embodiments, the Cas transgenic cell is obtained by introducing the Cas transgene in an isolated cell. In certain other embodiments, the Cas transgenic cell is obtained by isolating cells from a Cas transgenic organism. By means of example, and without limitation, the Cas transgenic cell as referred to herein may be derived from a Cas transgenic eukaryote, such as a Cas knock-in eukaryote. Reference is made to WO 2014/093622 (PCT/US13/74667), incorporated herein by reference. Methods of US Patent Publication Nos. 20120017290 and 20110265198 assigned to Sangamo BioSciences, Inc. directed to targeting the Rosa locus may be modified to utilize the CRISPR Cas system of the present invention. Methods of US Patent Publication No. 20130236946 assigned to Cellectis directed to targeting the Rosa locus may also be modified to utilize the CRISPR Cas system of the present invention. By means of further example reference is made to Platt et. al. (Cell; 159 (2): 440-455 (2014)), describing a Cas9 knock-in mouse, which is incorporated herein by reference. The Cas transgene can further comprise a Lox-Stop-polyA-Lox (LSL) cassette thereby rendering Cas expression inducible by Cre recombinase. Alternatively, the Cas transgenic cell may be obtained by introducing the Cas transgene in an isolated cell. Delivery systems for transgenes are well known in the art. By means of example, the Cas transgene may be delivered in for instance eukaryotic cell by means of vector (e.g., AAV, adenovirus, lentivirus) and/or particle and/or nanoparticle delivery, as also described herein elsewhere.

It will be understood by the skilled person that the cell, such as the Cas transgenic cell, as referred to herein may comprise further genomic alterations besides having an integrated Cas gene or the mutations arising from the sequence specific action of Cas when complexed with RNA capable of guiding Cas to a target locus.

In certain aspects the invention involves vectors, e.g. for delivering or introducing in a cell Cas and/or RNA capable of guiding Cas to a target locus (i.e. guide RNA), but also for propagating these components (e.g. in prokaryotic cells). A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety. Thus, the embodiments disclosed herein may also comprise transgenic cells comprising the CRISPR effector system. In certain example embodiments, the transgenic cell may function as an individual discrete volume. In other words samples comprising a masking construct may be delivered to a cell, for example in a suitable delivery vesicle and if the target is present in the delivery vesicle the CRISPR effector is activated and a detectable signal generated.

The vector(s) can include the regulatory element(s), e.g., promoter(s). The vector(s) can comprise Cas encoding sequences, and/or a single, but possibly also can comprise at least 3 or 8 or 16 or 32 or 48 or 50 guide RNA(s) (e.g., sgRNAs) encoding sequences, such as 1-2, 1-3, 1-4 1-5, 3-6, 3-7, 3-8, 3-9, 3-10, 3-8, 3-16, 3-30, 3-32, 3-48, 3-50 RNA(s) (e.g., sgRNAs). In a single vector there can be a promoter for each RNA (e.g., sgRNA), advantageously when there are up to about 16 RNA(s); and, when a single vector provides for more than 16 RNA(s), one or more promoter(s) can drive expression of more than one of the RNA(s), e.g., when there are 32 RNA(s), each promoter can drive expression of two RNA(s), and when there are 48 RNA(s), each promoter can drive expression of three RNA(s). By simple arithmetic and well established cloning protocols and the teachings in this disclosure one skilled in the art can readily practice the invention as to the RNA(s) for a suitable exemplary vector such as AAV, and a suitable promoter such as the U6 promoter. For example, the packaging limit of AAV is ~4.7 kb. The length of a single U6-gRNA (plus restriction sites for cloning) is 361 bp. Therefore, the skilled person can readily fit about 12-16, e.g., 13 U6-gRNA cassettes in a single vector. This can be assembled by any suitable means, such as a golden gate strategy used for TALE assembly (genome-engineering.org/taleffectors/). The skilled person can also use a tandem guide strategy to increase the number of U6-gRNAs by approximately 1.5 times, e.g., to increase from 12-16, e.g., 13 to approximately 18-24, e.g., about 19 U6-gRNAs. Therefore, one skilled in the art can readily reach approximately 18-24, e.g., about 19 promoter-RNAs, e.g., U6-gRNAs in a single vector, e.g., an AAV vector. A further means for increasing the number of promoters and RNAs in a vector is to use a single promoter (e.g., U6) to express an array of RNAs separated by cleavable sequences. And an even further means for increasing the number of promoter-RNAs in a vector, is to express an array of promoter-RNAs separated by cleavable sequences in the intron of a coding sequence or gene; and, in this instance it is advantageous to use a polymerase II promoter, which can have increased expression and enable the transcription of long RNA in a tissue specific manner. (see, e.g., nar.oxfordjournals.org/content/34/7/e53.short and nature.com/mt/journal/v16/n9/abs/mt2008144a.html). In an advantageous embodiment, AAV may package U6 tandem gRNA targeting up to about 50 genes. Accordingly, from the knowledge in the art and the teachings in this disclosure the skilled person can readily make and use vector(s), e.g., a single vector, expressing multiple RNAs or guides under the control or operatively or functionally linked to one or more promoters-especially as to the numbers of RNAs or guides discussed herein, without any undue experimentation.

The guide RNA(s) encoding sequences and/or Cas encoding sequences, can be functionally or operatively linked to regulatory element(s) and hence the regulatory element(s) drive expression. The promoter(s) can be constitutive promoter(s) and/or conditional promoter(s) and/or inducible promoter(s) and/or tissue specific promoter(s). The promoter can be selected from the group consisting of RNA polymerases, pol I, pol II, pol III, T7, U6, H1, retroviral Rous sarcoma virus (RSV) LTR promoter, the cytomegalovirus (CMV) promoter, the SV40 promoter, the dihydrofolate reductase promoter, the β-actin promoter, the phosphoglycerol kinase (PGK) promoter, and the EF1α promoter. An advantageous promoter is the promoter is U6.

Additional effectors for use according to the invention can be identified by their proximity to cas1 genes, for example, though not limited to, within the region 20 kb from the start of the cas1 gene and 20 kb from the end of the cas1 gene. In certain embodiments, the effector protein comprises at least one HEPN domain and at least 500 amino acids, and wherein the C2c2 effector protein is naturally present in a prokaryotic genome within 20 kb upstream or downstream of a Cas gene or a CRISPR array. Non-limiting examples of Cas proteins include Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologues thereof, or modified versions thereof. In certain example embodiments, the C2c2 effector protein is naturally present in a prokaryotic genome within 20 kb upstream or downstream of a Cas 1 gene. The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of. Homologous proteins may but need not be structurally related, or are only partially structurally related. An "orthologue" of a protein as used herein is a protein of a different species which performs the same or a similar function as the protein it is an orthologue of. Orthologous proteins may but need not be structurally related, or are only partially structurally related.

Guide Molecules

The methods described herein may be used to screen inhibition of CRISPR systems employing different types of guide molecules. As used herein, the term "guide sequence" and "guide molecule" in the context of a CRISPR-Cas system, comprises any polynucleotide sequence having sufficient complementarity with a target nucleic acid sequence to hybridize with the target nucleic acid sequence and direct sequence-specific binding of a nucleic acid-targeting complex to the target nucleic acid sequence. The guide sequences made using the methods disclosed herein may be a full-length guide sequence, a truncated guide sequence, a full-length sgRNA sequence, a truncated sgRNA sequence, or an E+F sgRNA sequence. In some embodiments, the degree of complementarity of the guide sequence to a given target sequence, when optimally aligned using a suitable alignment algorithm, is about or more than about 50%, 60%, 75%, 80%, 85%, 90%, 95%, 97.5%, 99%, or more. In certain example embodiments, the guide molecule comprises a guide sequence that may be designed to have at least one mismatch with the target sequence, such that an RNA duplex formed between the guide sequence and the target sequence. Accordingly, the degree of complementarity is preferably less than 99%. For instance, where the guide sequence consists of 24 nucleotides, the degree of complementarity is more particularly about 96% or less. In particular embodiments, the guide sequence is designed to have a stretch of two or more adjacent mismatching nucleotides, such that the degree of complementarity over the entire guide sequence is further reduced. For instance, where the guide sequence consists of 24 nucleotides, the degree of complementarity is more particularly about 96% or less, more particularly, about 92% or less, more particularly about 88% or less, more particularly about 84% or less, more particularly about 80% or less, more particularly about 76% or less, more particularly about 72% or less, depending on whether the stretch of two or more mismatching nucleotides encompasses 2, 3, 4, 5, 6 or 7 nucleotides, etc. In some embodiments, aside from the stretch of one or more mismatching nucleotides, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), Clustal W, Clustal X, BLAT, Novoalign (Novocraft Technologies; available at www.novocraft.com), ELAND (Illumina, San Diego, CA), SOAP (available at soap.genomics.org.cn), and Maq (available at maq.sourceforge.net). The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence (or a sequence in the vicinity thereof) may be evaluated in a test tube by providing the target nucleic acid sequence, components of a nucleic acid-targeting complex, including the guide sequence to be tested and a control guide sequence different from the test guide sequence, and comparing binding or rate of cleavage at or in the vicinity of the target sequence between the test and control guide sequence reactions. Other assays are possible, and will occur to those skilled in the art. A guide sequence, and hence a nucleic acid-targeting guide RNA may be selected to target any target nucleic acid sequence.

In certain embodiments, the guide sequence or spacer length of the guide molecules is from 15 to 50 nt. In certain embodiments, the spacer length of the guide RNA is at least 15 nucleotides. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer. In certain example embodiment, the guide sequence is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nt.

In some embodiments, the guide sequence is an RNA sequence of between 10 to 50 nt in length, but more particularly of about 20-30 nt advantageously about 20 nt, 23-25 nt or 24 nt. The guide sequence is selected so as to ensure that it hybridizes to the target sequence. This is described more in detail below. Selection can encompass further steps which increase efficacy and specificity.

In some embodiments, the guide sequence has a canonical length (e.g., about 15-30 nt) is used to hybridize with the target RNA or DNA. In some embodiments, a guide molecule is longer than the canonical length (e.g., >30 nt) is used to hybridize with the target RNA or DNA, such that a region of the guide sequence hybridizes with a region of the RNA or DNA strand outside of the Cas-guide target complex. This can be of interest where additional modifications, such deamination of nucleotides is of interest. In alternative embodiments, it is of interest to maintain the limitation of the canonical guide sequence length.

In some embodiments, the sequence of the guide molecule (direct repeat and/or spacer) is selected to reduce the degree secondary structure within the guide molecule. In some embodiments, about or less than about 75%, 50%, 40%, 30%, 25%, 20%, 15%, 10%, 5%, 1%, or fewer of the nucleotides of the nucleic acid-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106 (1): 23-24; and P A Carr and G M Church, 2009, Nature Biotechnology 27 (12): 1151-62).

In some embodiments, it is of interest to reduce the susceptibility of the guide molecule to RNA cleavage, such as to cleavage by Cas13. Accordingly, in particular embodiments, the guide molecule is adjusted to avoid cleavage by Cas13 or other RNA-cleaving enzymes.

In certain embodiments, the guide molecule comprises non-naturally occurring nucleic acids and/or non-naturally occurring nucleotides and/or nucleotide analogs, and/or chemically modifications. Preferably, these non-naturally occurring nucleic acids and non-naturally occurring nucleotides are located outside the guide sequence. Non-naturally occurring nucleic acids can include, for example, mixtures of naturally and non-naturally occurring nucleotides. Non-naturally occurring nucleotides and/or nucleotide analogs may be modified at the ribose, phosphate, and/or base moiety. In an embodiment of the invention, a guide nucleic acid comprises ribonucleotides and non-ribonucleotides. In one such embodiment, a guide comprises one or more ribonucleotides and one or more deoxyribonucleotides. In an embodiment of the invention, the guide comprises one or more non-naturally occurring nucleotide or nucleotide analog such as a nucleotide with phosphorothioate linkage, a locked nucleic acid (LNA) nucleotides comprising a methylene bridge between the 2' and 4' carbons of the ribose ring, or bridged nucleic acids (BNA). Other examples of modified nucleotides include 2'-O-methyl analogs, 2'-deoxy analogs, or 2'-fluoro analogs. Further examples of modified bases include, but are not limited to, 2-aminopurine, 5-bromo-uridine, pseudouridine, inosine, 7-methylguanosine. Examples of guide RNA chemical modifications include, without limitation, incorporation of 2'-O-methyl (M), 2'-O-methyl 3' phosphorothioate (MS), S-constrained ethyl (cEt), or 2'-O-methyl 3' thioPACE (MSP) at one or more terminal nucleotides. Such chemically modified guides can comprise increased stability and increased activity as compared to unmodified guides, though on-target vs. off-target specificity is not predictable. (See, Hendel, 2015, Nat Biotechnol. 33 (9): 985-9, doi: 10.1038/nbt.3290, published online 29 Jun. 2015 Ragdarm et al., 0215, *PNAS, E*7110-E7111; Allerson et al., *J. Med. Chem.* 2005, 48:901-904; Bramsen et al., *Front. Genet.*, 2012, 3:154; Deng et al., *PNAS,* 2015, 112:11870-11875; Sharma et al., *MedChemComm.,* 2014, 5:1454-1471; Hendel et al., *Nat. Biotechnol.* (2015) 33 (9): 985-989; Li et al., *Nature Biomedical Engineering,* 2017, 1, 0066 DOI: 10.1038/s41551-017-0066). In some embodiments, 5' and/or 3' end of a guide RNA is modified by a variety of functional moieties including fluorescent dyes, polyethylene glycol, cholesterol, proteins, or detection tags. (See Kelly et al., 2016, *J. Biotech.* 233:74-83). In certain embodiments, a guide comprises ribonucleotides in a region that binds to a target RNA and one or more deoxyribonucleotides and/or nucleotide analogs in a region that binds to Cas13. In an embodiment of the invention, deoxyribonucleotides and/or nucleotide analogs are incorporated in engineered guide structures, such as, without limitation, stem-loop regions, and the seed region. For Cas13 guide, in certain embodiments, the modification is not in 5'-handle of the stem-loop regions. Chemical modification in 5'-handle of the stem-loop region of a guide may abolish its function (see Li, et al., *Nature Biomedical Engineering,* 2017, 1:0066). In certain embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, or 75 nucleotides of a guide is chemically modified. In some embodiments, 3-5 nucleotides at either 3' or 5' end of a guide is chemically modified. In some embodiments, only minor modifications are introduced in the seed region, such as 2'-F modifications. In some embodiments, 2'-F modification is introduced at the 3' end of a guide. In certain embodiments, three to five nucleotides at 5' and/or 3' end of the guide are chemically modified with 2'-O-methyl (M), 2'-O-methyl 3' phosphorothioate (MS), S-constrained ethyl (cEt), or 2'-O-methyl 3' thioPACE (MSP). Such modification can enhance genome editing efficiency (see Hendel et al., *Nat. Biotechnol.* (2015) 33 (9): 985-989). In certain embodiments, all of the phosphodiester bonds of a guide are substituted with phosphorothioates (PS) for enhancing levels of gene disruption. In certain embodiments, more than five nucleotides at 5' and/or 3' end of the guide are chemically modified with 2'-O-Me, 2'-F or S-constrained ethyl (cEt). Such chemically modified guide can mediate enhanced levels of gene disruption (see Ragdarm et al., 0215, *PNAS, E*7110-E7111). In an embodiment of the invention, a guide is modified to comprise a chemical moiety at its 3' and/or 5' end. Such moieties include, but are not limited to amine, azide, alkyne, thio, dibenzocyclooctyne (DBCO), or Rhodamine. In certain embodiment, the chemical moiety is conjugated to the guide by a linker, such as an alkyl chain. In certain embodiments, the chemical moiety of the modified guide can be used to attach the guide to another molecule, such as DNA, RNA, protein, or nanoparticles. Such chemically modified guide can be used to identify or enrich cells generically edited by a CRISPR system (see Lee et al., *eLife,* 2017, 6: e25312, DOI: 10.7554).

In some embodiments, the modification to the guide is a chemical modification, an insertion, a deletion or a split. In some embodiments, the chemical modification includes, but is not limited to, incorporation of 2'-O-methyl (M) analogs, 2'-deoxy analogs, 2-thiouridine analogs, N6-methyladenosine analogs, 2'-fluoro analogs, 2-aminopurine, 5-bromo-uridine, pseudouridine (Ψ), N1-methylpseudouridine (melΨ), 5-methoxyuridine (5moU), inosine, 7-methylguanosine, 2'-O-methyl 3'phosphorothioate (MS), S-constrained ethyl (cEt), phosphorothioate (PS), or 2'-O-methyl 3'thioPACE (MSP). In some embodiments, the guide comprises one or more of phosphorothioate modifications. In certain embodiments, at least 1, 2, 3, 4, 5, 6, 7, 8, 9, 10, 11, 12, 13, 14, 15, 16, 17, 18, 19, 20, or 25 nucleotides of the guide are chemically modified. In certain embodiments, one or more nucleotides in the seed region are chemically modified. In certain embodiments, one or more nucleotides in 3'-terminus are chemically modified. In certain embodiments, none of the nucleotides in 5'-handle is chemically modified. In some embodiments, the chemical modification in the seed region is a minor modification, such as incorporation of a 2'-fluoro analog. In a specific embodiment, one nucleotide of the seed region is replaced with a 2'-fluoro analog. In some embodiments, 5 to 10 nucleotides in 3'-terminus are chemically modified. Such chemical modifications at the 3'-terminus of the Cas13 CrRNA may improve Cas13 activity. In a specific embodiment, 1, 2, 3, 4, 5, 6, 7, 8, 9 or 10 nucleotides in 3'-terminus are replaced with 2'-fluoro analogues. In a specific embodiment, 1, 2, 3, 4, 5, 6, 7, 8, 9 or 10 nucleotides in 3'-terminus are replaced with 2'-O-methyl (M) analogs.

In some embodiments, the loop of 5'-handle of the guide is modified. In some embodiments, the loop of 5'-handle of the guide is modified to have a deletion, an insertion, a split, or chemical modifications. In certain embodiments, the modified loop comprises 3, 4, or 5 nucleotides. In certain embodiments, the loop comprises the sequence of UCUU, UUUU, UAUU, or UGUU.

In some embodiments, the guide molecule forms a stem-loop with a separate non-covalently linked sequence, which can be DNA or RNA. In particular embodiments, the sequences forming the guide are first synthesized using the standard phosphoramidite synthetic protocol (Herdewijn, P., ed., Methods in Molecular Biology Col 288, Oligonucleotide Synthesis: Methods and Applications, Humana Press, New Jersey (2012)). In some embodiments, these sequences can be functionalized to contain an appropriate functional group for ligation using the standard protocol known in the art (Hermanson, G. T., Bioconjugate Techniques, Academic Press (2013)). Examples of functional groups include, but are not limited to, hydroxyl, amine, carboxylic acid, carboxylic acid halide, carboxylic acid active ester, aldehyde, carbonyl, chlorocarbonyl, imidazolylcarbonyl, hydrozide, semicarbazide, thio semicarbazide, thiol, maleimide, haloalkyl, sulfonyl, ally, propargyl, diene, alkyne, and azide. Once this sequence is functionalized, a covalent chemical bond or linkage can be formed between this sequence and the direct repeat sequence. Examples of chemical bonds include, but are not limited to, those based on carbamates, ethers, esters, amides, imines, amidines, aminotrizines, hydrozone, disulfides, thioethers, thioesters, phosphorothioates, phosphorodithioates, sulfonamides, sulfonates, fulfones, sulfoxides, ureas, thioureas, hydrazide, oxime, triazole, photolabile linkages, C—C bond forming groups such as Diels-Alder cyclo-addition pairs or ring-closing metathesis pairs, and Michael reaction pairs.

In some embodiments, these stem-loop forming sequences can be chemically synthesized. In some embodiments, the chemical synthesis uses automated, solid-phase oligonucleotide synthesis machines with 2'-acetoxyethyl orthoester (2'-ACE) (Scaringe et al., J. Am. Chem. Soc. (1998) 120:11820-11821; Scaringe, Methods Enzymol. (2000) 317:3-18) or 2'-thionocarbamate (2'-TC) chemistry (Dellinger et al., J. Am. Chem. Soc. (2011) 133:11540-11546; Hendel et al., Nat. Biotechnol. (2015) 33:985-989).

In certain embodiments, the guide molecule comprises (1) a guide sequence capable of hybridizing to a target locus and (2) a tracr mate or direct repeat sequence whereby the direct repeat sequence is located upstream (i.e., 5') from the guide sequence. In a particular embodiment the seed sequence (i.e. the sequence essential critical for recognition and/or hybridization to the sequence at the target locus) of th guide sequence is approximately within the first 10 nucleotides of the guide sequence.

In a particular embodiment the guide molecule comprises a guide sequence linked to a direct repeat sequence, wherein the direct repeat sequence comprises one or more stem loops or optimized secondary structures. In particular embodiments, the direct repeat has a minimum length of 16 nts and a single stem loop. In further embodiments the direct repeat has a length longer than 16 nts, preferably more than 17 nts, and has more than one stem loops or optimized secondary structures. In particular embodiments the guide molecule comprises or consists of the guide sequence linked to all or part of the natural direct repeat sequence. A typical Type V or Type VI CRISPR-cas guide molecule comprises (in 3' to 5' direction or in 5' to 3' direction): a guide sequence a first complimentary stretch (the "repeat"), a loop (which is typically 4 or 5 nucleotides long), a second complimentary stretch (the "anti-repeat" being complimentary to the repeat), and a poly A (often poly U in RNA) tail (terminator). In certain embodiments, the direct repeat sequence retains its natural architecture and forms a single stem loop. In particular embodiments, certain aspects of the guide architecture can be modified, for example by addition, subtraction, or substitution of features, whereas certain other aspects of guide architecture are maintained. Preferred locations for engineered guide molecule modifications, including but not limited to insertions, deletions, and substitutions include guide termini and regions of the guide molecule that are exposed when complexed with the CRISPR-Cas protein and/or target, for example the stemloop of the direct repeat sequence.

In particular embodiments, the stem comprises at least about 4 bp comprising complementary X and Y sequences, although stems of more, e.g., 5, 6, 7, 8, 9, 10, 11 or 12 or fewer, e.g., 3, 2, base pairs are also contemplated. Thus, for example X2-10 and Y2-10 (wherein X and Y represent any complementary set of nucleotides) may be contemplated. In one aspect, the stem made of the X and Y nucleotides, together with the loop will form a complete hairpin in the overall secondary structure; and, this may be advantageous and the amount of base pairs can be any amount that forms a complete hairpin. In one aspect, any complementary X:Y base pairing sequence (e.g., as to length) is tolerated, so long as the secondary structure of the entire guide molecule is preserved. In one aspect, the loop that connects the stem made of X:Y base pairs can be any sequence of the same length (e.g., 4 or 5 nucleotides) or longer that does not interrupt the overall secondary structure of the guide molecule. In one aspect, the stemloop can further comprise, e.g. an MS2 aptamer. In one aspect, the stem comprises about 5-7 bp comprising complementary X and Y sequences, although stems of more or fewer base pairs are also contemplated. In one aspect, non-Watson Crick base pairing is contemplated, where such pairing otherwise generally preserves the architecture of the stemloop at that position.

In particular embodiments the natural hairpin or stemloop structure of the guide molecule is extended or replaced by an extended stemloop. It has been demonstrated that extension of the stem can enhance the assembly of the guide molecule with the CRISPR-Cas protein (Chen et al. Cell. (2013); 155 (7): 1479-1491). In particular embodiments the stem of the stemloop is extended by at least 1, 2, 3, 4, 5 or more complementary base pairs (i.e. corresponding to the addition of 2, 4, 6, 8, 10 or more nucleotides in the guide molecule). In particular embodiments these are located at the end of the stem, adjacent to the loop of the stemloop.

In particular embodiments, the susceptibility of the guide molecule to RNAses or to decreased expression can be reduced by slight modifications of the sequence of the guide molecule which do not affect its function. For instance, in particular embodiments, premature termination of transcription, such as premature transcription of U6 Pol-III, can be removed by modifying a putative Pol-III terminator (4 consecutive U's) in the guide molecules sequence. Where such sequence modification is required in the stemloop of the guide molecule, it is preferably ensured by a base pair flip.

In a particular embodiment, the direct repeat may be modified to comprise one or more protein-binding RNA aptamers. In a particular embodiment, one or more aptamers may be included such as part of optimized secondary structure. Such aptamers may be capable of binding a bacteriophage coat protein as detailed further herein.

In some embodiments, the guide molecule forms a duplex with a target RNA comprising at least one target cytosine residue to be edited. Upon hybridization of the guide RNA molecule to the target RNA, the cytidine deaminase binds to the single strand RNA in the duplex made accessible by the mismatch in the guide sequence and catalyzes deamination of one or more target cytosine residues comprised within the stretch of mismatching nucleotides.

A guide sequence, and hence a nucleic acid-targeting guide RNA may be selected to target any target nucleic acid sequence. The target sequence may be mRNA.

In certain embodiments, the target sequence should be associated with a PAM (protospacer adjacent motif) or PFS (protospacer flanking sequence or site); that is, a short sequence recognized by the CRISPR complex. Depending on the nature of the CRISPR-Cas protein, the target sequence should be selected such that its complementary sequence in the DNA duplex (also referred to herein as the non-target sequence) is upstream or downstream of the PAM. In the embodiments of the present invention where the CRISPR-Cas protein is a Cas13 protein, the complementary sequence of the target sequence is downstream or 3' of the PAM or upstream or 5' of the PAM. The precise sequence and length requirements for the PAM differ depending on the Cas13 protein used, but PAMs are typically 2-5 base pair sequences adjacent the protospacer (that is, the target sequence). Examples of the natural PAM sequences for different Cas13 orthologues are provided herein below and the skilled person will be able to identify further PAM sequences for use with a given Cas13 protein.

Further, engineering of the PAM Interacting (PI) domain may allow programing of PAM specificity, improve target site recognition fidelity, and increase the versatility of the CRISPR-Cas protein, for example as described for Cas9 in Kleinstiver B P et al. Engineered CRISPR-Cas9 nucleases with altered PAM specificities. Nature. 2015 Jul. 23; 523 (7561): 481-5. doi: 10.1038/nature 14592. As further detailed herein, the skilled person will understand that Cas13 proteins may be modified analogously.

In particular embodiment, the guide is an escorted guide. By "escorted" is meant that the CRISPR-Cas system or complex or guide is delivered to a selected time or place within a cell, so that activity of the CRISPR-Cas system or complex or guide is spatially or temporally controlled. For example, the activity and destination of the 3 CRISPR-Cas system or complex or guide may be controlled by an escort RNA aptamer sequence that has binding affinity for an aptamer ligand, such as a cell surface protein or other localized cellular component. Alternatively, the escort aptamer may for example be responsive to an aptamer effector on or in the cell, such as a transient effector, such as an external energy source that is applied to the cell at a particular time.

The escorted CRISPR-Cas systems or complexes have a guide molecule with a functional structure designed to improve guide molecule structure, architecture, stability, genetic expression, or any combination thereof. Such a structure can include an aptamer.

Aptamers are biomolecules that can be designed or selected to bind tightly to other ligands, for example using a technique called systematic evolution of ligands by exponential enrichment (SELEX; Tuerk C, Gold L: "Systematic evolution of ligands by exponential enrichment: RNA ligands to bacteriophage T4 DNA polymerase." Science 1990, 249:505-510). Nucleic acid aptamers can for example be selected from pools of random-sequence oligonucleotides, with high binding affinities and specificities for a wide range of biomedically relevant targets, suggesting a wide range of therapeutic utilities for aptamers (Keefe, Anthony D., Supriya Pai, and Andrew Ellington. "Aptamers as therapeutics." Nature Reviews Drug Discovery 9.7 (2010): 537-550). These characteristics also suggest a wide range of uses for aptamers as drug delivery vehicles (Levy-Nissenbaum, Etgar, et al. "Nanotechnology and aptamers: applications in drug delivery." Trends in biotechnology 26.8 (2008): 442-449; and, Hicke B J, Stephens A W. "Escort aptamers: a delivery service for diagnosis and therapy." J Clin Invest 2000, 106:923-928.). Aptamers may also be constructed that function as molecular switches, responding to a que by changing properties, such as RNA aptamers that bind fluorophores to mimic the activity of green fluorescent protein (Paige, Jeremy S., Karen Y. Wu, and Samie R. Jaffrey. "RNA mimics of green fluorescent protein." Science 333.6042 (2011): 642-646). It has also been suggested that aptamers may be used as components of targeted siRNA therapeutic delivery systems, for example targeting cell surface proteins (Zhou, Jiehua, and John J. Rossi. "Aptamer-targeted cell-specific RNA interference." Silence 1.1 (2010): 4).

Accordingly, in particular embodiments, the guide molecule is modified, e.g., by one or more aptamer(s) designed to improve guide molecule delivery, including delivery across the cellular membrane, to intracellular compartments, or into the nucleus. Such a structure can include, either in addition to the one or more aptamer(s) or without such one or more aptamer(s), moiety(ies) so as to render the guide molecule deliverable, inducible or responsive to a selected effector. The invention accordingly comprehends an guide molecule that responds to normal or pathological physiological conditions, including without limitation pH, hypoxia, $O_2$ concentration, temperature, protein concentration, enzymatic concentration, lipid structure, light exposure, mechanical disruption (e.g. ultrasound waves), magnetic fields, electric fields, or electromagnetic radiation.

Light responsiveness of an inducible system may be achieved via the activation and binding of cryptochrome-2 and CIB1. Blue light stimulation induces an activating conformational change in cryptochrome-2, resulting in recruitment of its binding partner CIB1. This binding is fast and reversible, achieving saturation in <15 sec following pulsed stimulation and returning to baseline <15 min after the end of stimulation. These rapid binding kinetics result in a system temporally bound only by the speed of transcription/translation and transcript/protein degradation, rather than uptake and clearance of inducing agents. Crytochrome-2 activation is also highly sensitive, allowing for the use of low light intensity stimulation and mitigating the risks of phototoxicity. Further, in a context such as the intact mammalian brain, variable light intensity may be used to control the size of a stimulated region, allowing for greater precision than vector delivery alone may offer.

The invention contemplates energy sources such as electromagnetic radiation, sound energy or thermal energy to induce the guide. Advantageously, the electromagnetic radiation is a component of visible light. In a preferred embodiment, the light is a blue light with a wavelength of about 450 to about 495 nm. In an especially preferred embodiment, the wavelength is about 488 nm. In another preferred embodiment, the light stimulation is via pulses. The light power may range from about 0-9 mW/cm$^2$. In a preferred embodiment, a stimulation paradigm of as low as 0.25 sec every 15 sec should result in maximal activation.

The chemical or energy sensitive guide may undergo a conformational change upon induction by the binding of a chemical source or by the energy allowing it act as a guide and have the Cas13 CRISPR-Cas system or complex function. The invention can involve applying the chemical source or energy so as to have the guide function and the Cas13 CRISPR-Cas system or complex function; and optionally further determining that the expression of the genomic locus is altered.

There are several different designs of this chemical inducible system: 1. ABI-PYL based system inducible by Abscisic Acid (ABA) (see, e.g., stke.sciencemag.org/cgi/content/abstract/sigtrans; 4/164/rs2), 2. FKBP-FRB based system inducible by rapamycin (or related chemicals based on rapamycin) (see, e.g., www.nature.com/nmeth/journal/v2/n6/full/nmeth763.html), 3. GID1-GAI based system inducible by Gibberellin (GA) (see, e.g., www.nature.com/nchembio/journal/v8/n5/full/nchembio.922.html).

A chemical inducible system can be an estrogen receptor (ER) based system inducible by 4-hydroxytamoxifen (4OHT) (see, e.g., www.pnas.org/content/1Apr. 3, 1027.abstract). A mutated ligand-binding domain of the estrogen receptor called ERT2 translocates into the nucleus of cells upon binding of 4-hydroxytamoxifen. In further embodiments of the invention any naturally occurring or engineered derivative of any nuclear receptor, thyroid hormone receptor, retinoic acid receptor, estrogen receptor, estrogen-related receptor, glucocorticoid receptor, progesterone receptor, androgen receptor may be used in inducible systems analogous to the ER based inducible system.

Another inducible system is based on the design using Transient receptor potential (TRP) ion channel based system inducible by energy, heat or radio-wave (see, e.g., www.sciencemag.org/content/336/6081/604). These TRP family proteins respond to different stimuli, including light and heat. When this protein is activated by light or heat, the ion channel will open and allow the entering of ions such as calcium into the plasma membrane. This influx of ions will bind to intracellular ion interacting partners linked to a polypeptide including the guide and the other components of the Cas13 CRISPR-Cas complex or system, and the binding will induce the change of sub-cellular localization of the polypeptide, leading to the entire polypeptide entering the nucleus of cells. Once inside the nucleus, the guide protein and the other components of the Cas13 CRISPR-Cas complex will be active and modulating target gene expression in cells.

While light activation may be an advantageous embodiment, sometimes it may be disadvantageous especially for in vivo applications in which the light may not penetrate the skin or other organs. In this instance, other methods of energy activation are contemplated, in particular, electric field energy and/or ultrasound which have a similar effect.

Electric field energy is preferably administered substantially as described in the art, using one or more electric pulses of from about 1 Volt/cm to about 10 k Volts/cm under in vivo conditions. Instead of or in addition to the pulses, the electric field may be delivered in a continuous manner. The electric pulse may be applied for between 1 µs and 500 milliseconds, preferably between 1 µs and 100 milliseconds. The electric field may be applied continuously or in a pulsed manner for 5 about minutes.

As used herein, 'electric field energy' is the electrical energy to which a cell is exposed. Preferably the electric field has a strength of from about 1 Volt/cm to about 10 k Volts/cm or more under in vivo conditions (see WO97/49450).

As used herein, the term "electric field" includes one or more pulses at variable capacitance and voltage and including exponential and/or square wave and/or modulated wave and/or modulated square wave forms. References to electric fields and electricity should be taken to include reference the presence of an electric potential difference in the environment of a cell. Such an environment may be set up by way of static electricity, alternating current (AC), direct current (DC), etc, as known in the art. The electric field may be uniform, non-uniform or otherwise, and may vary in strength and/or direction in a time dependent manner.

Single or multiple applications of electric field, as well as single or multiple applications of ultrasound are also possible, in any order and in any combination. The ultrasound and/or the electric field may be delivered as single or multiple continuous applications, or as pulses (pulsatile delivery).

Electroporation has been used in both in vitro and in vivo procedures to introduce foreign material into living cells. With in vitro applications, a sample of live cells is first mixed with the agent of interest and placed between electrodes such as parallel plates. Then, the electrodes apply an electrical field to the cell/implant mixture. Examples of systems that perform in vitro electroporation include the Electro Cell Manipulator ECM600 product, and the Electro Square Porator T820, both made by the BTX Division of Genetronics, Inc (see U.S. Pat. No. 5,869,326).

The known electroporation techniques (both in vitro and in vivo) function by applying a brief high voltage pulse to electrodes positioned around the treatment region. The electric field generated between the electrodes causes the cell membranes to temporarily become porous, whereupon molecules of the agent of interest enter the cells. In known electroporation applications, this electric field comprises a single square wave pulse on the order of 1000 V/cm, of about 100.mu·s duration. Such a pulse may be generated, for example, in known applications of the Electro Square Porator T820.

Preferably, the electric field has a strength of from about 1 V/cm to about 10 kV/cm under in vitro conditions. Thus, the electric field may have a strength of 1 V/cm, 2 V/cm, 3 V/cm, 4 V/cm, 5 V/cm, 6 V/cm, 7 V/cm, 8 V/cm, 9 V/cm, 10 V/cm, 20 V/cm, 50 V/cm, 100 V/cm, 200 V/cm, 300 V/cm, 400 V/cm, 500 V/cm, 600 V/cm, 700 V/cm, 800 V/cm, 900 V/cm, 1 kV/cm, 2 kV/cm, 5 kV/cm, 10 kV/cm, 20 kV/cm, 50 kV/cm or more. More preferably from about 0.5 kV/cm to about 4.0 kV/cm under in vitro conditions. Preferably the electric field has a strength of from about 1 V/cm to about 10 kV/cm under in vivo conditions. However, the electric field strengths may be lowered where the number of pulses delivered to the target site are increased. Thus, pulsatile delivery of electric fields at lower field strengths is envisaged.

Preferably the application of the electric field is in the form of multiple pulses such as double pulses of the same strength and capacitance or sequential pulses of varying strength and/or capacitance. As used herein, the term "pulse" includes one or more electric pulses at variable capacitance and voltage and including exponential and/or square wave and/or modulated wave/square wave forms.

Preferably the electric pulse is delivered as a waveform selected from an exponential wave form, a square wave form, a modulated wave form and a modulated square wave form.

A preferred embodiment employs direct current at low voltage. Thus, Applicants disclose the use of an electric field which is applied to the cell, tissue or tissue mass at a field strength of between 1V/cm and 20V/cm, for a period of 100 milliseconds or more, preferably 15 minutes or more.

Ultrasound is advantageously administered at a power level of from about 0.05 W/cm$^2$ to about 100 W/cm$^2$. Diagnostic or therapeutic ultrasound may be used, or combinations thereof.

As used herein, the term "ultrasound" refers to a form of energy which consists of mechanical vibrations the frequencies of which are so high they are above the range of human hearing. Lower frequency limit of the ultrasonic spectrum may generally be taken as about 20 kHz. Most diagnostic applications of ultrasound employ frequencies in the range 1 and 15 MHz' (From Ultrasonics in Clinical Diagnosis, P. N. T. Wells, ed., 2nd. Edition, Publ. Churchill Livingstone [Edinburgh, London & NY, 1977]).

Ultrasound has been used in both diagnostic and therapeutic applications. When used as a diagnostic tool ("diagnostic ultrasound"), ultrasound is typically used in an energy density range of up to about 100 mW/cm$^2$ (FDA recommendation), although energy densities of up to 750 mW/cm$^2$ have been used. In physiotherapy, ultrasound is typically used as an energy source in a range up to about 3 to 4 W/cm$^2$ (WHO recommendation). In other therapeutic applications, higher intensities of ultrasound may be employed, for example, HIFU at 100 W/cm up to 1 kW/cm$^2$ (or even higher) for short periods of time. The term "ultrasound" as used in this specification is intended to encompass diagnostic, therapeutic and focused ultrasound.

Focused ultrasound (FUS) allows thermal energy to be delivered without an invasive probe (see Morocz et al 1998 Journal of Magnetic Resonance Imaging Vol. 8, No. 1, pp. 136-142. Another form of focused ultrasound is high intensity focused ultrasound (HIFU) which is reviewed by Moussatov et al in Ultrasonics (1998) Vol. 36, No. 8, pp. 893-900 and TranHuuHue et al in Acustica (1997) Vol. 83, No. 6, pp. 1103-1106.

Preferably, a combination of diagnostic ultrasound and a therapeutic ultrasound is employed. This combination is not intended to be limiting, however, and the skilled reader will appreciate that any variety of combinations of ultrasound may be used. Additionally, the energy density, frequency of ultrasound, and period of exposure may be varied.

Preferably the exposure to an ultrasound energy source is at a power density of from about 0.05 to about 100 Wcm−2. Even more preferably, the exposure to an ultrasound energy source is at a power density of from about 1 to about 15 Wcm−2.

Preferably the exposure to an ultrasound energy source is at a frequency of from about 0.015 to about 10.0 MHz. More preferably the exposure to an ultrasound energy source is at a frequency of from about 0.02 to about 5.0 MHz or about 6.0 MHz. Most preferably, the ultrasound is applied at a frequency of 3 MHz.

Preferably the exposure is for periods of from about 10 milliseconds to about 60 minutes. Preferably the exposure is for periods of from about 1 second to about 5 minutes. More preferably, the ultrasound is applied for about 2 minutes. Depending on the particular target cell to be disrupted, however, the exposure may be for a longer duration, for example, for 15 minutes.

Advantageously, the target tissue is exposed to an ultrasound energy source at an acoustic power density of from about 0.05 Wcm−2 to about 10 Wcm−2 with a frequency ranging from about 0.015 to about 10 MHZ (see WO 98/52609). However, alternatives are also possible, for example, exposure to an ultrasound energy source at an acoustic power density of above 100 Wcm−2, but for reduced periods of time, for example, 1000 Wcm−2 for periods in the millisecond range or less.

Preferably the application of the ultrasound is in the form of multiple pulses; thus, both continuous wave and pulsed wave (pulsatile delivery of ultrasound) may be employed in any combination. For example, continuous wave ultrasound may be applied, followed by pulsed wave ultrasound, or vice versa. This may be repeated any number of times, in any order and combination. The pulsed wave ultrasound may be applied against a background of continuous wave ultrasound, and any number of pulses may be used in any number of groups.

Preferably, the ultrasound may comprise pulsed wave ultrasound. In a highly preferred embodiment, the ultrasound is applied at a power density of 0.7 Wcm−2 or 1.25 Wcm−2 as a continuous wave. Higher power densities may be employed if pulsed wave ultrasound is used.

Use of ultrasound is advantageous as, like light, it may be focused accurately on a target. Moreover, ultrasound is advantageous as it may be focused more deeply into tissues unlike light. It is therefore better suited to whole-tissue penetration (such as but not limited to a lobe of the liver) or whole organ (such as but not limited to the entire liver or an entire muscle, such as the heart) therapy. Another important advantage is that ultrasound is a non-invasive stimulus which is used in a wide variety of diagnostic and therapeutic applications. By way of example, ultrasound is well known in medical imaging techniques and, additionally, in orthopedic therapy. Furthermore, instruments suitable for the application of ultrasound to a subject vertebrate are widely available and their use is well known in the art.

In particular embodiments, the guide molecule is modified by a secondary structure to increase the specificity of the CRISPR-Cas system and the secondary structure can protect against exonuclease activity and allow for 5' additions to the guide sequence also referred to herein as a protected guide molecule.

In one aspect, the invention provides for hybridizing a "protector RNA" to a sequence of the guide molecule, wherein the "protector RNA" is an RNA strand complementary to the 3' end of the guide molecule to thereby generate a partially double-stranded guide RNA. In an embodiment of the invention, protecting mismatched bases (i.e. the bases of the guide molecule which do not form part of the guide sequence) with a perfectly complementary protector sequence decreases the likelihood of target RNA binding to the mismatched base pairs at 3' end. In particular embodiments of the invention, additional sequences comprising an extented length may also be present within the guide molecule such that the guide comprises a protector sequence within the guide molecule. This "protector sequence" ensures that the guide molecule comprises a "protected sequence" in addition to an "exposed sequence" (comprising the part of the guide sequence hybridizing to the target sequence). In particular embodiments, the guide molecule is modified by the presence of the protector guide to comprise a secondary structure such as a hairpin. Advantageously there are three or four to thirty or more, e.g., about 10 or more, contiguous base pairs having complementarity to the protected sequence, the guide sequence or both. It is advantageous that the protected portion does not impede thermodynamics of the CRISPR-Cas system interacting with its target. By providing such an extension including a partially double stranded guide molecule, the guide molecule is considered protected and results in improved specific binding of the CRISPR-Cas complex, while maintaining specific activity.

In particular embodiments, use is made of a truncated guide (tru-guide), i.e. a guide molecule which comprises a guide sequence which is truncated in length with respect to the canonical guide sequence length. As described by Nowak et al. (Nucleic Acids Res (2016) 44 (20): 9555-9564), such guides may allow catalytically active CRISPR-Cas enzyme to bind its target without cleaving the target RNA. In particular embodiments, a truncated guide is used which allows the binding of the target but retains only nickase activity of the CRISPR-Cas enzyme.

The present invention may also use a Cas12 CRISPR enzyme. Cas12 enzymes include Cas12a (Cpf1), Cas12b (C2cl), and Cas12c (C2c3), described further herein.

The present invention may be further illustrated and extended based on aspects of CRISPR-Cas development and use as set forth in the following articles and particularly as relates to delivery of a CRISPR protein complex and uses of an RNA guided endonuclease in cells and organisms:

Multiplex genome engineering using CRISPR-Cas systems. Cong, L., Ran, F. A., Cox, D., Lin, S., Barretto, R., Habib, N., Hsu, P. D., Wu, X., Jiang, W., Marraffini, L. A., & Zhang, F. Science February 15; 339 (6121): 819-23 (2013);

RNA-guided editing of bacterial genomes using CRISPR-Cas systems. Jiang W., Bikard D., Cox D., Zhang F, Marraffini LA. Nat Biotechnol March; 31 (3): 233-9 (2013);

One-Step Generation of Mice Carrying Mutations in Multiple Genes by CRISPR-Cas-Mediated Genome Engineering. Wang H., Yang H., Shivalila C S., Dawlaty M M., Cheng A W., Zhang F., Jaenisch R. Cell May 9; 153 (4): 910-8 (2013);

Optical control of mammalian endogenous transcription and epigenetic states. Konermann S, Brigham M D, Trevino A E, Hsu P D, Heidenreich M, Cong L, Platt R J, Scott D A, Church G M, Zhang F. Nature. August 22; 500 (7463): 472-6. doi: 10.1038/Nature12466. Epub 2013 Aug. 23 (2013);

Double Nicking by RNA-Guided CRISPR Cas9 for Enhanced Genome Editing Specificity. Ran, F A., Hsu, P D., Lin, C Y., Gootenberg, J S., Konermann, S., Trevino, A E., Scott, D A., Inoue, A., Matoba, S., Zhang, Y., & Zhang, F. Cell August 28. pii: S0092-8674 (13) 01015-5 (2013-A);

DNA targeting specificity of RNA-guided Cas9 nucleases. Hsu, P., Scott, D., Weinstein, J., Ran, FA., Konermann, S., Agarwala, V., Li, Y., Fine, E., Wu, X., Shalem, O., Cradick, T J., Marraffini, L A., Bao, G., & Zhang, F. Nat Biotechnol doi: 10.1038/nbt.2647 (2013);

Genome engineering using the CRISPR-Cas9 system. Ran, F A., Hsu, P D., Wright, J., Agarwala, V., Scott, D A., Zhang, F. Nature Protocols November; 8 (11): 2281-308 (2013-B);

Genome-Scale CRISPR-Cas9 Knockout Screening in Human Cells. Shalem, O., Sanjana, N E., Hartenian, E., Shi, X., Scott, D A., Mikkelson, T., Heckl, D., Ebert, B L., Root, D E., Doench, J G., Zhang, F. Science December 12. (2013);

Crystal structure of cas9 in complex with guide RNA and target DNA. Nishimasu, H., Ran, F A., Hsu, P D., Konermann, S., Shehata, S I., Dohmae, N., Ishitani, R., Zhang, F., Nureki, O. Cell February 27, 156 (5): 935-49 (2014);

Genome-wide binding of the CRISPR endonuclease Cas9 in mammalian cells. Wu X., Scott D A., Kriz A J., Chiu A C., Hsu P D., Dadon D B., Cheng A W., Trevino A E., Konermann S., Chen S., Jaenisch R., Zhang F., Sharp P A. Nat Biotechnol. April 20. doi: 10.1038/nbt.2889 (2014);

CRISPR-Cas9 Knockin Mice for Genome Editing and Cancer Modeling. Platt R J, Chen S, Zhou Y, Yim M J, Swiech L, Kempton H R, Dahlman J E, Parnas O, Eisenhaure T M, Jovanovic M, Graham D B, Jhunjhunwala S, Heidenreich M, Xavier R J, Langer R, Anderson D G, Hacohen N, Regev A, Feng G, Sharp P A, Zhang F. Cell 159 (2): 440-455 DOI: 10.1016/j.cell.2014.09.014 (2014);

Development and Applications of CRISPR-Cas9 for Genome Engineering, Hsu P D, Lander E S, Zhang F., Cell. June 5; 157 (6): 1262-78 (2014);

Genetic screens in human cells using the CRISPR-Cas9 system, Wang T, Wei J J, Sabatini D M, Lander E S., Science. January 3; 343 (6166): 80-84. doi: 10.1126/science. 1246981 (2014);

Rational design of highly active sgRNAs for CRISPR-Cas9-mediated gene inactivation, Doench J G, Hartenian E, Graham D B, Tothova Z, Hegde M, Smith I, Sullender M, Ebert B L, Xavier R J, Root D E., (published online 3 Sep. 2014) Nat Biotechnol. December; 32 (12): 1262-7 (2014);

In vivo interrogation of gene function in the mammalian brain using CRISPR-Cas9, Swiech L, Heidenreich M, Banerjee A, Habib N, Li Y, Trombetta J, Sur M, Zhang F., (published online 19 Oct. 2014) Nat Biotechnol. January; 33 (1): 102-6 (2015);

Genome-scale transcriptional activation by an engineered CRISPR-Cas9 complex, Konermann S, Brigham M D, Trevino A E, Joung J, Abudayyeh O O, Barcena C, Hsu P D, Habib N, Gootenberg J S, Nishimasu H, Nureki O, Zhang F., Nature. January 29; 517 (7536): 583-8 (2015);

A split-Cas9 architecture for inducible genome editing and transcription modulation, Zetsche B, Volz S E, Zhang F., (published online 2 Feb. 2015) Nat Biotechnol. February; 33 (2): 139-42 (2015);

Genome-wide CRISPR Screen in a Mouse Model of Tumor Growth and Metastasis, Chen S, Sanjana N E, Zheng K, Shalem O, Lee K, Shi X, Scott D A, Song J, Pan J Q, Weissleder R, Lee H, Zhang F, Sharp P A. Cell 160, 1246-1260 Mar. 12, 2015 (multiplex screen in mouse); and In vivo genome editing using *Staphylococcus aureus* Cas9, Ran F A, Cong L, Yan W X, Scott D A, Gootenberg J S, Kriz A J, Zetsche B, Shalem O, Wu X, Makarova K S, Koonin E V, Sharp P A, Zhang F., (published online 1 Apr. 2015), Nature. April 9; 520 (7546): 186-91 (2015);

A Shalem et al., "High-throughput functional genomics using CRISPR-Cas9," Nature Reviews Genetics 16, 299-311 (May 2015);

Xu et al., "Sequence determinants of improved CRISPR sgRNA design," Genome Research 25, 1147-1157 (August 2015);

Parnas et al., "A Genome-wide CRISPR Screen in Primary Immune Cells to Dissect Regulatory Networks," Cell 162, 675-686 (Jul. 30, 2015);

Ramanan et al., "CRISPR-Cas9 cleavage of viral DNA efficiently suppresses hepatitis B virus," Scientific Reports 5:10833. doi: 10.1038/srep10833 (Jun. 2, 2015);

Nishimasu et al., "Crystal Structure of *Staphylococcus aureus* Cas9," Cell 162, 1113-1126 (Aug. 27, 2015);

A BCL11A enhancer dissection by Cas9-mediated in situ saturating mutagenesis, Canver et al., Nature 527 (7577): 192-7 (Nov. 12, 2015) doi: 10.1038/nature15521. Epub 2015 Sep. 16.;

*Cpf1 Is a Single RNA-Guided Endonuclease of a Class 2 CRISPR-Cas System*, Zetsche et al., Cell 163, 759-71 (Sep. 25, 2015);

*Discovery and Functional Characterization of Diverse Class 2 CRISPR-Cas Systems*, Shmakov et al., Molecular Cell, 60 (3), 385-397 doi: 10.1016/j.molcel.2015.10.008 Epub Oct. 22, 2015;

*Rationally engineered Cas9 nucleases with improved specificity*, Slaymaker et al., Science 2016 Jan. 1 351 (6268): 84-88 doi: 10.1126/science.aad5227. Epub 2015 Dec. 1.

Gao et al, "Engineered Cpf1 Enzymes with Altered PAM Specificities," bioRxiv 091611; doi: http://dx.doi.org/10.1101/091611 (Dec. 4, 2016);

Cox et al., "RNA editing with CRISPR-Cas13," Science. 2017 Nov. 24; 358 (6366): 1019-1027. doi: 10.1126/science.aaq0180. Epub 2017 Oct. 25;

Gaudelli et al. "Programmable base editing of A-T to G-C in genomic DNA without DNA cleavage" Nature 464 (551); 464-471 (2017);

Strecker et al., "Engineering of CRISPR-Cas12b for human genome editing," Nature Communications volume 10, Article number: 212 (2019).

each of which is incorporated herein by reference, may be considered in the practice of the instant invention, and discussed briefly below:

Cong et al. engineered type II CRISPR-Cas systems for use in eukaryotic cells based on both *Streptococcus thermophilus* Cas9 and also *Streptococcus pyogenes* Cas9 and demonstrated that Cas9 nucleases can be directed by short RNAs to induce precise cleavage of DNA in human and mouse cells. Their study further showed that Cas9 as converted into a nicking enzyme can be used to facilitate homology-directed repair in eukaryotic cells with minimal mutagenic activity. Additionally, their study demonstrated that multiple guide sequences can be encoded into a single CRISPR array to enable simultaneous editing of several at endogenous genomic loci sites within the mammalian genome, demonstrating easy programmability and wide applicability of the RNA-guided nuclease technology. This ability to use RNA to program sequence specific DNA cleavage in cells defined a new class of genome engineering tools. These studies further showed that other CRISPR loci are likely to be transplantable into mammalian cells and can also mediate mammalian genome cleavage. Importantly, it can be envisaged that several aspects of the CRISPR-Cas system can be further improved to increase its efficiency and versatility.

Jiang et al. used the clustered, regularly interspaced, short palindromic repeats (CRISPR)-associated Cas9 endonuclease complexed with dual-RNAs to introduce precise mutations in the genomes of *Streptococcus pneumoniae* and *Escherichia coli*. The approach relied on dual-RNA: Cas9-directed cleavage at the targeted genomic site to kill unmutated cells and circumvents the need for selectable markers or counter-selection systems. The study reported reprogramming dual-RNA: Cas9 specificity by changing the sequence of short CRISPR RNA (crRNA) to make single- and multinucleotide changes carried on editing templates. The study showed that simultaneous use of two crRNAs enabled multiplex mutagenesis. Furthermore, when the approach was used in combination with recombineering, in *S. pneumoniae*, nearly 100% of cells that were recovered using the described approach contained the desired mutation, and in *E. coli*, 65% that were recovered contained the mutation.

Wang et al. (2013) used the CRISPR-Cas system for the one-step generation of mice carrying mutations in multiple genes which were traditionally generated in multiple steps by sequential recombination in embryonic stem cells and/or time-consuming intercrossing of mice with a single mutation. The CRISPR-Cas system will greatly accelerate the in vivo study of functionally redundant genes and of epistatic gene interactions.

A Konermann et al. (2013) addressed the need in the art for versatile and robust technologies that enable optical and chemical modulation of DNA-binding domains based CRISPR Cas9 enzyme and also Transcriptional Activator Like Effectors.

A Ran et al. (2013-A) described an approach that combined a Cas9 nickase mutant with paired guide RNAs to introduce targeted double-strand breaks. This addresses the issue of the Cas9 nuclease from the microbial CRISPR-Cas system being targeted to specific genomic loci by a guide sequence, which can tolerate certain mismatches to the DNA target and thereby promote undesired off-target mutagenesis. Because individual nicks in the genome are repaired with high fidelity, simultaneous nicking via appropriately offset guide RNAs is required for double-stranded breaks and extends the number of specifically recognized bases for target cleavage. The authors demonstrated that using paired nicking can reduce off-target activity by 50- to 1,500-fold in cell lines and to facilitate gene knockout in mouse zygotes without sacrificing on-target cleavage efficiency. This versatile strategy enables a wide variety of genome editing applications that require high specificity.

Hsu et al. (2013) characterized SpCas9 targeting specificity in human cells to inform the selection of target sites and avoid off-target effects. The study evaluated >700 guide RNA variants and SpCas9-induced indel mutation levels at >100 predicted genomic off-target loci in 293T and 293 FT cells. The authors that SpCas9 tolerates mismatches between guide RNA and target DNA at different positions in a sequence-dependent manner, sensitive to the number, position and distribution of mismatches. The authors further showed that SpCas9-mediated cleavage is unaffected by DNA methylation and that the dosage of SpCas9 and guide RNA can be titrated to minimize off-target modification. Additionally, to facilitate mammalian genome engineering applications, the authors reported providing a web-based software tool to guide the selection and validation of target sequences as well as off-target analyses.

Ran et al. (2013-B) described a set of tools for Cas9-mediated genome editing via non-homologous end joining (NHEJ) or homology-directed repair (HDR) in mammalian cells, as well as generation of modified cell lines for downstream functional studies. To minimize off-target cleavage, the authors further described a double-nicking strategy using the Cas9 nickase mutant with paired guide RNAs. The protocol provided by the authors experimentally derived guidelines for the selection of target sites, evaluation of cleavage efficiency and analysis of off-target activity. The studies showed that beginning with target design, gene modifications can be achieved within as little as 1-2 weeks, and modified clonal cell lines can be derived within 2-3 weeks.

Shalem et al. described a new way to interrogate gene function on a genome-wide scale. Their studies showed that delivery of a genome-scale CRISPR-Cas9 knock-out (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hits NF2, CUL3, TADA2B, and TADA1. The authors observed a high level of consistency between independent guide RNAs targeting the same gene and a high rate of hit confirmation, and thus demonstrated the promise of genome-scale screening with Cas9.

Nishimasu et al. reported the crystal structure of *Streptococcus pyogenes* Cas9 in complex with sgRNA and its target DNA at 2.5 A° resolution. The structure revealed a bilobed architecture composed of target recognition and nuclease lobes, accommodating the sgRNA: DNA heteroduplex in a positively charged groove at their interface. Whereas the recognition lobe is essential for binding sgRNA and DNA, the nuclease lobe contains the HNH and RuvC nuclease domains, which are properly positioned for cleavage of the complementary and non-complementary strands of the target DNA, respectively. The nuclease lobe also contains a carboxyl-terminal domain responsible for the interaction with the protospacer adjacent motif (PAM). This high-resolution structure and accompanying functional analyses have revealed the molecular mechanism of RNA-guided DNA targeting by Cas9, thus paving the way for the rational design of new, versatile genome-editing technologies.

Wu et al. mapped genome-wide binding sites of a catalytically inactive Cas9 (dCas9) from *Streptococcus pyogenes* loaded with single guide RNAs (sgRNAs) in mouse embryonic stem cells (mESCs). The authors showed that each of the four sgRNAs tested targets dCas9 to between tens and thousands of genomic sites, frequently characterized by a 5-nucleotide seed region in the sgRNA and an NGG protospacer adjacent motif (PAM). Chromatin inaccessibility decreases dCas9 binding to other sites with matching seed sequences; thus 70% of off-target sites are associated with genes. The authors showed that targeted sequencing of 295 dCas9 binding sites in mESCs transfected with catalytically active Cas9 identified only one site mutated above background levels. The authors proposed a two-state model for Cas9 binding and cleavage, in which a seed match triggers binding but extensive pairing with target DNA is required for cleavage.

Platt et al. established a Cre-dependent Cas9 knockin mouse. The authors demonstrated in vivo as well as ex vivo genome editing using adeno-associated virus (AAV)-, lentivirus-, or particle-mediated delivery of guide RNA in neurons, immune cells, and endothelial cells.

Hsu et al. (2014) is a review article that discusses generally CRISPR-Cas9 history from yogurt to genome editing, including genetic screening of cells.

Wang et al. (2014) relates to a pooled, loss-of-function genetic screening approach suitable for both positive and negative selection that uses a genome-scale lentiviral single guide RNA (sgRNA) library.

Doench et al. created a pool of sgRNAs, tiling across all possible target sites of a panel of six endogenous mouse and three endogenous human genes and quantitatively assessed their ability to produce null alleles of their target gene by antibody staining and flow cytometry. The authors showed that optimization of the PAM improved activity and also provided an on-line tool for designing sgRNAs.

A Swiech et al. demonstrate that AAV-mediated SpCas9 genome editing can enable reverse genetic studies of gene function in the brain.

Konermann et al. (2015) discusses the ability to attach multiple effector domains, e.g., transcriptional activator, functional and epigenomic regulators at appropriate positions on the guide such as stem or tetraloop with and without linkers.

A Zetsche et al. demonstrates that the Cas9 enzyme can be split into two and hence the assembly of Cas9 for activation can be controlled.

Chen et al. relates to multiplex screening by demonstrating that a genome-wide in vivo CRISPR-Cas9 screen in mice reveals genes regulating lung metastasis.

Ran et al. (2015) relates to SaCas9 and its ability to edit genomes and demonstrates that one cannot extrapolate from biochemical assays.

Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity.

Xu et al. (2015) assessed the DNA sequence features that contribute to single guide RNA (sgRNA) efficiency in CRISPR-based screens. The authors explored efficiency of CRISPR-Cas9 knockout and nucleotide preference at the cleavage site. The authors also found that the sequence preference for CRISPRi/a is substantially different from that for CRISPR-Cas9 knockout.

A Parnas et al. (2015) introduced genome-wide pooled CRISPR-Cas9 libraries into dendritic cells (DCs) to identify genes that control the induction of tumor necrosis factor (Tnf) by bacterial lipopolysaccharide (LPS). Known regulators of Tlr4 signaling and previously unknown candidates were identified and classified into three functional modules with distinct effects on the canonical responses to LPS.

Ramanan et al (2015) demonstrated cleavage of viral episomal DNA (cccDNA) in infected cells. The HBV genome exists in the nuclei of infected hepatocytes as a 3.2 kb double-stranded episomal DNA species called covalently closed circular DNA (cccDNA), which is a key component in the HBV life cycle whose replication is not inhibited by current therapies. The authors showed that sgRNAs specifically targeting highly conserved regions of HBV robustly suppresses viral replication and depleted cccDNA.

Nishimasu et al. (2015) reported the crystal structures of SaCas9 in complex with a single guide RNA (sgRNA) and its double-stranded DNA targets, containing the 5'-TTGAAT-3' PAM and the 5'-TTGGGT-3' PAM. A structural comparison of SaCas9 with SpCas9 highlighted both structural conservation and divergence, explaining their distinct PAM specificities and orthologous sgRNA recognition.

Canver et al. (2015) demonstrated a CRISPR-Cas9-based functional investigation of non-coding genomic elements. The authors we developed pooled CRISPR-Cas9 guide RNA libraries to perform in situ saturating mutagenesis of the human and mouse BCL11A enhancers which revealed critical features of the enhancers.

Zetsche et al. (2015) reported characterization of Cpf1, a class 2 CRISPR nuclease from *Francisella novicida* U112 having features distinct from Cas9. Cpf1 is a single RNA-guided endonuclease lacking tracrRNA, utilizes a T-rich protospacer-adjacent motif, and cleaves DNA via a staggered DNA double-stranded break.

A Shmakov et al. (2015) reported three distinct Class 2 CRISPR-Cas systems. Two system CRISPR enzymes (C2c1 and C2c3) contain RuvC-like endonuclease domains distantly related to Cpf1. Unlike Cpf1, C2c1 depends on both crRNA and tracrRNA for DNA cleavage. The third enzyme (C2c2) contains two predicted HEPN RNase domains and is tracrRNA independent.

Slaymaker et al (2016) reported the use of structure-guided protein engineering to improve the specificity of *Streptococcus pyogenes* Cas9 (SpCas9). The authors developed "enhanced specificity" SpCas9 (eSpCas9) variants which maintained robust on-target cleavage with reduced off-target effects.

Cox et al., (2017) reported the use of catalytically inactive Cas13 (dCas13) to direct adenosine-to-inosine deaminase activity by ADAR2 (adenosine deaminase acting on RNA type 2) to transcripts in mammalian cells. The system, referred to as RNA Editing for Programmable A to I Replacement (REPAIR), has no strict sequence constraints and can be used to edit full-length transcripts. The authors further engineered the system to create a high-specificity variant and minimized the system to facilitate viral delivery.

The methods and tools provided herein are may be designed for use with or Cas13, a type II nuclease that does not make use of tracrRNA. Orthologs of Cas13 have been identified in different bacterial species as described herein. Further type II nucleases with similar properties can be identified using methods described in the art (Shmakov et al. 2015, 60:385-397; Abudayeh et al. 2016, Science, 5; 353 (6299)). In particular embodiments, such methods for identifying novel CRISPR effector proteins may comprise the steps of selecting sequences from the database encoding a seed which identifies the presence of a CRISPR Cas locus, identifying loci located within 10 kb of the seed comprising Open Reading Frames (ORFs) in the selected sequences, selecting therefrom loci comprising ORFs of which only a single ORF encodes a novel CRISPR effector having greater than 700 amino acids and no more than 90% homology to a known CRISPR effector. In particular embodiments, the seed is a protein that is common to the CRISPR-Cas system, such as Cas1. In further embodiments, the CRISPR array is used as a seed to identify new effector proteins.

Also, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32 (6): 569-77 (2014), relates to dimeric RNA-guided FokI Nucleases that recognize extended sequences and can edit endogenous genes with high efficiencies in human cells.

Also, Harrington et al. "Programmed DNA destruction by miniature CRISPR-Cas14 enzymes" Science 2018 doi: 10/1126/science.aav4293, relates to Cas14.

With respect to general information on CRISPR/Cas Systems, components thereof, and delivery of such components, including methods, materials, delivery vehicles, vectors, particles, and making and using thereof, including as to amounts and formulations, as well as CRISPR-Cas-expressing eukaryotic cells, CRISPR-Cas expressing eukaryotes, such as a mouse, reference is made to: U.S. Pat. Nos. 8,999,641, 8,993,233, 8,697,359, 8,771,945, 8,795,965, 8,865,406, 8,871,445, 8,889,356, 8,889,418, 8,895,308, 8,906,616, 8,932,814, and 8,945,839; US Patent Publications US 2014-0310830 (U.S. application Ser. No. 14/105, 031), US 2014-0287938 A1 (U.S. application Ser. No. 14/213,991), US 2014-0273234 A1 (U.S. application Ser. No. 14/293,674), US2014-0273232 A1 (U.S. application Ser. No. 14/290,575), US 2014-0273231 (U.S. application Ser. No. 14/259,420), US 2014-0256046 A1 (U.S. application Ser. No. 14/226,274), US 2014-0248702 A1 (U.S. application Ser. No. 14/258,458), US 2014-0242700 A1 (U.S. application Ser. No. 14/222,930), US 2014-0242699 A1 (U.S. application Ser. No. 14/183,512), US 2014-0242664 A1 (U.S. application Ser. No. 14/104,990), US 2014-0234972 A1 (U.S. application Ser. No. 14/183,471), US 2014-0227787 A1 (U.S. application Ser. No. 14/256, 912), US 2014-0189896 A1 (U.S. application Ser. No. 14/105,035), US 2014-0186958 (U.S. application Ser. No. 14/105,017), US 2014-0186919 A1 (U.S. application Ser. No. 14/104,977), US 2014-0186843 A1 (U.S. application Ser. No. 14/104,900), US 2014-0179770 A1 (U.S. application Ser. No. 14/104,837) and US 2014-0179006 A1 (U.S. application Ser. No. 14/183,486), US 2014-0170753 (U.S. application Ser. No. 14/183,429); US 2015-0184139 (U.S. application Ser. No. 14/324,960); Ser. No. 14/054,414 European Patent Applications EP 2 771 468 (EP13818570.7), EP 2 764 103 (EP13824232.6), and EP 2 784 162 (EP14170383.5); and PCT Patent Publications WO2014/093661 (PCT/US2013/074743), WO2014/093694 (PCT/US2013/074790), WO2014/093595 (PCT/US2013/074611), WO2014/093718 (PCT/US2013/074825), WO2014/093709 (PCT/US2013/074812), WO2014/093622 (PCT/US2013/074667), WO2014/093635 (PCT/US2013/074691), WO2014/093655 (PCT/US2013/074736), WO2014/093712 (PCT/US2013/074819), WO2014/093701 (PCT/US2013/074800), WO2014/018423 (PCT/US2013/051418), WO2014/204723 (PCT/US2014/041790), WO2014/204724 (PCT/US2014/041800), WO2014/204725 (PCT/US2014/041803), WO2014/204726 (PCT/US2014/041804), WO2014/204727 (PCT/US2014/041806), WO2014/204728 (PCT/US2014/041808), WO2014/204729 (PCT/US2014/041809), WO2015/089351 (PCT/US2014/069897), WO2015/089354 (PCT/US2014/069902), WO2015/089364 (PCT/US2014/069925), WO2015/089427 (PCT/US2014/070068), WO2015/089462 (PCT/US2014/070127), WO2015/089419 (PCT/US2014/070057), WO2015/089465 (PCT/US2014/070135), WO2015/089486 (PCT/US2014/070175), WO2015/058052 (PCT/US2014/061077), WO2015/070083 (PCT/US2014/064663), WO2015/089354 (PCT/US2014/069902), WO2015/089351 (PCT/US2014/069897), WO2015/089364 (PCT/US2014/069925), WO2015/089427 (PCT/US2014/070068), WO2015/089473 (PCT/US2014/070152), WO2015/089486 (PCT/US2014/070175), WO2016/049258 (PCT/US2015/051830), WO2016/094867 (PCT/US2015/065385), WO2016/094872 (PCT/US2015/065393), WO2016/094874 (PCT/US2015/065396), WO2016/106244 (PCT/US2015/067177).

Mention is also made of U.S. application 62/180,709, 17-Jun.-2015, PROTECTED GUIDE RNAS (PGRNAS); U.S. application 62/091,455, filed, 12-Dec.-2014, PROTECTED GUIDE RNAS (PGRNAS); U.S. application 62/096,708, 24-Dec.-2014, PROTECTED GUIDE RNAS (PGRNAS); U.S. applications 62/091,462, 12-Dec.-2014, 62/096,324, 23-Dec.-2014, 62/180,681, 17 Jun. 2015, and 62/237,496, 5 Oct. 2015, DEAD GUIDES FOR CRISPR TRANSCRIPTION FACTORS; U.S. application 62/091, 456, 12-Dec.-2014 and 62/180,692, 17-Jun.-2015, ESCORTED AND FUNCTIONALIZED GUIDES FOR CRISPR-CAS SYSTEMS; U.S. application 62/091,461, 12-Dec.-2014, DELIVERY, USE AND THERAPEUTIC APPLICATIONS OF THE CRISPR-CAS SYSTEMS AND COMPOSITIONS FOR GENOME EDITING AS TO HEMATOPOETIC STEM CELLS (HSCs); U.S. application 62/094,903, 19-Dec.-2014, UNBIASED IDENTIFICATION OF DOUBLE-STRAND BREAKS AND GENOMIC REARRANGEMENT BY GENOME-WISE INSERT CAPTURE SEQUENCING; U.S. application 62/096,761, 24-Dec.-2014, ENGINEERING OF SYSTEMS, METHODS AND OPTIMIZED ENZYME AND GUIDE SCAFFOLDS FOR SEQUENCE MANIPULATION; U.S. application 62/098,059, 30-Dec.-2014, 62/181,641, 18 Jun. 2015, and 62/181,667, 18 Jun. 2015, RNA-TARGETING SYSTEM; U.S. application 62/096,656, 24-Dec.-2014 and 62/181,151, 17 Jun. 2015, CRISPR HAVING OR ASSOCIATED WITH DESTABILIZATION DOMAINS; U.S. application 62/096,697, 24-Dec.-2014, CRISPR HAVING OR ASSOCIATED WITH AAV; U.S. application 62/098,158, 30-Dec.-2014, ENGINEERED CRISPR COMPLEX INSERTIONAL TARGETING SYSTEMS; U.S. application 62/151,052, 22-Apr.-2015, CELLULAR TARGETING FOR EXTRACELLULAR EXOSOMAL REPORTING; U.S. application 62/054,490, 24-Sep.-14, DELIVERY, USE AND THERAPEUTIC APPLICATIONS OF THE CRISPR- CAS SYSTEMS AND COMPOSITIONS FOR TARGETING DISORDERS AND DISEASES USING PARTICLE DELIVERY COMPONENTS; US application 61/939,154, 12-F EB-14, SYSTEMS, METHODS AND COMPOSITIONS FOR SEQUENCE MANIPULATION WITH OPTIMIZED FUNCTIONAL CRISPR-CAS SYSTEMS; U.S. application 62/055,484, 25-Sep.-14, SYSTEMS, METHODS AND COMPOSITIONS FOR SEQUENCE MANIPULATION WITH OPTIMIZED FUNCTIONAL CRISPR-CAS SYSTEMS; U.S. application 62/087,537, 4-Dec.-2014, SYSTEMS, METHODS AND COMPOSITIONS FOR SEQUENCE MANIPULATION WITH OPTIMIZED FUNCTIONAL CRISPR-CAS SYSTEMS; U.S. application 62/054,651, 24-Sep.-14, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/067,886, 23-Oct.-2014, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. applications 62/054,675, 24-Sep.-14 and 62/181,002, 17 Jun. 2015, DELIVERY, USE AND THERAPEUTIC APPLICATIONS OF THE CRISPR-CAS SYSTEMS AND COMPOSITIONS IN NEURONAL CELLS/TISSUES; U.S. application 62/054,528, 24-Sep.-14, DELIVERY, USE AND THERAPEUTIC APPLICATIONS OF THE CRISPR-CAS SYSTEMS AND COMPOSITIONS IN IMMUNE DISEASES OR DISORDERS; U.S. application 62/055,454, 25-Sep.-14, DELIVERY, USE AND THERAPEUTIC APPLICATIONS OF THE CRISPR-CAS SYSTEMS AND COMPOSITIONS FOR TARGETING DISORDERS AND DISEASES USING CELL PENETRATION PEPTIDES (CPP); U.S. application 62/055,460, 25-Sep.-14, MULTIFUNCTIONAL-CRISPR COMPLEXES AND/OR OPTIMIZED ENZYME LINKED FUNCTIONAL-CRISPR COMPLEXES; U.S. application 62/087,475, 4-Dec.-2014 and 62/181,690, 18 Jun. 2015, FUNCTIONAL SCREENING WITH OPTIMIZED FUNCTIONAL CRISPR-CAS SYSTEMS; U.S. application 62/055,487, 25-Sep.-14, FUNCTIONAL SCREENING WITH OPTIMIZED FUNCTIONAL CRISPR-CAS SYSTEMS; U.S. application 62/087,546, 4-Dec.-14 and 62/181,687, 18 Jun. 2015, MULTIFUNCTIONAL CRISPR COMPLEXES AND/OR OPTIMIZED ENZYME LINKED FUNCTIONAL-CRISPR COMPLEXES; and U.S. application 62/098,285, 30-Dec.-2014, CRISPR MEDIATED IN VIVO MODELING AND GENETIC SCREENING OF TUMOR GROWTH AND METASTASIS.

Mention is made of U.S. applications 62/181,659, 18 Jun. 2015 and 62/207,318, 19-Aug.-2015, ENGINEERING AND OPTIMIZATION OF SYSTEMS, METHODS, ENZYME AND GUIDE SCAFFOLDS OF CAS9 ORTHOLOGS AND VARIANTS FOR SEQUENCE MANIPULATION. Mention is made of U.S. applications 62/181,663, 18 Jun. 2015 and 62/245,264, 22 Oct. 2015, NOVEL CRISPR ENZYMES AND SYSTEMS, U.S. applications 62/181,675, 18 Jun. 2015, 62/285,349, 22 Oct. 2015, 62/296,522, 17 Feb. 2016, and 62/320,231, 8 Apr. 2016, NOVEL CRISPR ENZYMES AND SYSTEMS, U.S. application 62/232,067, 24 Sep. 2015, U.S. application Ser. No. 14/975,085, 18 Dec. 2015, European application No. 16150428.7, U.S. application 62/205,733, 16 Aug. 2015, U.S. application 62/201,542, 5-Aug.-2015, U.S. application 62/193,507, 16 Jul. 2015, and U.S. application 62/181,739, 18 Jun. 2015, each entitled NOVEL CRISPR ENZYMES AND SYSTEMS and of U.S. application 62/245,270, 22 Oct. 2015, NOVEL CRISPR ENZYMES AND SYSTEMS. Mention is also made of U.S. application 61/939,256, 12 Feb. 2014, and WO 2015/089473 (PCT/US2014/070152), 12 Dec. 2014, each entitled ENGINEERING OF SYSTEMS, METHODS AND OPTIMIZED GUIDE COMPOSITIONS WITH NEW ARCHITECTURES FOR SEQUENCE MANIPULATION. Mention is also made of PCT/US2015/045504, 15-Aug.-2015, U.S. application 62/180,699, 17 Jun. 2015, and U.S. application 62/038,358, 17 Aug. 2014, each entitled GENOME EDITING USING CAS9 NICKASES.

Each of these patents, patent publications, and applications, and all documents cited therein or during their prosecution ("appln cited documents") and all documents cited or referenced in the appln cited documents, together with any instructions, descriptions, product specifications, and product sheets for any products mentioned therein or in any document therein and incorporated by reference herein, are hereby incorporated herein by reference, and may be employed in the practice of the invention. All documents (e.g., these patents, patent publications and applications and the appln cited documents) are incorporated herein by reference to the same extent as if each individual document was specifically and individually indicated to be incorporated by reference.

In particular embodiments, pre-complexed guide RNA and CRISPR effector protein, (optionally, adenosine deaminase fused to a CRISPR protein or an adaptor) are delivered as a ribonucleoprotein (RNP). RNPs have the advantage that they lead to rapid editing effects even more so than the RNA method because this process avoids the need for transcription. An important advantage is that both RNP delivery is transient, reducing off-target effects and toxicity issues. Efficient genome editing in different cell types has been observed by Kim et al. (2014, Genome Res. 24 (6): 1012-9), Paix et al. (2015, Genetics 204 (1): 47-54), Chu et al. (2016, BMC Biotechnol. 16:4), and Wang et al. (2013, Cell. 9; 153 (4): 910-8).

In particular embodiments, the ribonucleoprotein is delivered by way of a polypeptide-based shuttle agent as described in WO2016161516. WO2016161516 describes efficient transduction of polypeptide cargos using synthetic peptides comprising an endosome leakage domain (ELD) operably linked to a cell penetrating domain (CPD), to a histidine-rich domain and a CPD. Similarly these polypeptides can be used for the delivery of CRISPR-effector based RNPs in eukaryotic cells.

Tale Systems

As disclosed herein editing can be made by way of the transcription activator-like effector nucleases (TALENs) system. Transcription activator-like effectors (TALEs) can be engineered to bind practically any desired DNA sequence. Exemplary methods of genome editing using the TALEN system can be found for example in Cermak T. Doyle E L. Christian M. Wang L. Zhang Y. Schmidt C, et al. Efficient design and assembly of custom TALEN and other TAL effector-based constructs for DNA targeting. Nucleic Acids Res. 2011; 39: e82; Zhang F. Cong L. Lodato S. Kosuri S. Church G M. Arlotta P Efficient construction of sequence-specific TAL effectors for modulating mammalian transcription. Nat Biotechnol. 2011; 29:149-153 and U.S. Pat. Nos. 8,450,471, 8,440,431 and 8,440,432, all of which are specifically incorporated by reference.

In advantageous embodiments of the invention, the methods provided herein use isolated, non-naturally occurring, recombinant or engineered DNA binding proteins that comprise TALE monomers as a part of their organizational structure that enable the targeting of nucleic acid sequences with improved efficiency and expanded specificity.

Naturally occurring TALEs or "wild type TALEs" are nucleic acid binding proteins secreted by numerous species of proteobacteria. TALE polypeptides contain a nucleic acid binding domain composed of tandem repeats of highly conserved monomer polypeptides that are predominantly 33, 34 or 35 amino acids in length and that differ from each other mainly in amino acid positions 12 and 13. In advantageous embodiments the nucleic acid is DNA. As used herein, the term "polypeptide monomers", or "TALE monomers" will be used to refer to the highly conserved repetitive polypeptide sequences within the TALE nucleic acid binding domain and the term "repeat variable di-residues" or "RVD" will be used to refer to the highly variable amino acids at positions 12 and 13 of the polypeptide monomers. As provided throughout the disclosure, the amino acid residues of the RVD are depicted using the IUPAC single letter code for amino acids. A general representation of a TALE monomer which is comprised within the DNA binding domain is X1-11-(X12X13)-X14-33 or 34 or 35, where the subscript indicates the amino acid position and X represents any amino acid. X12X13 indicate the RVDs. In some polypeptide monomers, the variable amino acid at position 13 is missing or absent and in such polypeptide monomers, the RVD consists of a single amino acid. In such cases the RVD may be alternatively represented as X*, where X represents X12 and (*) indicates that X13 is absent. The DNA binding domain comprises several repeats of TALE monomers and this may be represented as (X1-11-(X12X13)-X14-33 or 34 or 35) z, where in an advantageous embodiment, z is at least 5 to 40. In a further advantageous embodiment, z is at least 10 to 26.

The TALE monomers have a nucleotide binding affinity that is determined by the identity of the amino acids in its RVD. For example, polypeptide monomers with an RVD of NI preferentially bind to adenine (A), polypeptide monomers with an RVD of NG preferentially bind to thymine (T), polypeptide monomers with an RVD of HD preferentially bind to cytosine (C) and polypeptide monomers with an RVD of NN preferentially bind to both adenine (A) and guanine (G). In yet another embodiment of the invention, polypeptide monomers with an RVD of IG preferentially bind to T. Thus, the number and order of the polypeptide monomer repeats in the nucleic acid binding domain of a TALE determines its nucleic acid target specificity. In still further embodiments of the invention, polypeptide monomers with an RVD of NS recognize all four base pairs and may bind to A, T, G or C. The structure and function of TALEs is further described in, for example, Moscou et al., Science 326:1501 (2009); Boch et al., Science 326:1509-1512 (2009); and Zhang et al., Nature Biotechnology 29:149-153 (2011), each of which is incorporated by reference in its entirety.

The TALE polypeptides used in methods of the invention are isolated, non-naturally occurring, recombinant or engineered nucleic acid-binding proteins that have nucleic acid or DNA binding regions containing polypeptide monomer repeats that are designed to target specific nucleic acid sequences.

As described herein, polypeptide monomers having an RVD of HN or NH preferentially bind to guanine and thereby allow the generation of TALE polypeptides with high binding specificity for guanine containing target nucleic acid sequences. In a preferred embodiment of the invention, polypeptide monomers having RVDs RN, NN, NK, SN, NH, KN, HN, NQ, HH, RG, KH, RH and SS preferentially bind to guanine. In a much more advantageous embodiment of the invention, polypeptide monomers having RVDs RN, NK, NQ, HH, KH, RH, SS and SN preferentially bind to guanine and thereby allow the generation of TALE polypeptides with high binding specificity for guanine containing target nucleic acid sequences. In an even more advantageous embodiment of the invention, polypeptide monomers having RVDs HH, KH, NH, NK, NQ, RH, RN and SS preferentially bind to guanine and thereby allow the generation of TALE polypeptides with high binding specificity for guanine containing target nucleic acid sequences. In a further advantageous embodiment, the RVDs that have high binding specificity for guanine are RN, NH RH and KH. Furthermore, polypeptide monomers having an RVD of NV preferentially bind to adenine and guanine. In more preferred embodiments of the invention, polypeptide monomers having RVDs of H*, HA, KA, N*, NA, NC, NS, RA, and S* bind to adenine, guanine, cytosine and thymine with comparable affinity.

The predetermined N-terminal to C-terminal order of the one or more polypeptide monomers of the nucleic acid or DNA binding domain determines the corresponding predetermined target nucleic acid sequence to which the TALE polypeptides will bind. As used herein the polypeptide monomers and at least one or more half polypeptide monomers are "specifically ordered to target" the genomic locus or gene of interest. In plant genomes, the natural TALE-binding sites always begin with a thymine (T), which may be specified by a cryptic signal within the non-repetitive N-terminus of the TALE polypeptide; in some cases this region may be referred to as repeat 0. In animal genomes, TALE binding sites do not necessarily have to begin with a thymine (T) and TALE polypeptides may target DNA sequences that begin with T, A, G or C. The tandem repeat of TALE monomers always ends with a half-length repeat or a stretch of sequence that may share identity with only the first 20 amino acids of a repetitive full length TALE monomer and this half repeat may be referred to as a half-monomer (FIG. 8), which is included in the term "TALE monomer". Therefore, it follows that the length of the nucleic acid or DNA being targeted is equal to the number of full polypeptide monomers plus two.

As described in Zhang et al., Nature Biotechnology 29:149-153 (2011), TALE polypeptide binding efficiency may be increased by including amino acid sequences from the "capping regions" that are directly N-terminal or C-terminal of the DNA binding region of naturally occurring TALEs into the engineered TALEs at positions N-terminal or C-terminal of the engineered TALE DNA binding region. Thus, in certain embodiments, the TALE polypeptides described herein further comprise an N-terminal capping region and/or a C-terminal capping region.

As used herein the predetermined "N-terminus" to "C terminus" orientation of the N-terminal capping region, the DNA binding domain comprising the repeat TALE monomers and the C-terminal capping region provide structural basis for the organization of different domains in the d-TALEs or polypeptides of the invention.

The entire N-terminal and/or C-terminal capping regions are not necessary to enhance the binding activity of the DNA binding region. Therefore, in certain embodiments, fragments of the N-terminal and/or C-terminal capping regions are included in the TALE polypeptides described herein.

In certain embodiments, the TALE polypeptides described herein contain a N-terminal capping region fragment that included at least 10, 20, 30, 40, 50, 54, 60, 70, 80, 87, 90, 94, 100, 102, 110, 117, 120, 130, 140, 147, 150, 160, 170, 180, 190, 200, 210, 220, 230, 240, 250, 260 or 270 amino acids of an N-terminal capping region. In certain embodiments, the N-terminal capping region fragment amino acids are of the C-terminus (the DNA-binding region proximal end) of an N-terminal capping region. As described in Zhang et al., Nature Biotechnology 29:149-153 (2011), N-terminal capping region fragments that include the C-terminal 240 amino acids enhance binding activity equal to the full length capping region, while fragments that include the C-terminal 147 amino acids retain greater than 80% of the efficacy of the full length capping region, and fragments that include the C-terminal 117 amino acids retain greater than 50% of the activity of the full-length capping region.

In some embodiments, the TALE polypeptides described herein contain a C-terminal capping region fragment that included at least 6, 10, 20, 30, 37, 40, 50, 60, 68, 70, 80, 90, 100, 110, 120, 127, 130, 140, 150, 155, 160, 170, 180 amino acids of a C-terminal capping region. In certain embodiments, the C-terminal capping region fragment amino acids are of the N-terminus (the DNA-binding region proximal end) of a C-terminal capping region. As described in Zhang et al., Nature Biotechnology 29:149-153 (2011), C-terminal capping region fragments that include the C-terminal 68 amino acids enhance binding activity equal to the full length capping region, while fragments that include the C-terminal 20 amino acids retain greater than 50% of the efficacy of the full length capping region.

In certain embodiments, the capping regions of the TALE polypeptides described herein do not need to have identical sequences to the capping region sequences provided herein. Thus, in some embodiments, the capping region of the TALE polypeptides described herein have sequences that are at least 50%, 60%, 70%, 80%, 85%, 90%, 91%, 92%, 93%, 94%, 95%, 96%, 97%, 98% or 99% identical or share identity to the capping region amino acid sequences provided herein. Sequence identity is related to sequence homology. Homology comparisons may be conducted by eye, or more usually, with the aid of readily available sequence comparison programs. These commercially available computer programs may calculate percent (%) homology between two or more sequences and may also calculate the sequence identity shared by two or more amino acid or nucleic acid sequences. In some preferred embodiments, the capping region of the TALE polypeptides described herein have sequences that are at least 95% identical or share identity to the capping region amino acid sequences provided herein.

Sequence homologies may be generated by any of a number of computer programs known in the art, which include but are not limited to BLAST or FASTA. Suitable computer program for carrying out alignments like the GCG Wisconsin Bestfit package may also be used. Once the software has produced an optimal alignment, it is possible to calculate % homology, preferably % sequence identity. The software typically does this as part of the sequence comparison and generates a numerical result.

In advantageous embodiments described herein, the TALE polypeptides of the invention include a nucleic acid binding domain linked to the one or more effector domains. The terms "effector domain" or "regulatory and functional domain" refer to a polypeptide sequence that has an activity other than binding to the nucleic acid sequence recognized by the nucleic acid binding domain. By combining a nucleic acid binding domain with one or more effector domains, the polypeptides of the invention may be used to target the one or more functions or activities mediated by the effector domain to a particular target DNA sequence to which the nucleic acid binding domain specifically binds.

In some embodiments of the TALE polypeptides described herein, the activity mediated by the effector domain is a biological activity. For example, in some embodiments the effector domain is a transcriptional inhibitor (i.e., a repressor domain), such as an mSin interaction domain (SID). SID4X domain or a Krüppel-associated box (KRAB) or fragments of the KRAB domain. In some embodiments the effector domain is an enhancer of transcription (i.e. an activation domain), such as the VP16, VP64 or p65 activation domain. In some embodiments, the nucleic acid binding is linked, for example, with an effector domain that includes but is not limited to a transposase, integrase, recombinase, resolvase, invertase, protease, DNA methyltransferase, DNA demethylase, histone acetylase, histone deacetylase, nuclease, transcriptional repressor, transcriptional activator, transcription factor recruiting, protein nuclear-localization signal or cellular uptake signal.

In some embodiments, the effector domain is a protein domain which exhibits activities which include but are not limited to transposase activity, integrase activity, recombinase activity, resolvase activity, invertase activity, protease activity, DNA methyltransferase activity, DNA demethylase activity, histone acetylase activity, histone deacetylase activity, nuclease activity, nuclear-localization signaling activity, transcriptional repressor activity, transcriptional activator activity, transcription factor recruiting activity, or cellular uptake signaling activity. Other preferred embodiments of the invention may include any combination the activities described herein.

ZN-Finger Nucleases

Other preferred tools for genome editing for use in the context of this invention include zinc finger systems. One type of programmable DNA-binding domain is provided by artificial zinc-finger (ZF) technology, which involves arrays of ZF modules to target new DNA-binding sites in the genome. Each finger module in a ZF array targets three DNA bases. A customized array of individual zinc finger domains is assembled into a ZF protein (ZFP).

ZFPs can comprise a functional domain. The first synthetic zinc finger nucleases (ZFNs) were developed by fusing a ZF protein to the catalytic domain of the Type IIS restriction enzyme FokI. (Kim, Y. G. et al., 1994, Chimeric restriction endonuclease, Proc. Natl. Acad. Sci. U.S.A. 91, 883-887; Kim, Y. G. et al., 1996, Hybrid restriction enzymes: zinc finger fusions to Fok I cleavage domain. Proc. Natl. Acad. Sci. U.S.A. 93, 1156-1160). Increased cleavage specificity can be attained with decreased off target activity by use of paired ZFN heterodimers, each targeting different nucleotide sequences separated by a short spacer. (Doyon, Y. et al., 2011, Enhancing zinc-finger-nuclease activity with improved obligate heterodimeric architectures. Nat. Methods 8, 74-79). ZFPs can also be designed as transcription activators and repressors and have been used to target many genes in a wide variety of organisms. Exemplary methods of genome editing using ZFNs can be found for example in U.S. Pat. Nos. 6,534,261, 6,607,882, 6,746,838, 6,794,136, 6,824,978, 6,866,997, 6,933,113, 6,979,539, 7,013,219, 7,030,215, 7,220,719, 7,241,573, 7,241,574, 7,585,849, 7,595,376, 6,903,185, and 6,479,626, all of which are specifically incorporated by reference.

Meganucleases

As disclosed herein editing can be made by way of meganucleases, which are endodeoxyribonucleases characterized by a large recognition site (double-stranded DNA sequences of 12 to 40 base pairs). Exemplary method for using meganucleases can be found in U.S. Pat. Nos. 8,163, 514; 8,133,697; 8,021,867; 8,119,361; 8,119,381; 8,124, 369; and 8,129,134, which are specifically incorporated by reference.

The invention is further described in the following examples, which do not limit the scope of the invention described in the claims.

EXAMPLES

Example 1—Sequencing-Based Proteomics (SBP)

At present, studying cellular signaling pathways at the systems level broadly relies on high-throughput gene transcription measurements by RNA sequencing. However, despite the fact that most cellular signaling pathways store and process information at the protein level by modulating protein abundance, localization, or post-translational modifications, currently no method exists for monitoring these important parameters in living cells at a proteome-wide scale.

A high-throughput method for studying proteomics was developed, based on CRISPR/Cas9 and DNA sequencing. This technology employs a genome-wide CRISPR/Cas9 gRNA library for integrating sequences encoding fluorescent tags into endogenous protein-coding genes. Quantification and localization of proteins at high-throughput is based on tagging protein-coding genes with a marker gene at high-throughput using Cas9 and non-homologous end joining (NHEJ) (FIGS. 1-4, see, also Schmid-Burgk J L, et al., CRISPaint allows modular base-specific gene tagging using a ligase-4-dependent mechanism. Nat Commun. 2016 Jul. 28; 7:12338. doi: 10.1038/ncomms12338). The universal donor system utilizes guide sequences to target CRISPR/Cas9 to a genomic locus encoding a gene to be tagged. A universal donor construct is targeted for cleavage by a guide sequence capable of selecting the frame of the donor sequence. In this way, the donor sequence can be used for any target gene requiring insertion in a different frame. Upon expression of the donor system in a cell the genomic locus is repaired using the cleaved universal donor construct, frequently resulting in an in-frame insertion of a tag gene (e.g., detectable marker) at the C-terminus of a target gene. Due to stochastic delivery of the target-specific guide sequences, most cells will have only one random gene tagged, but every gene will be covered by many independent single cells. As shown in FIG. 4, integration fidelity is high as the reading frame of mNeonGreen fusions of three tagged genes, ACTG1, HIST1H4C and TUBB, is correct in the majority of cells, as denoted by the green pieces of the pie charts, as measured by deep sequencing.

Figure 1:
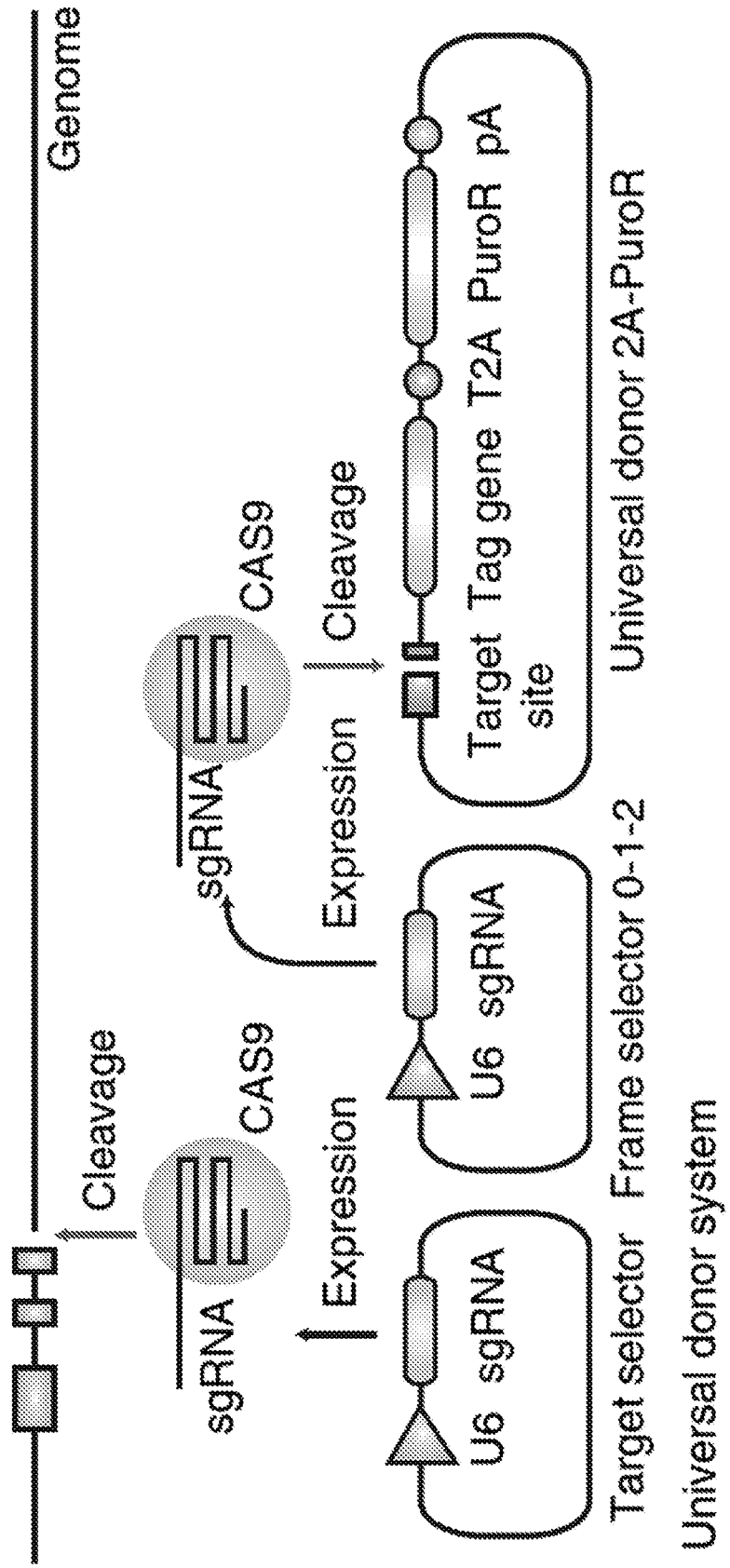
FIG. 1—Shows a schematic of non-homologous end joining (NHEJ)-based gene tagging of a target gene at its genomic locus with a donor sequence using a CRISPR system.
Figure 2:
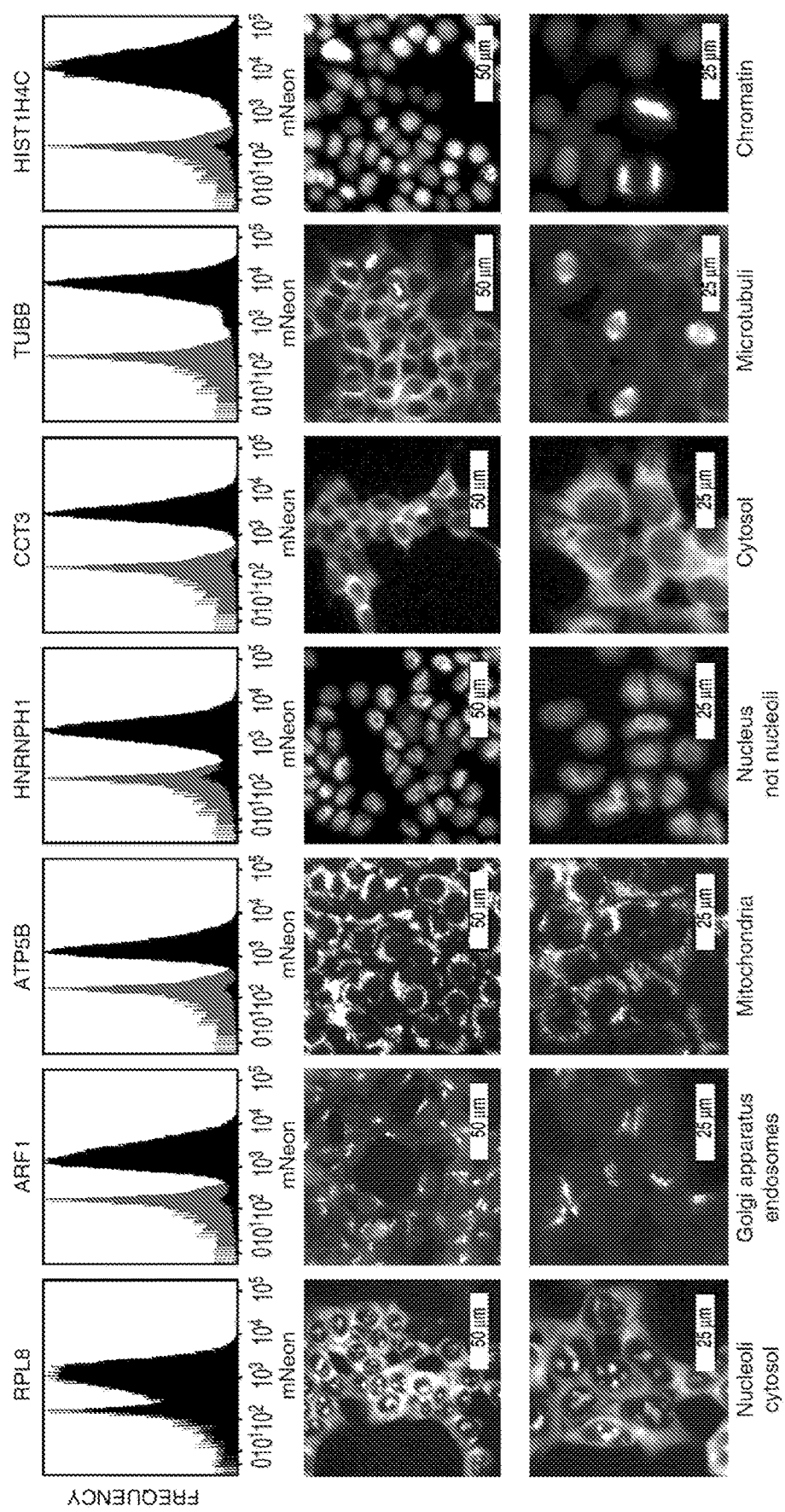
FIG. 2—Shows NHEJ-based gene tagging of genes representative of proteins localized to different cellular compartments and organelles with mNeon.
Figure 3:
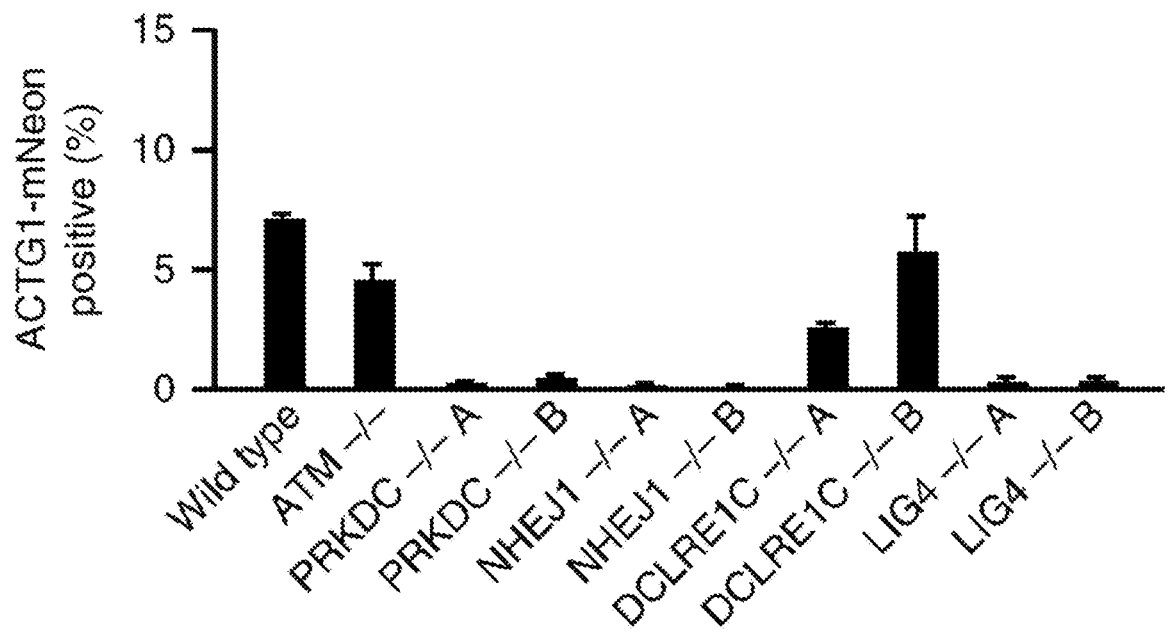
FIG. 3—Shows that tagging of genes is efficient and dependent on ligase IV. Image quantification of ACTG1-mNeon-positive cells. Shown are mean values+s.e.m. from three independent biological replicates.
Figure 5:
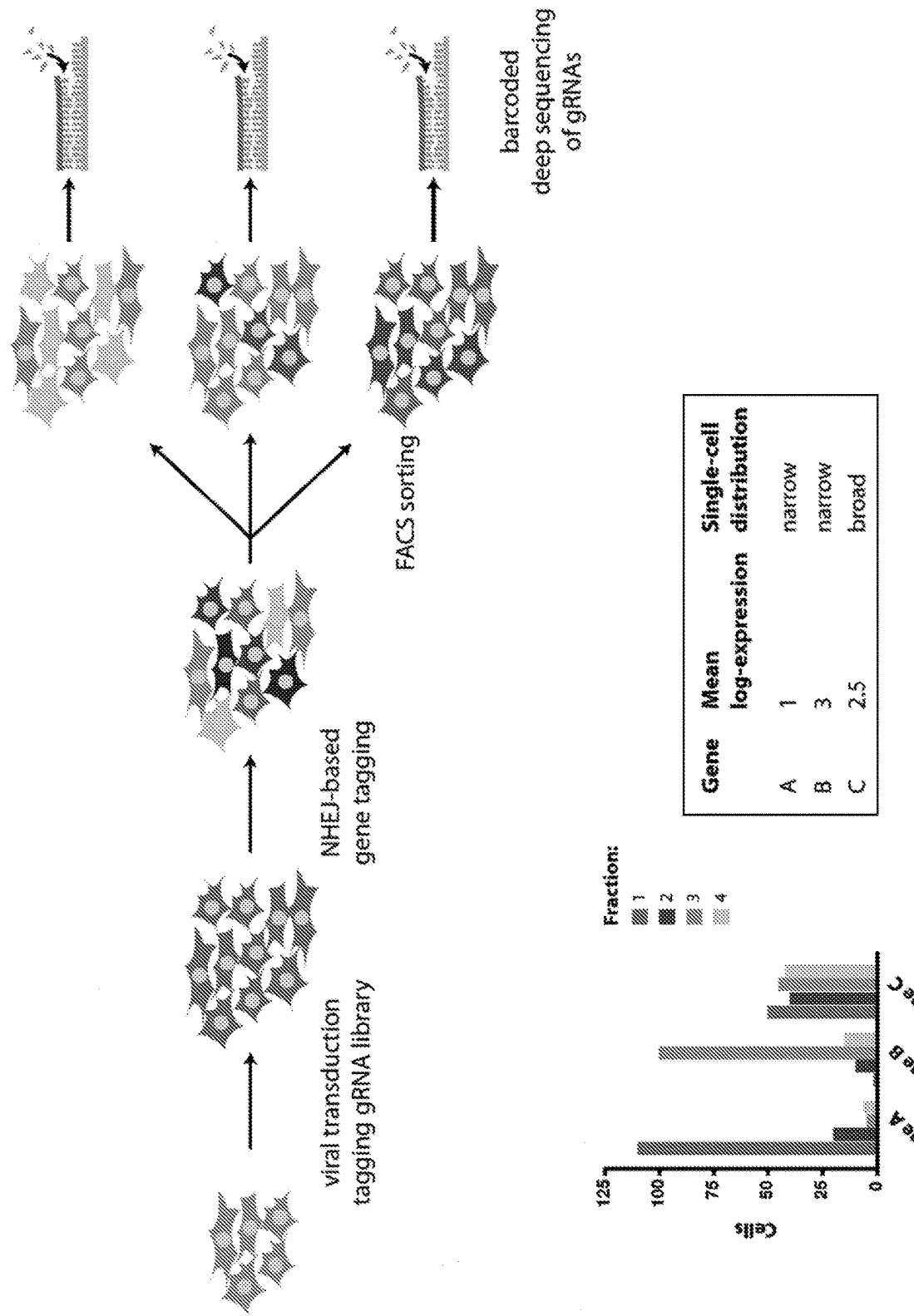
FIG. 5—Shows a schematic of sequencing-based proteomics, demonstrating the expression levels of genes A-C.

A summary of the method for sequencing-based proteomics comprising tagging and measuring gene expression is described (FIG. 5). As shown in FIG. 5, viral transduction of a population of cells is used to introduce a library of guide sequences targeting protein-coding genes A-C and the CRISPR-Cas9 system containing the universal donor system for tagging genes. The genes are tagged by NHEJ. After establishing and validating a library of cells with randomly tagged genes, the cells can be FACS-sorted into populations of distinct levels of fluorescent tag expression. The tags were fused with the endogenous proteins; therefore, the expression of the proteins should be highly correlated with the expression of the tagged proteins. Cells can then be sorted based on expression of the detectable marker and thus expression of genes A-C fused to the detectable marker. Biochemical methods like immunoblotting were used to verify the expression levels of the proteins. Each sorted population of cells was subsequently analyzed by deep sequencing of the guide sequences that were present in each cell. As these guide sequences contain information relating to which genes were tagged, sequencing enabled assignment of individual tagged genes to sorted expression levels. The sorted groups are sequenced to determine the guide sequences present in each group and thus determining the tagged genes in each group. In this example the cells are sorted into 4 groups. In certain embodiments, the cells may be sorted into 2, 3, 4, 5, 6, 7, 8, 9, 10, 11, 12, 13, 14, 15, 16 or more than 16 groups. Not being bound by a theory measurement of gene expression is more sensitive when cells are sorted into more groups. Cells in which gene A is tagged are present predominantly in population 1, thus gene A has low expression levels in the population of cells. Cells in which gene B was tagged predominantly reside in population 3 and thus gene B has higher expression than gene A. Cells in which gene C is tagged were present in all groups, thus the expression level of gene C is variable in the population. In certain embodiments, the population of cells can be used to compare treated and untreated cells to measure changes in gene expression.

Figure 6:
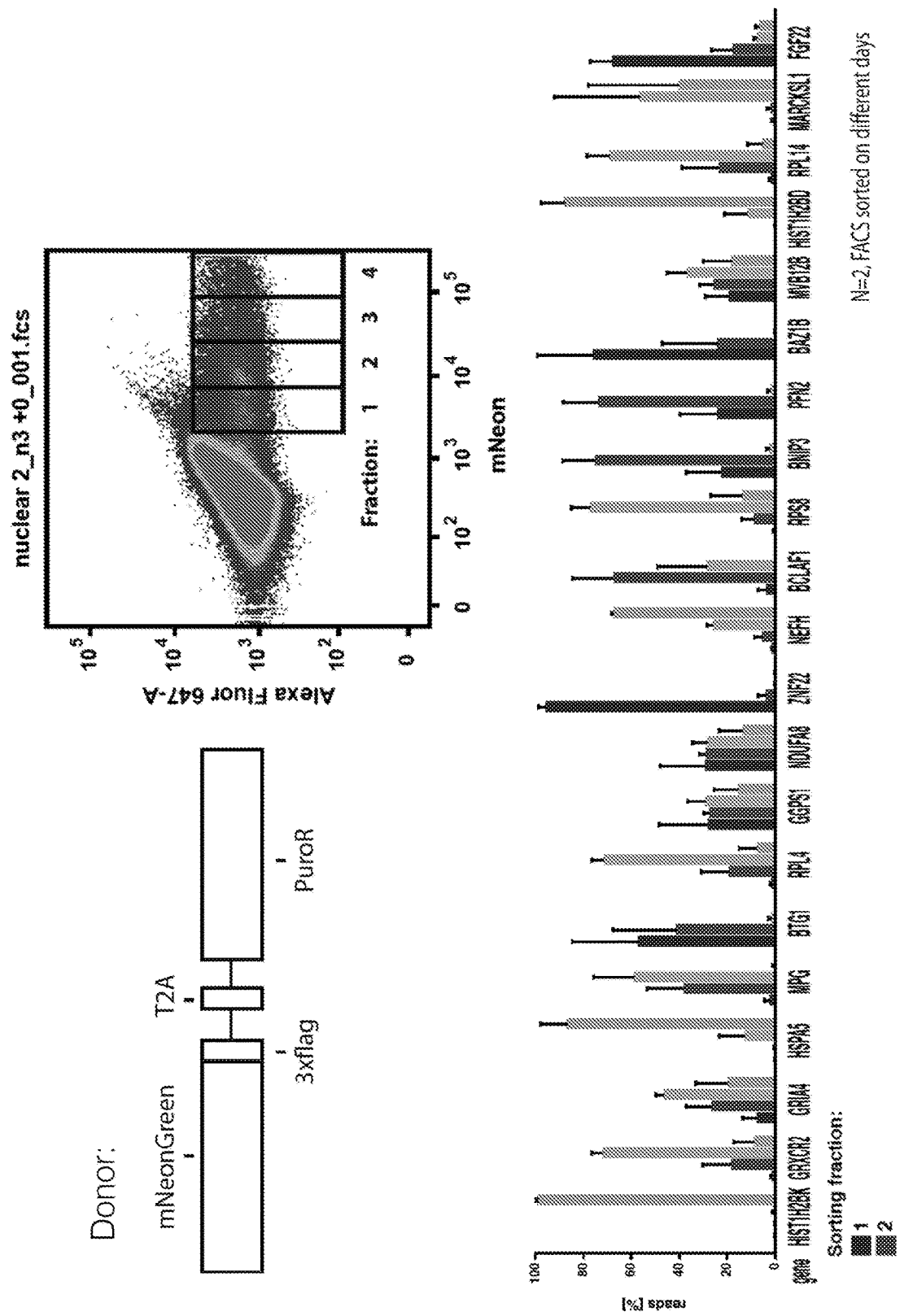
FIG. 6—Shows results of barcoded deep sequencing of the gRNAs when expressed proteins were FACS-sorted into 4 bins of expression levels. mNeonGreen was used as the marker on a tagging construct introduced into human cells.

As shown in FIG. 6, Applicants tagged and determined differential expression of a panel of genes using the methods described herein. Flow cytometry (i.e., FACS) was done to separate the cells into bins based on gene expression levels. Barcoded deep sequencing of the guide sequences was then performed to evaluate the abundance of each protein. mNeonGreen was used as the marker on the donor construct introduced into human cells (FIG. 6). The donor construct also included an epitope tag (3×flag) and a selectable marker (puromycin resistance gene) linked by a ribosomal stuttering site (T2A).

Example 2—Tagging Optimization

Figure 7:
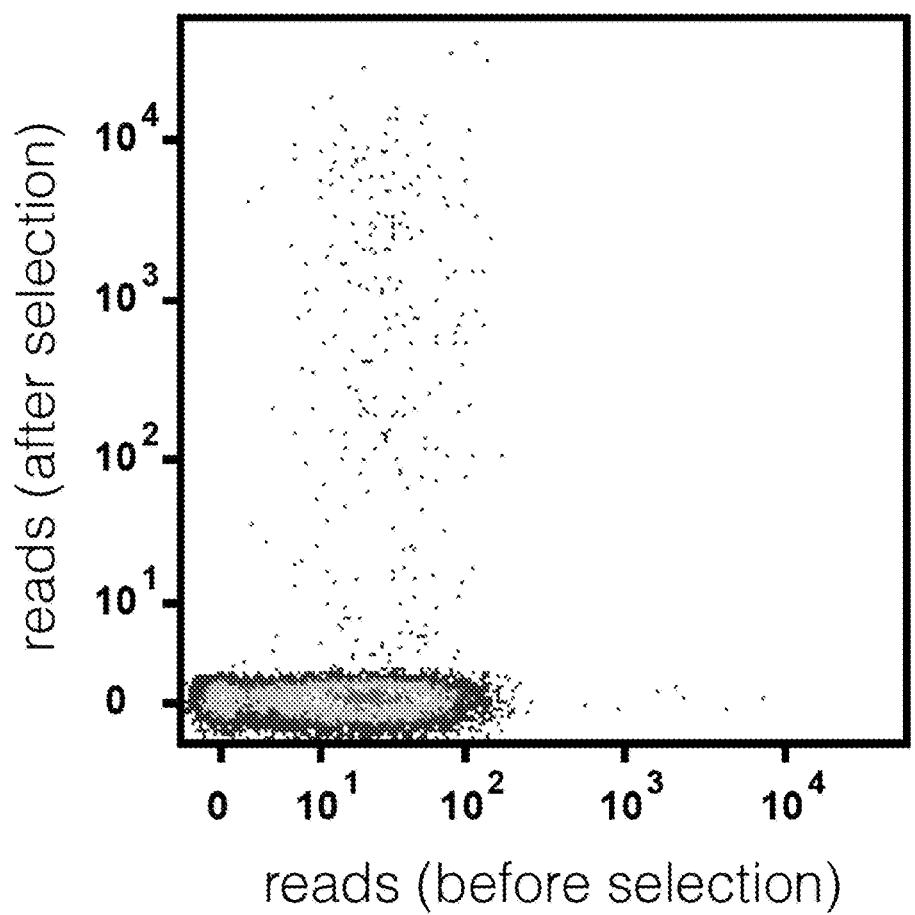
FIG. 7—Shows representation of tagged target gene library before and after selecting for selectable marker.
Figure 8:
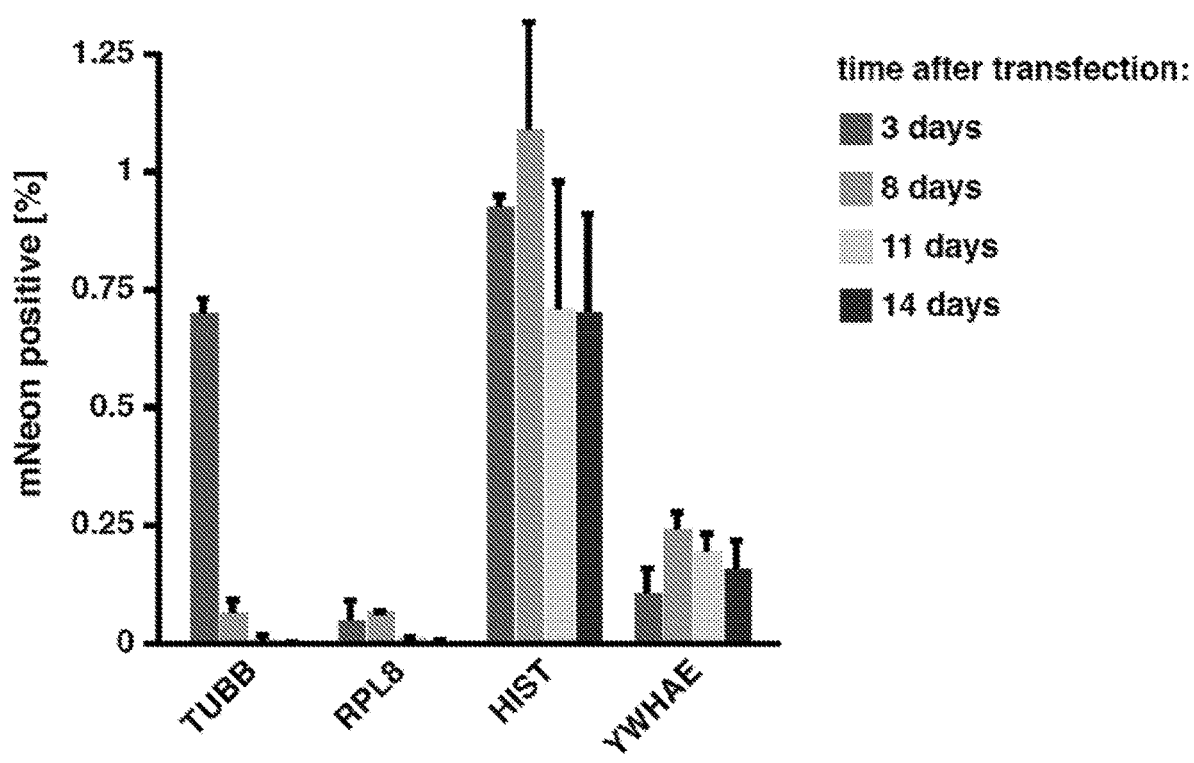
FIG. 8—Shows expression of mNeon tagged proteins over time after tagging.
Figure 9:
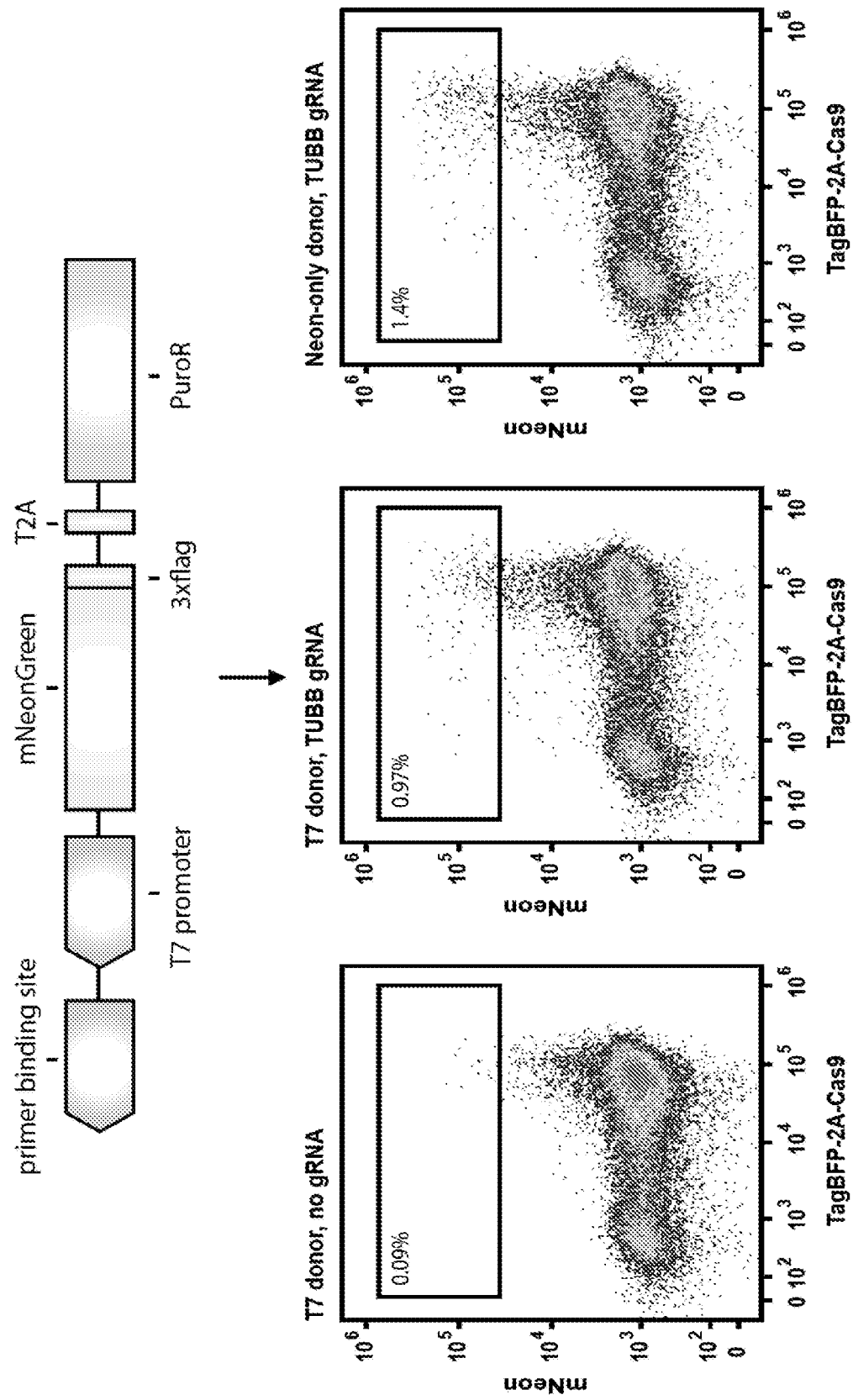
FIG. 9—Shows results testing the efficiency of tagging with a donor construct performed for no gRNA, as well as a gRNA targeting the TUBB gene with and without a T7 promoter.
Figure 10:
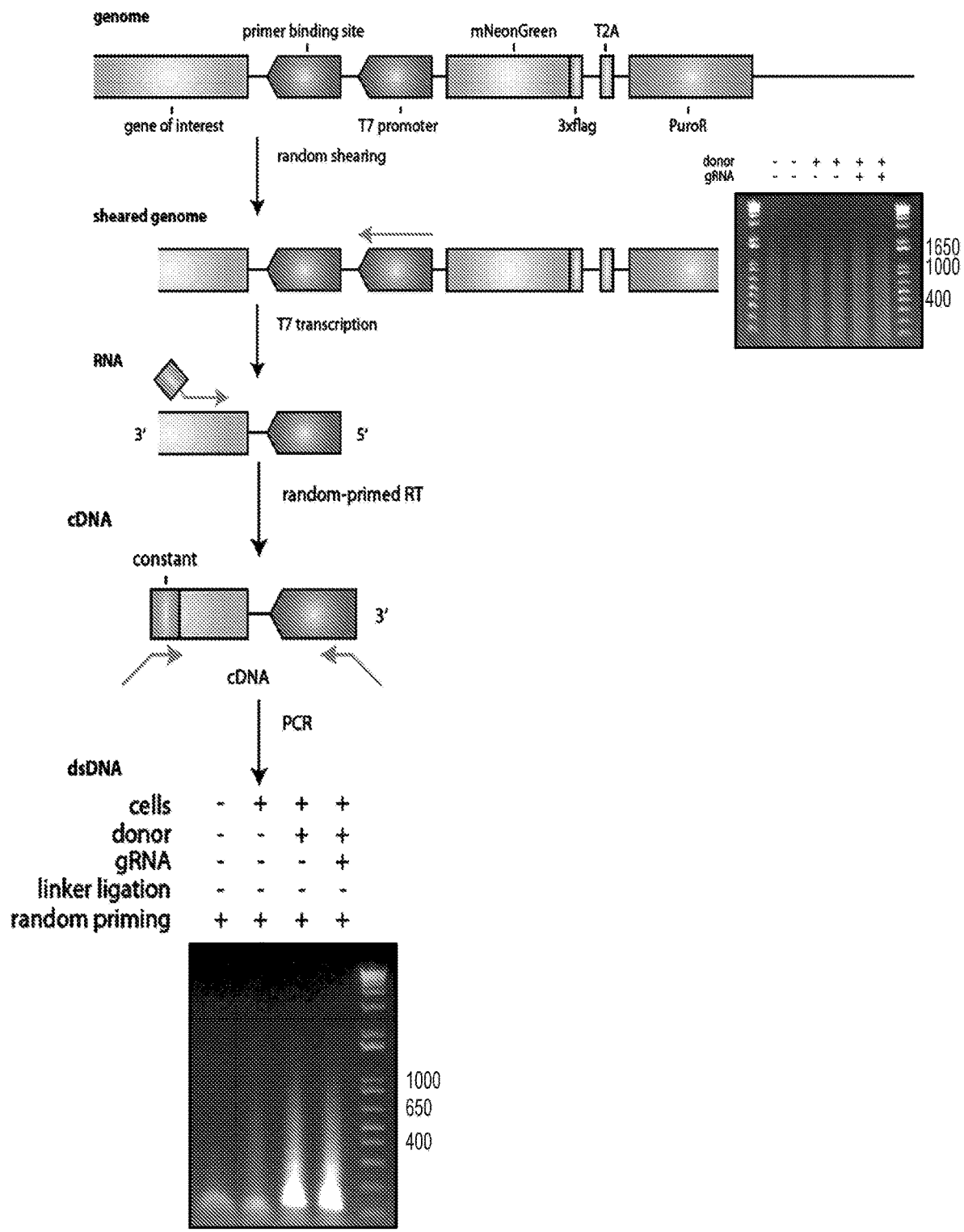
FIG. 10—Shows a step-by-step schematic demonstrating a method of integration site sequencing.
Figure 11:
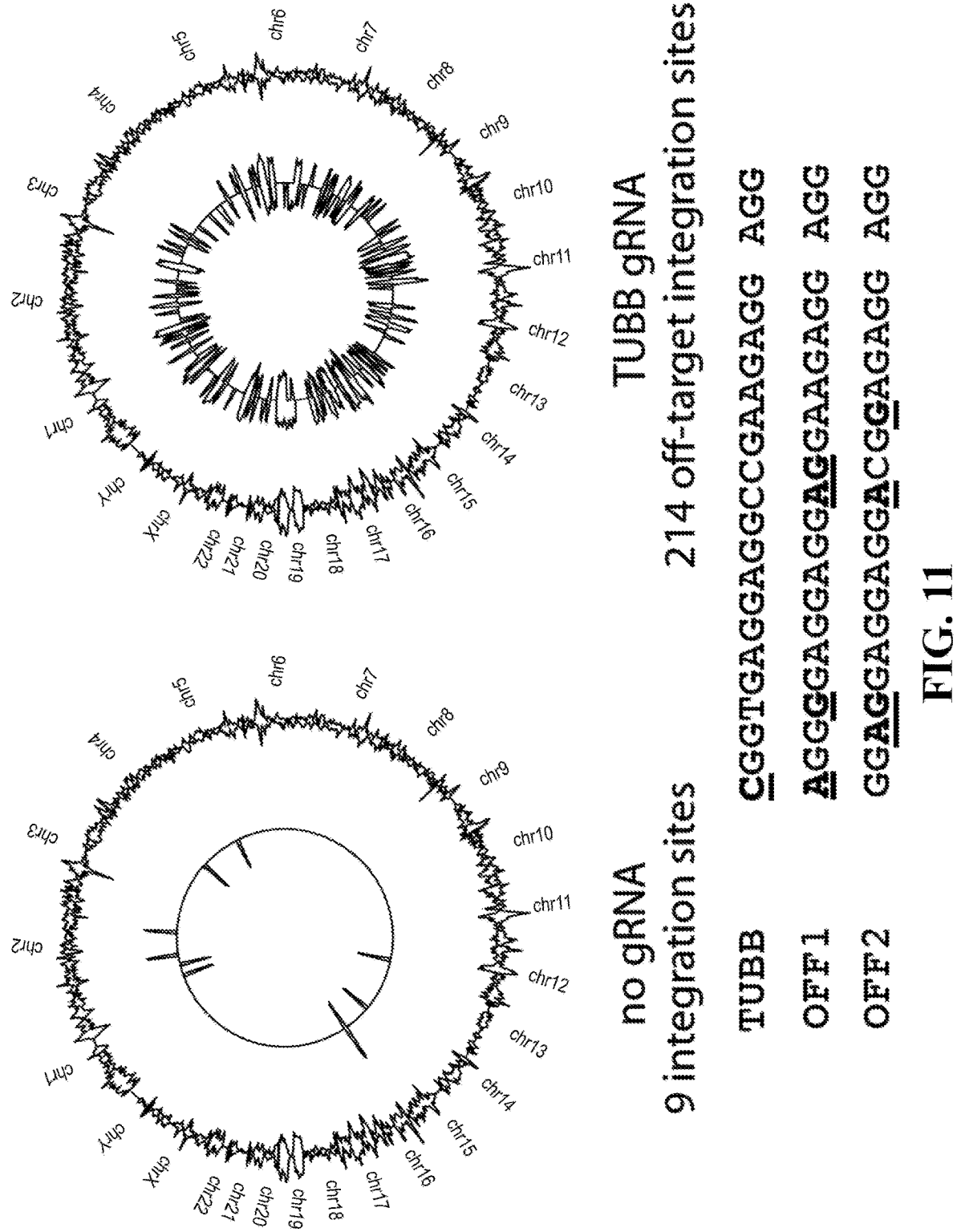
FIG. 11—Shows results of integration site sequencing performed after tagging experiments using spCas9 with no guide sequence or with TUBB guide sequence (SEQ ID NO: 69329). The donor was found at 9 integration sites when no gRNA was used, while the donor was found at 214 off-target integration sites when TUBB gRNA was used. Exemplary sequences of guide sequence targets and off target sequences (SEQ ID NO:69330 and 69331) upstream of PAM sequences is shown.
Figure 12:
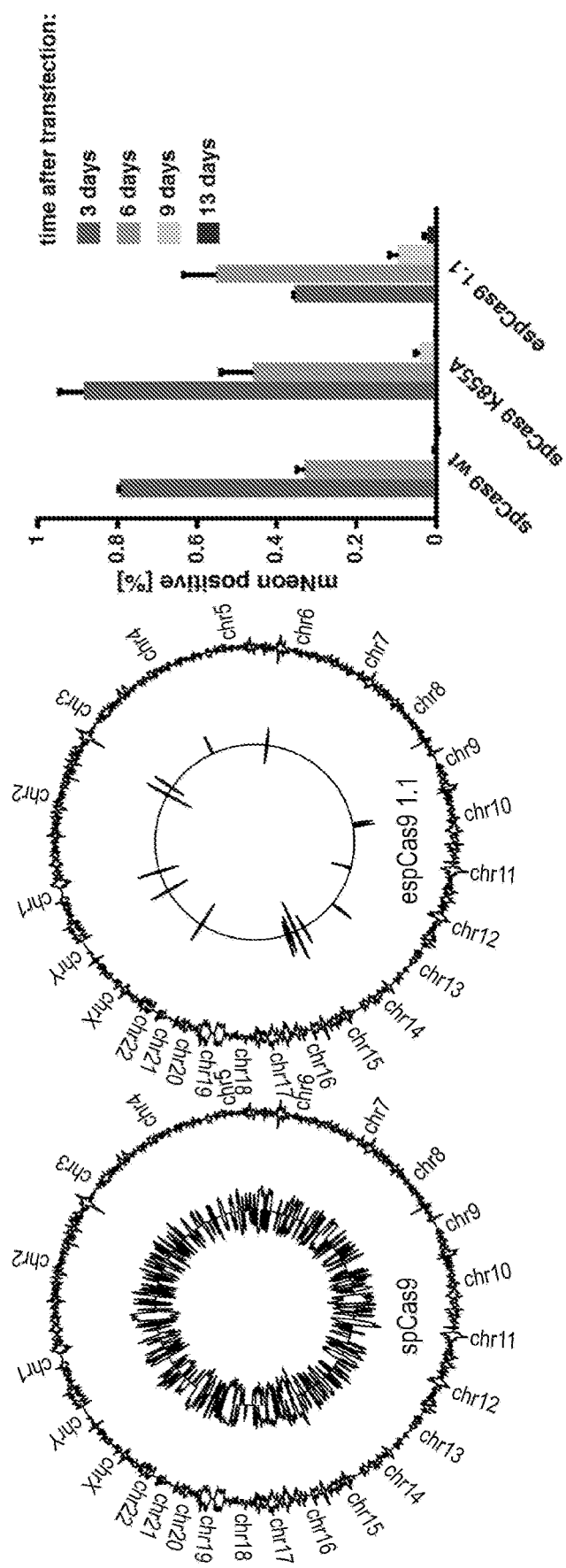
FIG. 12—Shows a comparison of integration site number and toxicity in tagging experiments using spCas9 and esp-Cas9 1.1.

Applicants performed experiments for determining the initial efficiency of tagging. FIG. 7 shows gRNA reads before and after selection. Applicants enriched for tagging by selection. Applicants transfected 15 million cells and greater than 200 genes were tagged. Applicants performed experiments to determine the cause of the low efficiency of tagging. Applicants hypothesized that there were differences in guide sequence tagging efficiency, general low tagging efficiency or low survival of tagged cells. FIG. 8 shows that 4 genes were tagged with different efficiencies and the tagged genes were lost over time. This suggested guide sequence specific toxicity after tagging. Tagging efficiency of a donor construct with and without a T7 promoter was performed for no guide sequence, as well as a guide sequence targeting the TUBB gene (FIG. 9). BFP was used to detect cells expressing Cas9. T7 did not affect the efficiency of tagging. Only about 1% of the cells were tagged in the TUBB gRNA cells. NHEJ was used to integrate the nucleic acid construct with the T7 promoter, encoding the mNeonGreen marker, a 3×FLAG site, T2A sequence, and a puromycin resistance selectable marker into the genome of the host cell. This construct allows for integration site sequencing using T7 transcription as shown in FIG. 10. Random shearing of the tagged genome was performed, followed by T7 transcription to generate RNA comprising the primer binding site and sequence correlated to the tagged gene of interest. Random-primed reverse transcription was performed to produce cDNA, followed by PCR to produce dsDNA. FIG. 11 shows 9 integration sites when no gRNA was used, while 214 off-target integration sites were found when TUBB gRNA was used. Also shown is the TUBB target site and PAM sequence, as well as exemplary off-target site sequences. The donor can be integrated in off-target sites upstream of a PAM sequence with a few mismatches. Applicants hypothesized that off-target integration can lead to toxicity. Applicants performed tagging with espCas9 1.1, which resulted in much fewer off-target integration sites as compared to spCas9. Applicants generated a library having 5000 tagged genes (FIG. 12). Applicants were also able to detect mNeonGreen positive cells after 13 days using espCas9 1.1.

Figure 21:
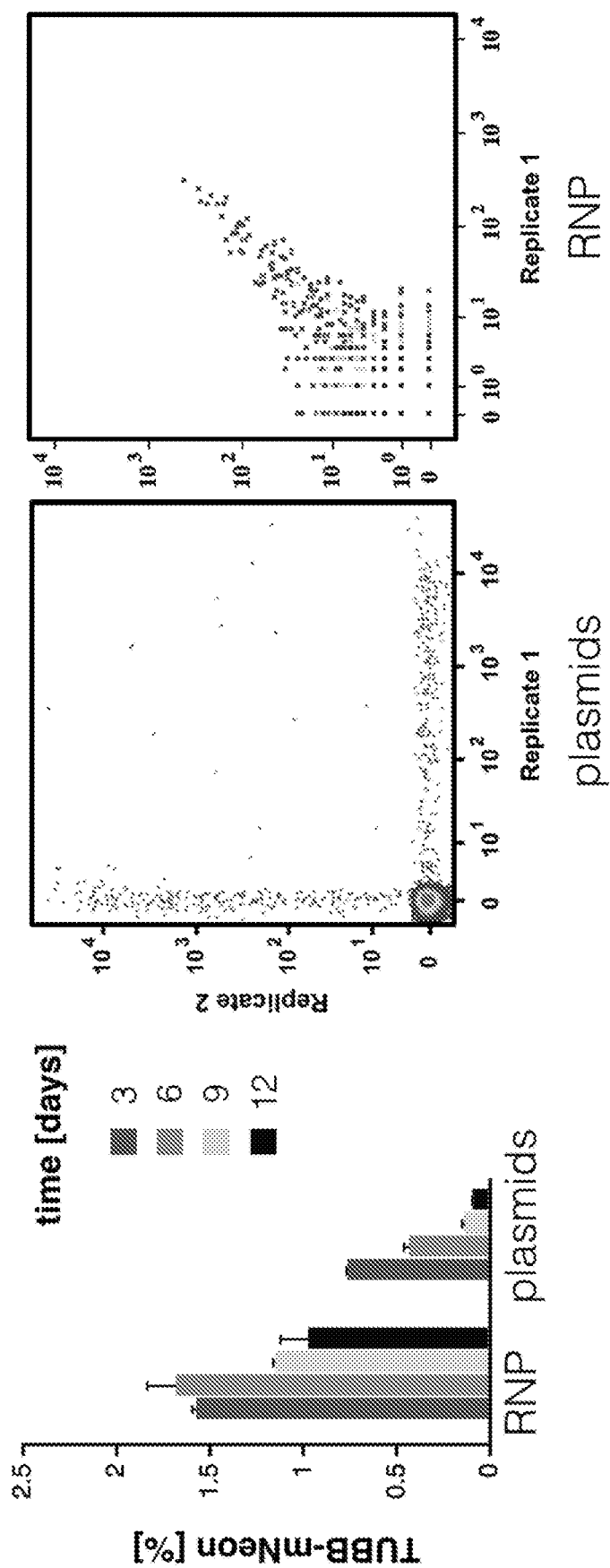
FIG. 21—Shows that RNP delivery gives rise to more efficient and more persistent tagging of an endogenous gene (left panel) and more reproducible gene representation in replicates of polyclonal tagging libraries (right panel).

Applicants have also determined that the CRISPR system may be delivered to the cell as a ribonucleoprotein complex (RNP). The RNP complex may comprise recombinant CRISPR enzyme, guide sequences (e.g., in vitro transcribed (IVT)), and the donor construct. The RNP complexes may be delivered to a population of cells by transfection. Applicants determined that tagging is less toxic by transfecting RNP complexes (Cas9+IVT-transcribed gRNA pool)+donor DNA (FIG. 21).

The transfection conditions for an optimized protocol are:
mix 1:
  25 µl Optimum
  100 ng Cas9-3×NLS (from IDT)
  10 ng gRNA pool (transcribed in vitro from a PCR-amplified oligo pool by T7)
  100 ng donor DNA
mix 2:
  25 µl Optimum
  0.5 µl Lipofectamine 2000 incubate each mix for 5 minutes, mix both mixes, incubate for 20 minutes
  add 7 µl per 96-well, each containing ca. 50,000 HEK293T cells plated the day before.

Example 3—Protein Localization Using SBP

Figure 13:
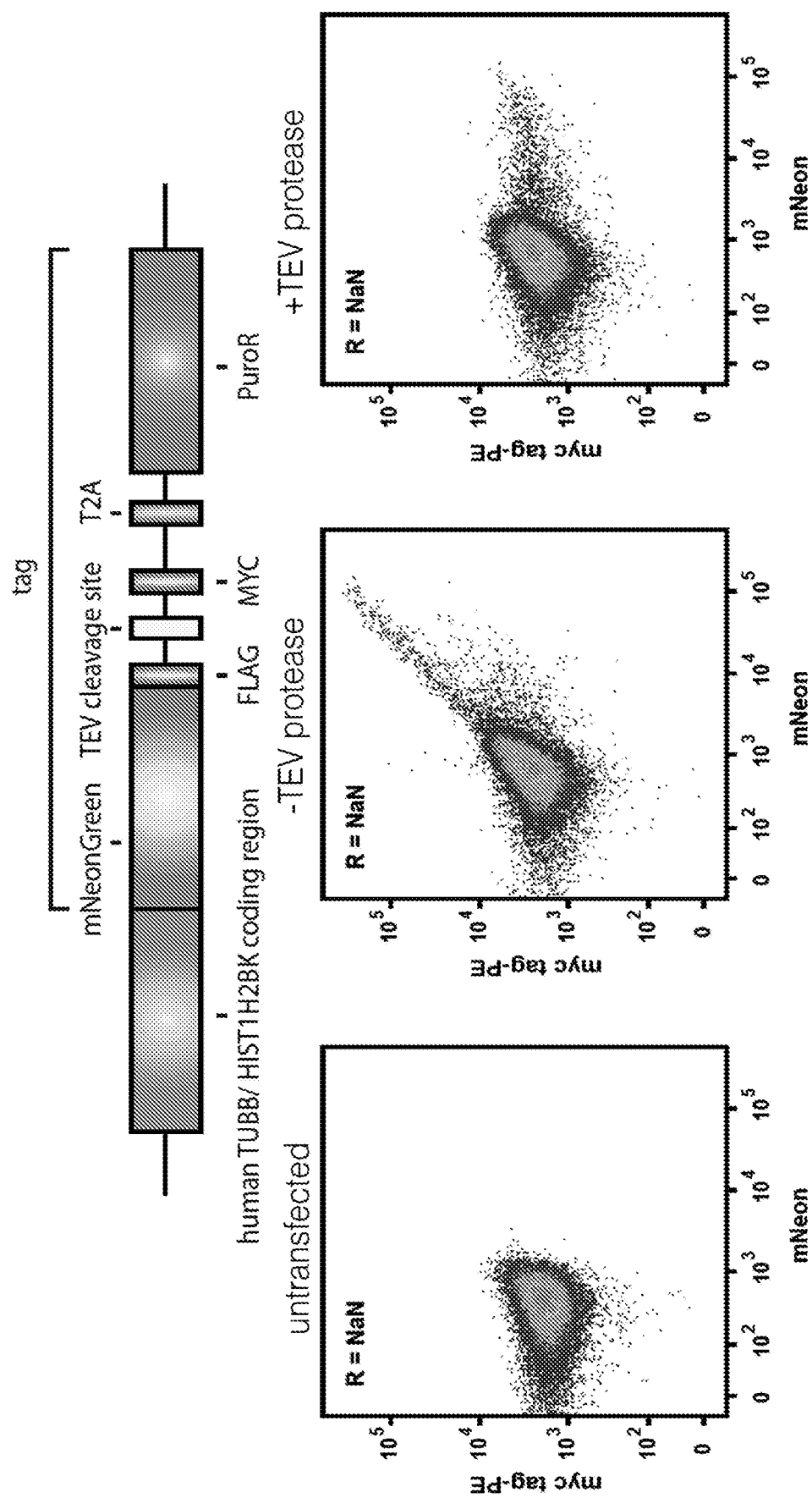
FIG. 13—Shows a protein localization reporter integrated into the TUBB gene and FACS analysis with and without TEV protease.
Figure 14:
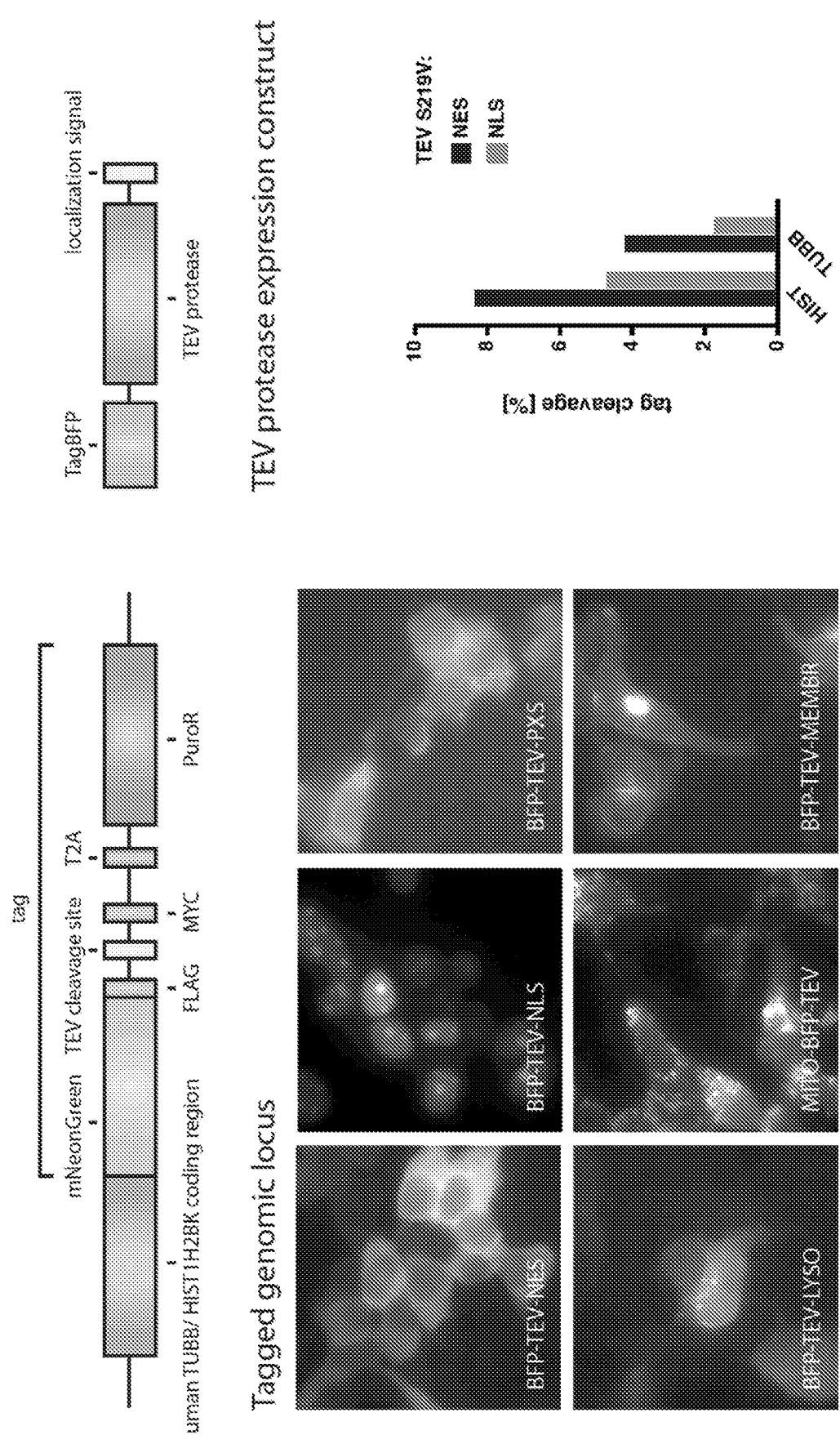
FIG. 14—Shows protein localization experiments using TEV protease expression constructs localized to organelles.
Figure 15:
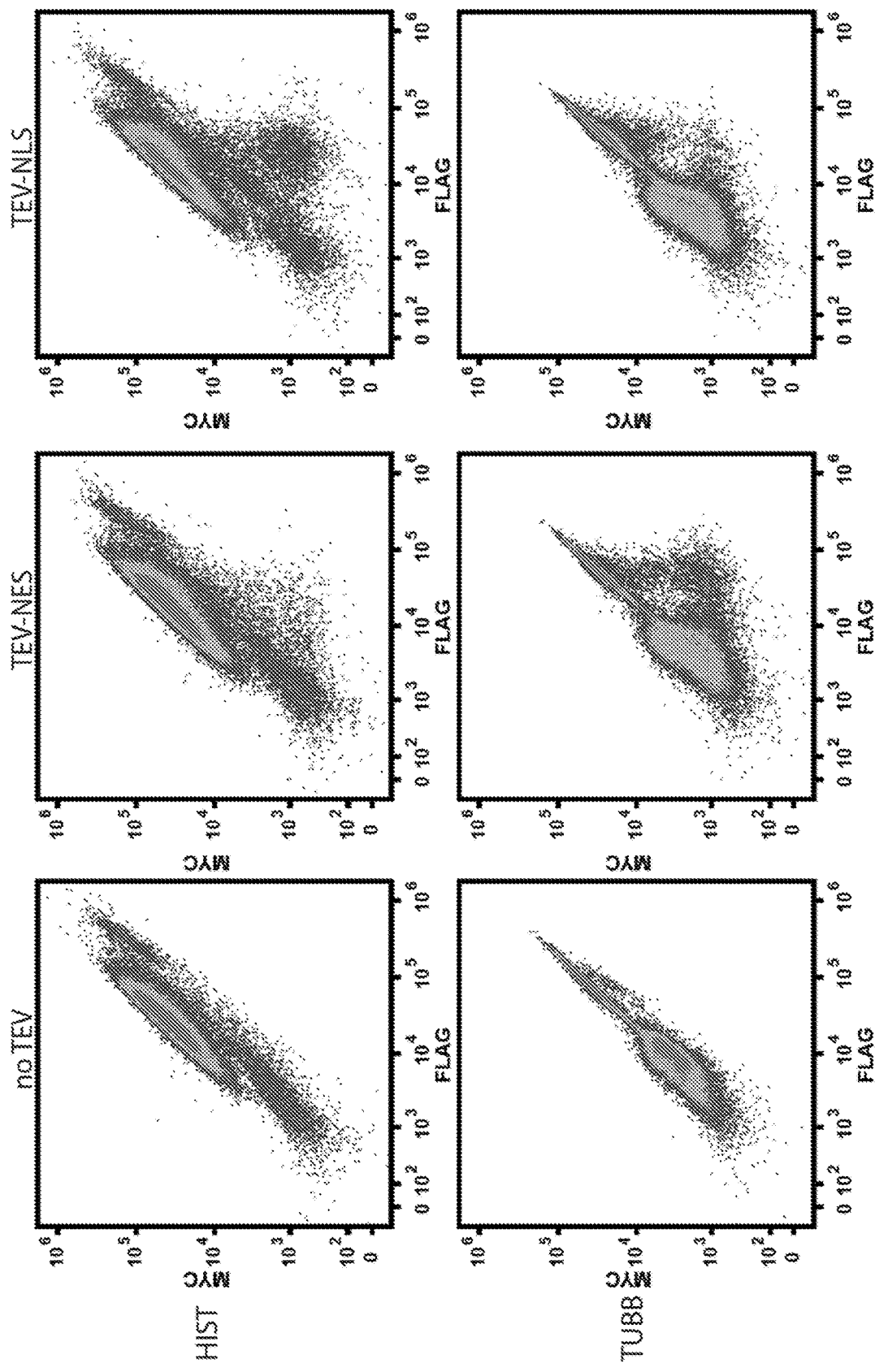
FIG. 15—Shows that the TEV S219P mutant allows localization-dependent cleavage by FACS.

As shown in FIG. 13, Applicants integrated a protein localization donor construct into human HEK 293T cells. The donor construct includes mNeonGreen and further includes a 3×flag epitope, a TEV cleavage site followed by a MYC epitope, all in frame with the target gene of interest (e.g., TUBB or HIST1H2BK). FACS analysis was performed with and without TEV protease. Without TEV protease, tagged cells are positive for myc and mNeonGreen. With TEV cells are positive for mNeon only. The TEV protease cleaved off the myc tag. Applicants hypothesized that protein localization could be determined by using a TEV protease localized to different cellular compartments. Different TEV mutants are more stable while maintaining wild-type catalytic proficiency. In one embodiment, Applicants use the TEV S219P mutant for localization-dependent cleavage (see, e.g., Kapust et al., Protein Engineering, 2001 vol. 14, No 12 pp. 993-1000). FIG. 14 shows protein localization experiments using TEV protease expression constructs localized to organelles. The TEV protease was labeled with BFP and included a localization signal. BFP was visualized in the correct location depending on the localization signal (e.g., nucleus, cytoplasm, lysosomes, nucleus, mitochondria, peroxisomes). Moreover, MYC tag cleavage is increased for TUBB using the TEV having a nuclear export signal as compared to TEV having a nuclear localization signal. FIG. 15 shows that the TEV S219P mutant allows localization-dependent cleavage by FACS. Applicants used a nuclear protein, HIST, and a cytoplasmic protein, TUBB, to show protein localization-dependent cleavage. Shown are FACS experiments using the non-cleavable FLAG tag and the cleavable MYC tag. For HIST the MYC tag is only cleaved efficiently when using a TEV having a NLS. For TUBB the MYC tag is only cleaved efficiently when using a TEV having a NES. FIG. 16 shows bar graphs depicting that the TEV S219P mutant allows localization-dependent cleavage. The left panel shows experiments similar to FIG. 19. The right panel shows that TUBB is mainly localized to the cytoplasm, as tag cleavage is highest when TEV includes a NES (also shown are experiments with nuclear localization signal (NLS), peroxisome localization signal (PXS), lysosome localization signal (LYSO), and membrane localization signal (MEMBR).

Example 4—Integration Site Sequencing Using Tagmentation

Figure 17:
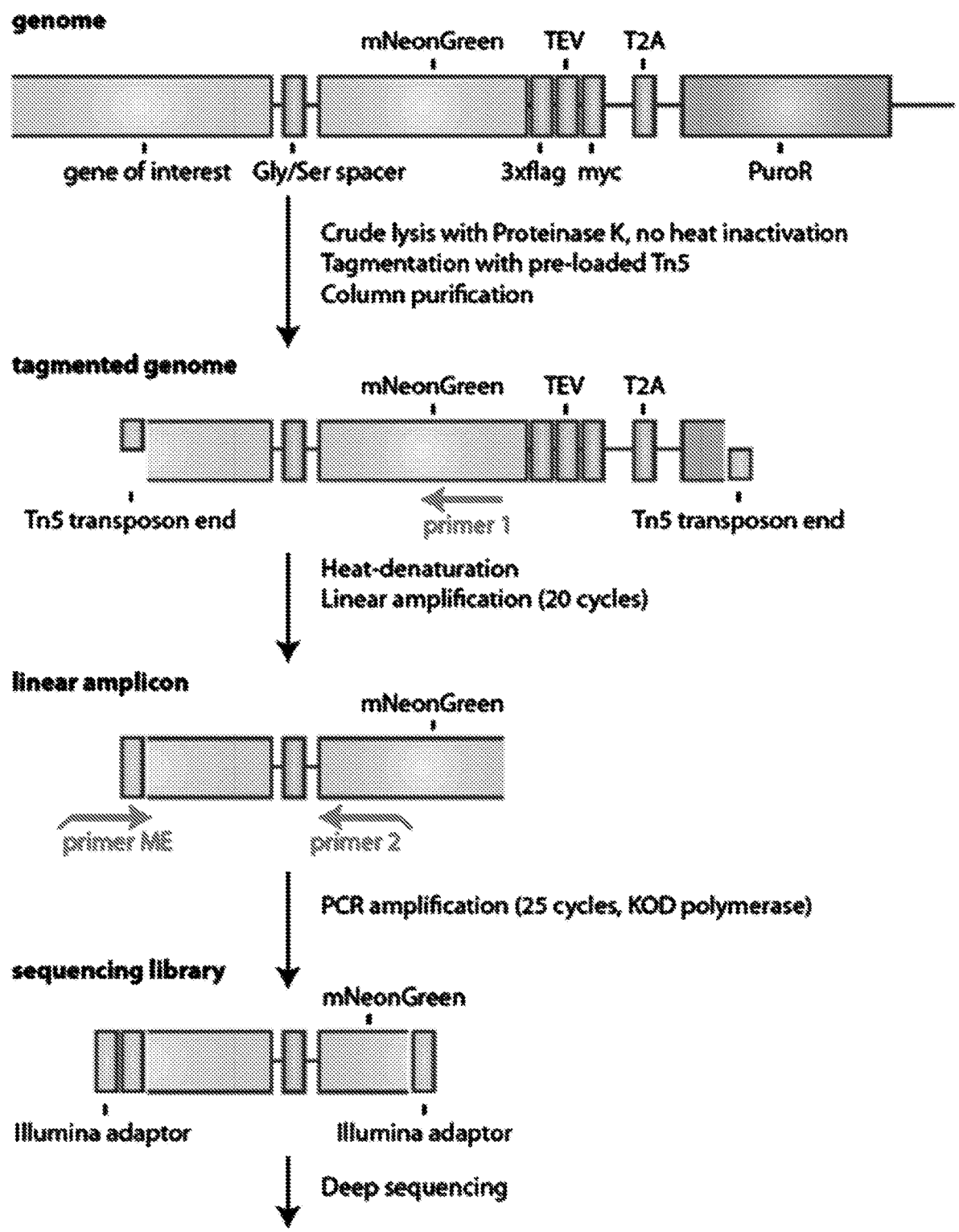
FIG. 17—Shows a schematic of a method for creating a sequencing library using tagmentation.
Figure 18:
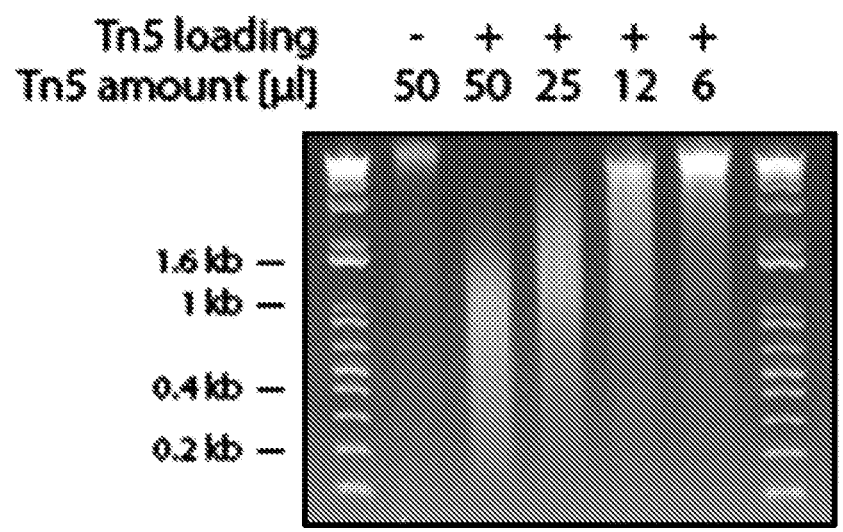
FIG. 18—Shows gel electrophoresis results of Tn5 tagmentation.
Figure 19:
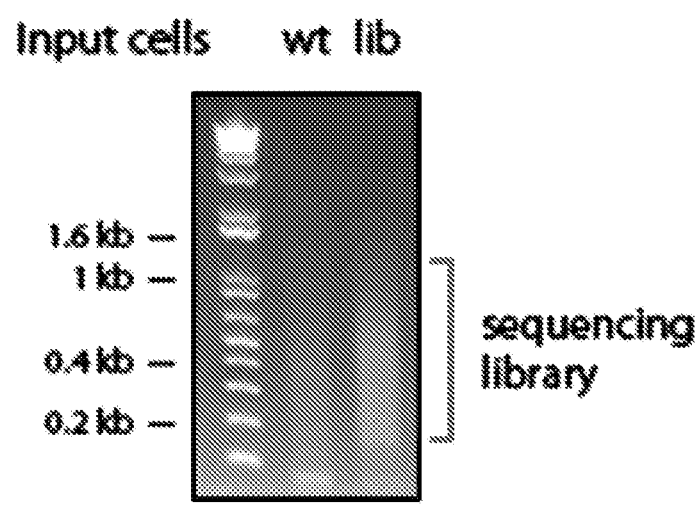
FIG. 19—Shows gel electrophoresis results of the PCR amplification to create a sequencing library with mNeon-Green marker.

FIG. 17 shows a summary of integration site sequencing using tagmentation (TagSeq). Sequencing tag integration sites was performed using Tn5-mediated tagmentation in a crude proteinase-K lysis buffer (FIG. 18). Linear amplification was then performed with tag-specific primers using a high-processivity polymerase (KOD). PCR amplification was then done using a high-processivity polymerase (KOD) and shifted primer (FIG. 19). Highly specific sequencing libraries were produced with >80% on-target reads (FIG. 20).

The tagmentation step in the TagSeq method fragments the genomic DNA and adds a constant sequence to the ends at the same time. The fragment size is controlled by the ratio of gDNA and loaded Tn5 transposase. However, Applicants found that there is a saturation of Tn5, yielding a fragment size of 100-300 bp, which is quite optimal for the TagSeq method. Therefore, Applicants can saturate any tagmentation reaction instead of calculating the optimal amount of Tn5 transposase.

Example 5—Other Exemplary Embodiments

In one exemplary embodiment, enrichment was performed on successfully tagged cells, followed by sorting of cells based on tag expression. Identification of tagged genes in each sorted bin was then performed. If desired, protein localization was measured by cleaving the tags in specific organelles using targeted TEV protease overexpression, which created a localization-dependent fluorescent signal after antibody staining. 390 proteins were able to be quantified in parallel, with TEV-dependent localization producing robust results for control genes.

In another embodiment, barcoding of cells can be performed using combinations of fluorescent proteins. LIC-based random assembly was done on three 2A-separated fluorescent proteins (FPs) chosen in a random fashion from a large set of FPs with distinct spectra. Optionally, a biological entity could be included in the plasmids linked to barcodes (e.g., a guide sequence cassette). Sequencing may be performed on the combinations of fluorescent proteins and the biological entity using long read sequencing (e.g., Oxford Nanopore Technologies, Pacific Biosciences). Lentivirus pools were then produced from fluorescent barcodes, and cells were infected with virus and expanded in culture. Cells were analyzed using spectral flow cytometry (Sony), multi-channel flow cytometry, or spectral microscopy. Barcodes were identified from combined fluorescent spectra. Transient expression of 19 random combinations of 12 FPs was distinguished in single cells after spectral FACS at a confidence level of 94%.

Example 6—Studying Systems Immunology Using SBP

The signaling pathways governing innate immunity in human cells at the systems level can be evaluated. Specifically, SBP technology can be used to generate an etiologic map of signaling components regulated at the protein level after activation of the immune receptors RIG-I, STING, TNFR, TLRs, as well as inflammasome receptors.

Initially, mapping of the signaling pathways downstream of RIG-I and TNER activation in HEK-293T cells can be done using SBP technology, since these cells are highly permissive to CRISPR/Cas9-mediated genome editing. Custom software can be developed that allows establishment of a detailed picture of how a population of immune-competent human cells reacts to synchronous immune-stimulation over time. Identified pathways can be validated using complementary biochemical methods like immunoblotting, immunofluorescence microscopy, and mass spectrometry.

In parallel, SBP can be employed in a myeloid cell line like THP-1, Seraphina-C/EBPα, or immortalized mouse macrophages. Optimizing the technology to work in these cells can allow mapping of the etiology of signaling components after TLR or inflammasome activation, which are non-functional in HEK-293T cells. These studies can contribute to a fuller understanding of the molecular signal processing network in specialized innate immune cells and can broadly translate into a better understanding of the mechanisms of clinically relevant chronic inflammation, allowing more precise interventions.

Example 7—Studying Cell Cycle Biology Using SBP

SBP technology relies on FACS, therefore it can be combined with additional fluorescent markers to enable the characterization of the proteome in specific subsets of cells or cell states. A three-color cell cycle reporter can be employed (Lister et al., (2008) Highly integrated single-base resolution maps of the epigenome in Arabidopsis. Cell 133 (3): 523-36), allowing differentiation of individual cell cycle phases at the time of sorting the tagged library. Changes in the proteome could thus be monitored over the course of the cell cycle in tumor cell lines. Combining these measurements with genetic perturbations of potential cell cycle regulators or with the application of anti-cancer drugs, unknown regulatory mechanisms that are relevant for the boundless cell division of cancer cells and drug resistance can be studied.

Example 8—Predicting the Mechanism of Action of Small-Molecule Drugs Using SBP

An established proteome-scale library of tagged cells can be expanded and reused ad libitum. Moreover, because all subsequent steps of the SBP method, namely sorting and sequencing, are easily scalable, the method could be applied to hundreds of conditions in parallel. As such, it is realistic to screen a panel of 384 drugs with known mechanisms of action for their effects on the proteome of human cells, thus establishing a database of drug proteome fingerprints. Subsequently, a set of chemicals with unknown function or mode of action can be tested using the same pipeline. By comparing the proteome fingerprints of the unknown drugs to the fingerprints of the known drugs, predictions can be made with regards to the function and mode of action of the second set of chemicals using a similar approach as described for transcriptome fingerprinting (Liu C, et al., (2015) Compound signature detection on LINCS L1000 big data. Mol Biosyst. 11 (3): 714-22). After confirming the validity of the method using control drugs not contained in the learning set, large libraries of chemicals could be screened in order to identify novel drug candidates regulating clinically relevant cellular processes like cell division or immune signaling.

Example 9—Detection of Protein Dynamics Through DNA Sequencing

Figure 26A:
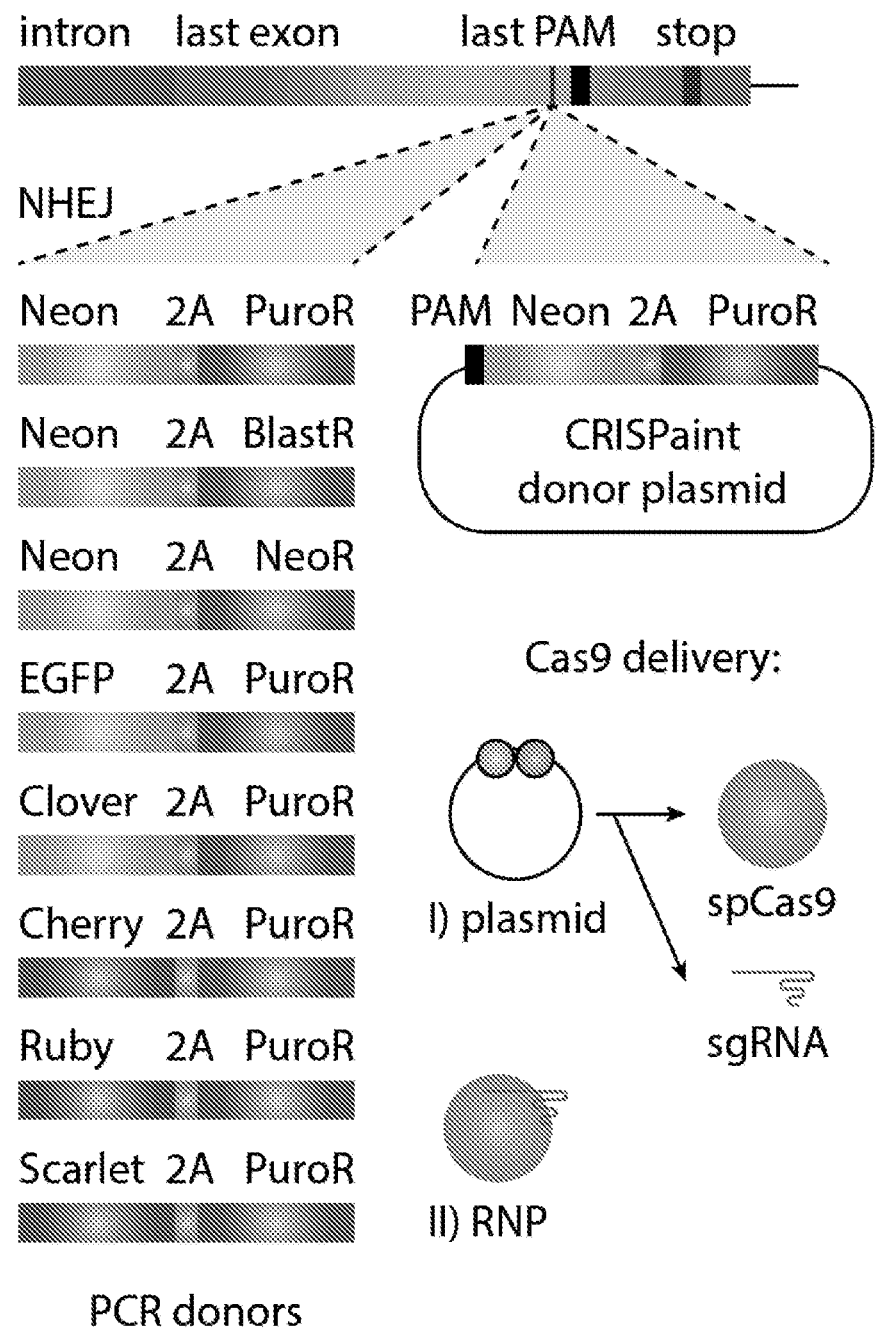
FIG. 26A-FIG. 26D—Optimization of NHEJ-mediated gene tagging.
Figures 26B, 26C, 26D:
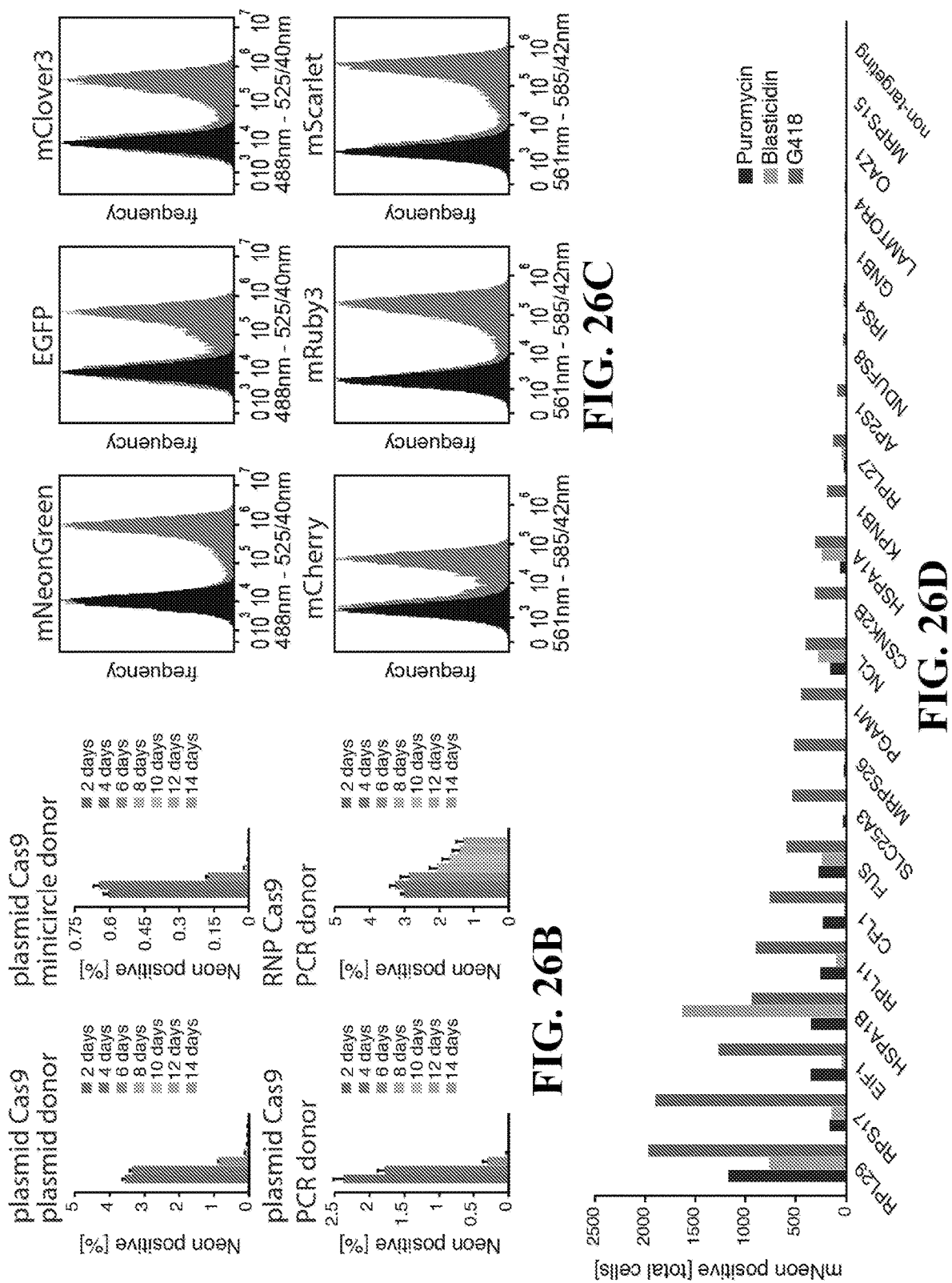

To generate a complex pooled library of human cells in which a large number of protein-coding genes is tagged with a fluorescent protein, Applicants took advantage of a previously established approach for efficient tagging of cell lines through Ligase-IV dependent tag insertion into protein-coding genes following targeted CRISPR-Cas9 cleavage (Schmid-Burgk, J. L., Honing, K., Ebert, T. S. & Hornung, V. CRISPaint allows modular base-specific gene tagging using a ligase-4-dependent mechanism. Nat Commun 7, 12338, doi: 10.1038/ncomms12338 (2016)). To parallelize this for library generation, Applicants performed several optimizations. First, comparing Cas9 and donor delivery strategies, Applicants found that RNP co-transfection with a phosphorothioate (PTO)-modified linear double-stranded DNA (dsDNA) donor yields the most sustainable gene tagging, whereas endogenous overexpression of Cas9 leads to rapid loss of tagged cells over the course of two weeks (FIG. 26a,b). Next, Applicants tagged endogenous Tubulin-beta with each of six fluorescent proteins and found that mNeonGreen and mScarlet provide the highest signal-to-noise ratios (FIG. 26c). To facilitate efficient enrichment of tagged cells for the generation of large tagging libraries, Applicants coupled an antibiotic resistance gene to the fluorescent tag using a 2A linker. However, when Applicants tested the commonly used Puromycin N-acetyl transferase as a resistance marker, the resulting library contained a limited number of highly expressed tagged genes (data not shown). Applicants therefore compared it to two other antibiotic selection markers for their ability to efficiently recover cells with an mNeonGreen-2A-resistance construct fused to each of 22 different endogenous genes in a HEK293T cell line in which the endogenous NeoR gene had been knocked out using CRISPR-Cas9. In this assay, G418 selection was superior to Puromycin and Blasticidin selection with respect to the number of tagged genes that could be efficiently recovered, indicating that Neomycin 3'-glycosyl phosphotransferase provides resistance at lower expression levels (Nakatake, Y. et al. Kinetics of drug selection systems in mouse embryonic stem cells. BMC Biotechnol 13, 64, doi: 10.1186/1472-6750-13-64 (2013)) (FIG. 26d).

Figure 22E:
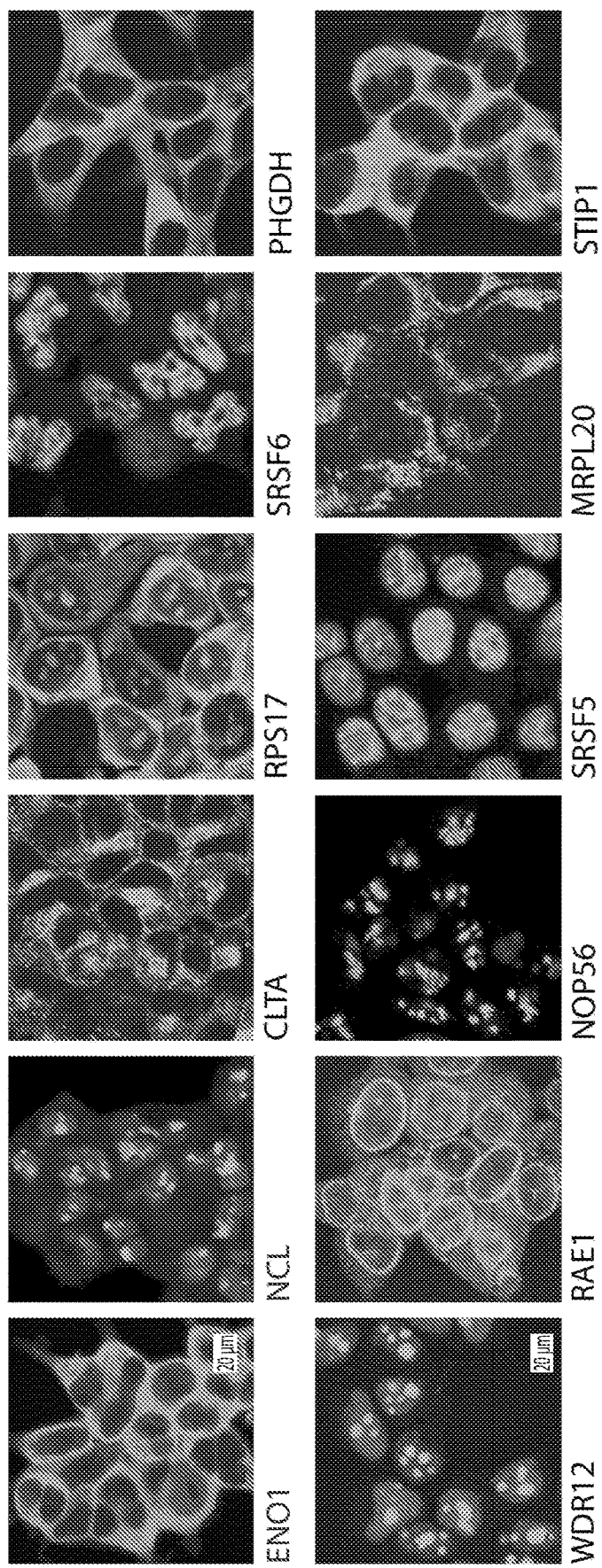
Figure 27:
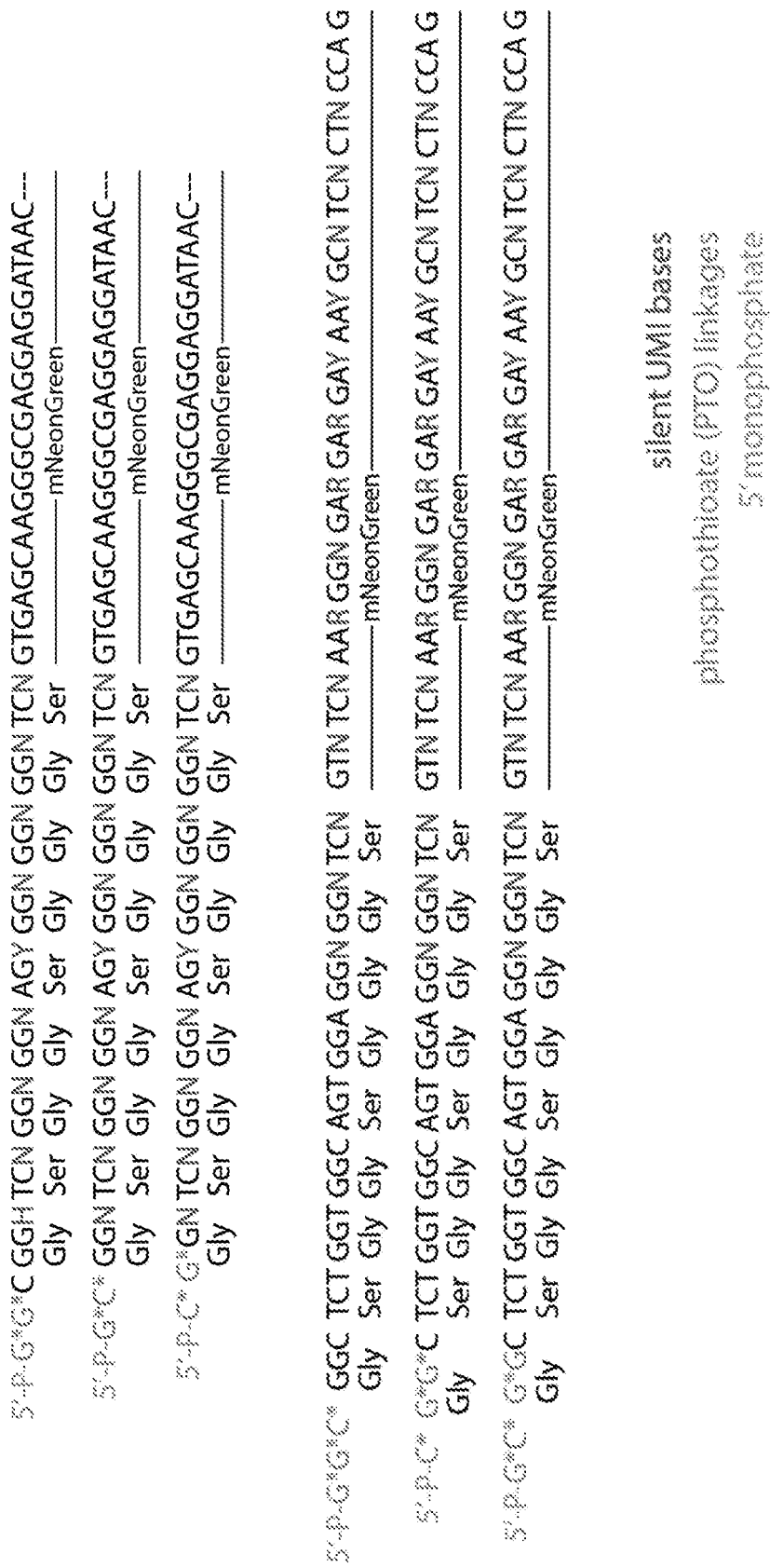
FIG. 27—Design of donor DNA for large-scale library tagging. Using modified PCR primers, the donor DNA is equipped with a 5' phosphate, two phosphorothioate-linkages on each 5' terminus, a Unique Molecular Identifier (UMI) of 9 or 14 degenerate bases incorporated without affecting the encoded amino acids (Silent Barcode), and three different 5' extensions in order to accommodate all three possible reading frames occurring among target genes. (SEQ ID NOs: 69332-69338).
Figure 28:
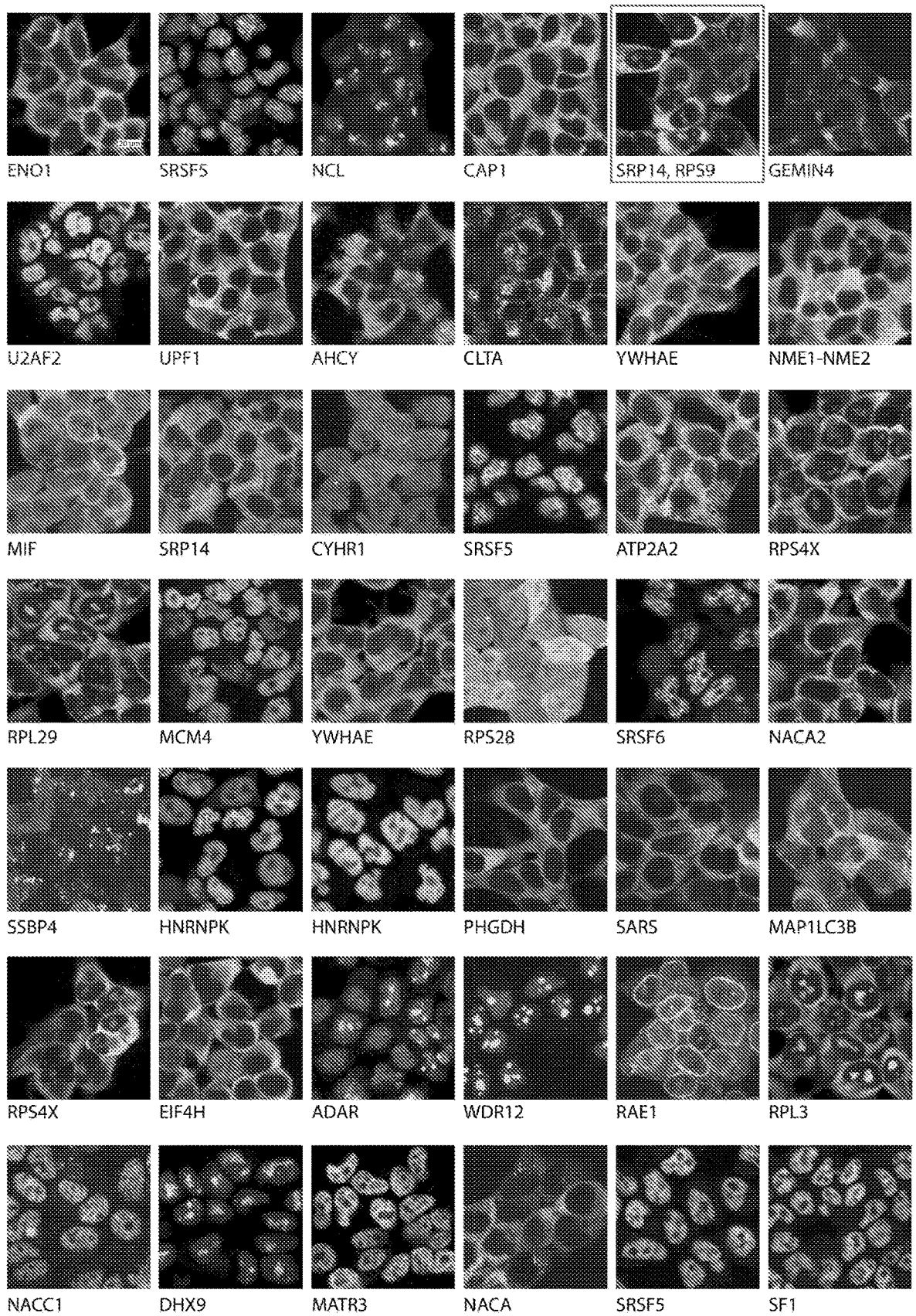
FIG. 28—Confocal microscopy images of library clones. The polyclonal tagging library was pre-sorted for mNeon expression and plated at limiting dilution conditions. After two weeks, clones were picked and duplicated, and one replicate was lysed and subjected to TTISS sequencing as described in the methods section. TTISS results are indicated as gene names below the images. Representative z-slice images from acquiring 1 μm-spaced confocal z-stacks are shown. Scale bar, 20 μm. Clones with two genes tagged are marked by a box.
Figure 28:
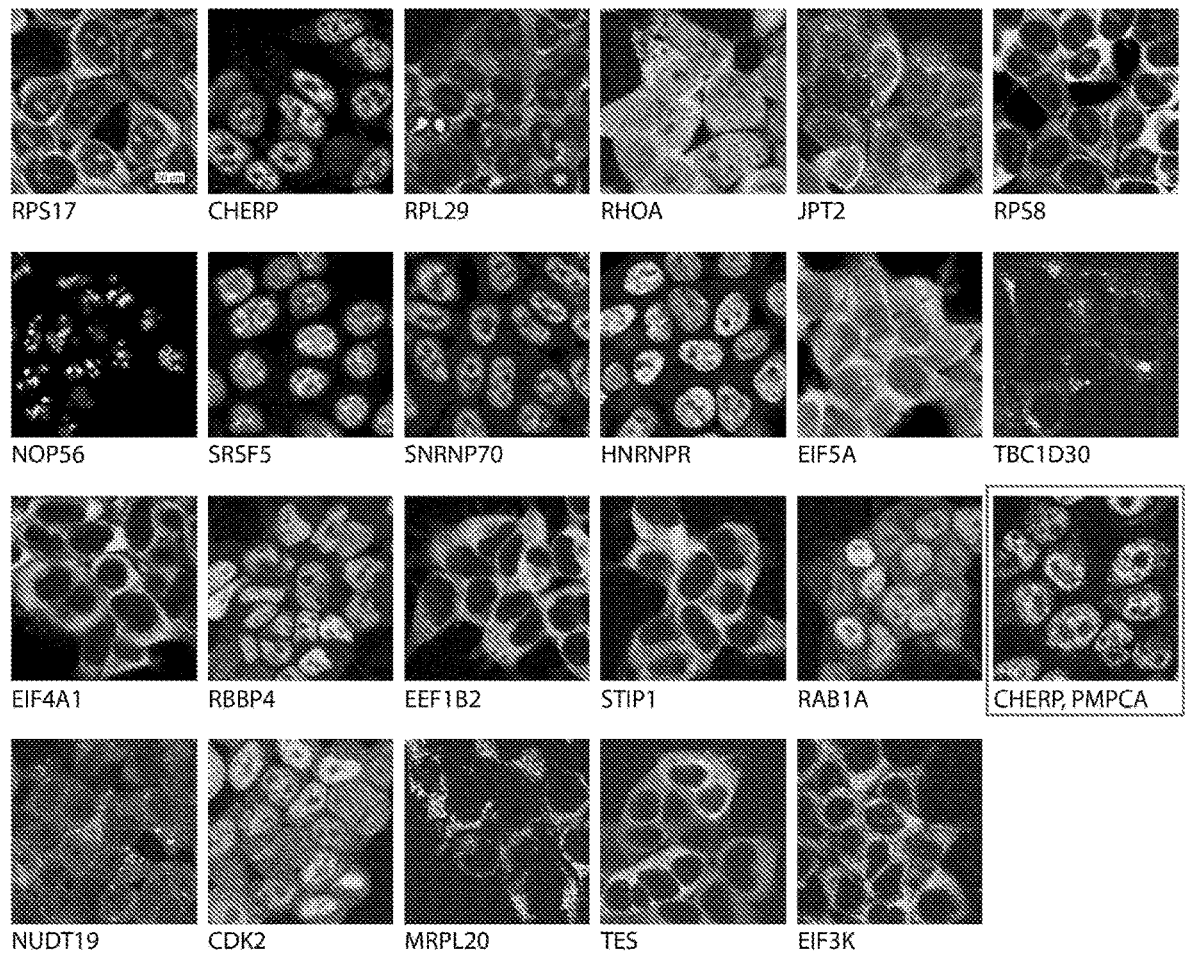

Next, Applicants applied the optimized NHEJ-based tagging protocol in a pooled fashion using a library of 23,095 sgRNAs spanning the human protein-coding genes (FIG. 22a). To verify successful tag integration in each protein-coding gene, Applicants developed a Tagmentation-based Tag Integration Site Sequencing (TTISS) method (FIG. 22a, bottom), which quantitatively identifies tag integration sites (FIG. 22b). TTISS determined that 10,085 protein-coding genes were successfully tagged in the polyclonal library (FIG. 22c). To assess individual tagging events, Applicants incorporated a Unique Molecular Identifier (UMI) in the donor by randomizing the third position of the codons in the linker (FIG. 22a and FIG. 27). Most successfully tagged genes are represented by at least two UMIs in the library, reflecting two independent tagging events (FIG. 22d). To confirm that most cells have only a single tagging event, Applicants expanded 96 single clones from the library of tagged cells by limiting dilution and both imaged them and analyzed them by TTISS (FIG. 22e, FIG. 28). Applicants observed single-gene in-frame tagging in 71/87 (81.6%) of successfully sequenced clones (9 clones could not be sequenced), and only three clones bearing two independent in-frame tag integrations (FIG. 28). The presence of these rare double-tagged clones may lead to artifacts in protein quantification due to passenger effects, where the expression of one tagged gene masks the expression of another, but because most (64.9%) tagged genes are represented multiple times in the library, such artifacts can be mitigated by UMI sequencing.

Figure 29:
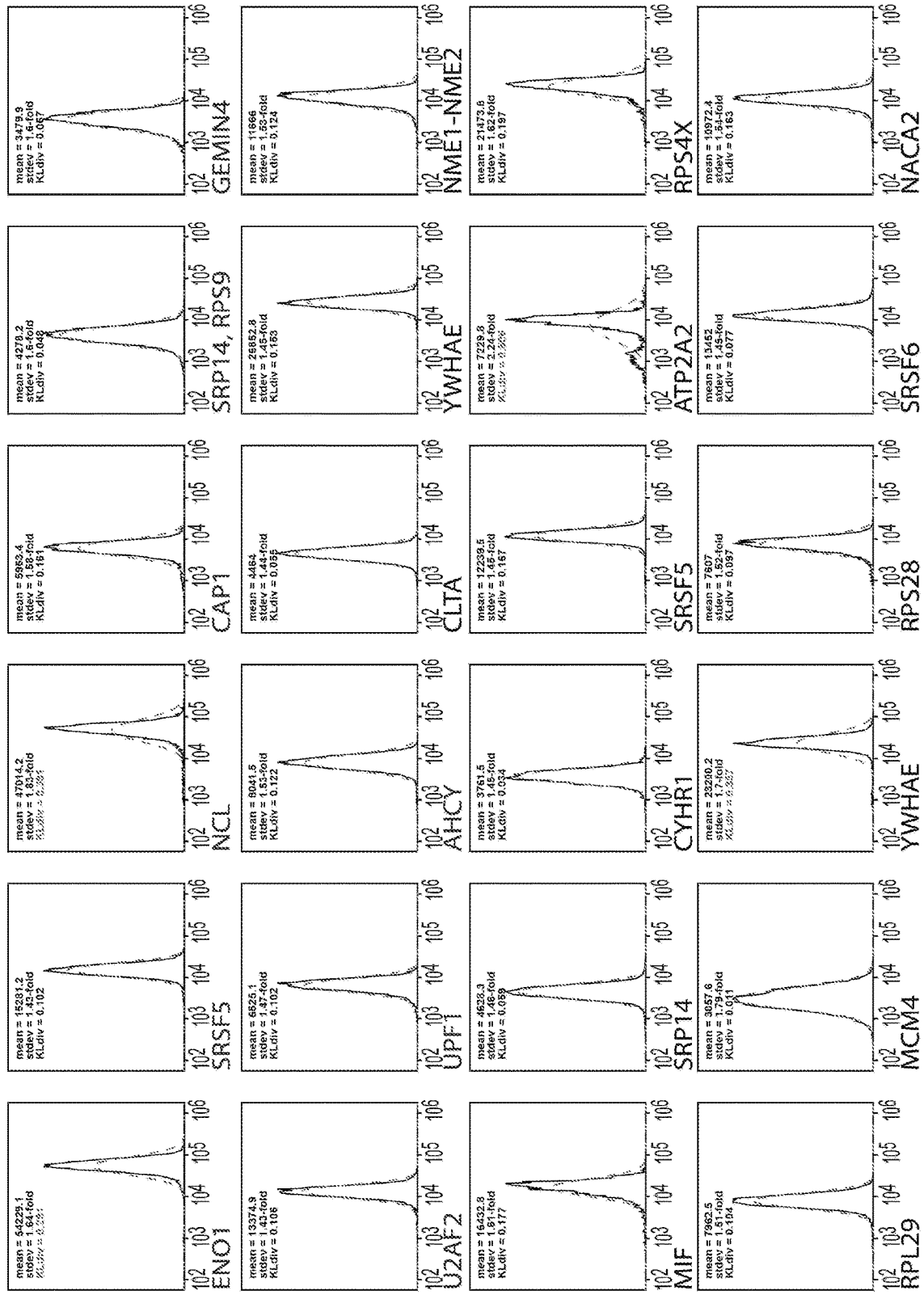
FIG. 29—FACS analysis of tagged clones. A random tagging library was pre-sorted for m Neon expression and plated at limiting dilution conditions. After two weeks, clones were picked and duplicated, and one replicate was lysed and subjected to Tagmentation-based Tag Integration Site Sequencing (TTISS) sequencing as described in the methods section. TTISS results are indicated as gene names below the plot. The same clones were analyzed using FACS. Shown are histograms of logarithmic fluorescence per cell.
Figure 29:
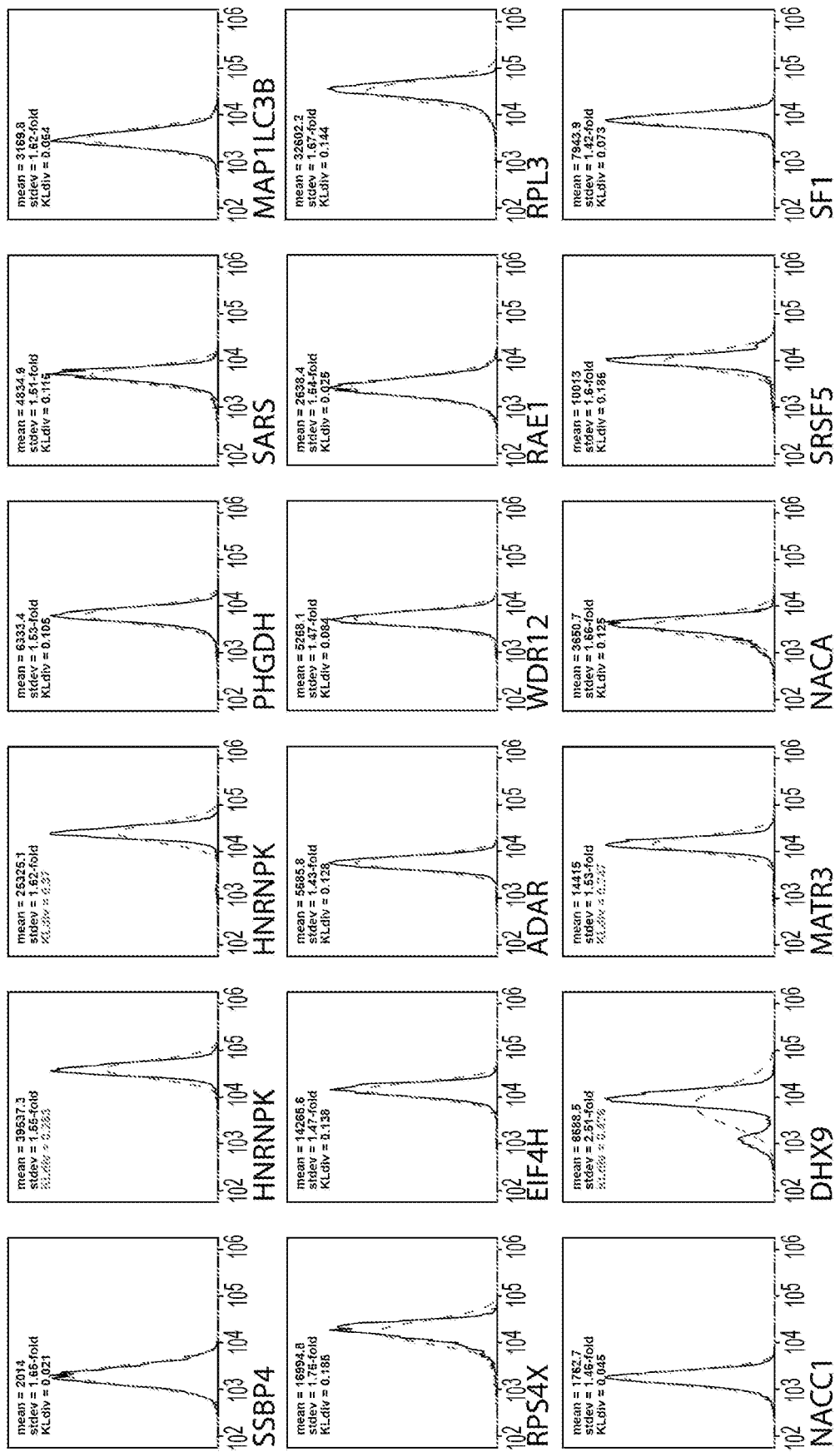
Figure 29:
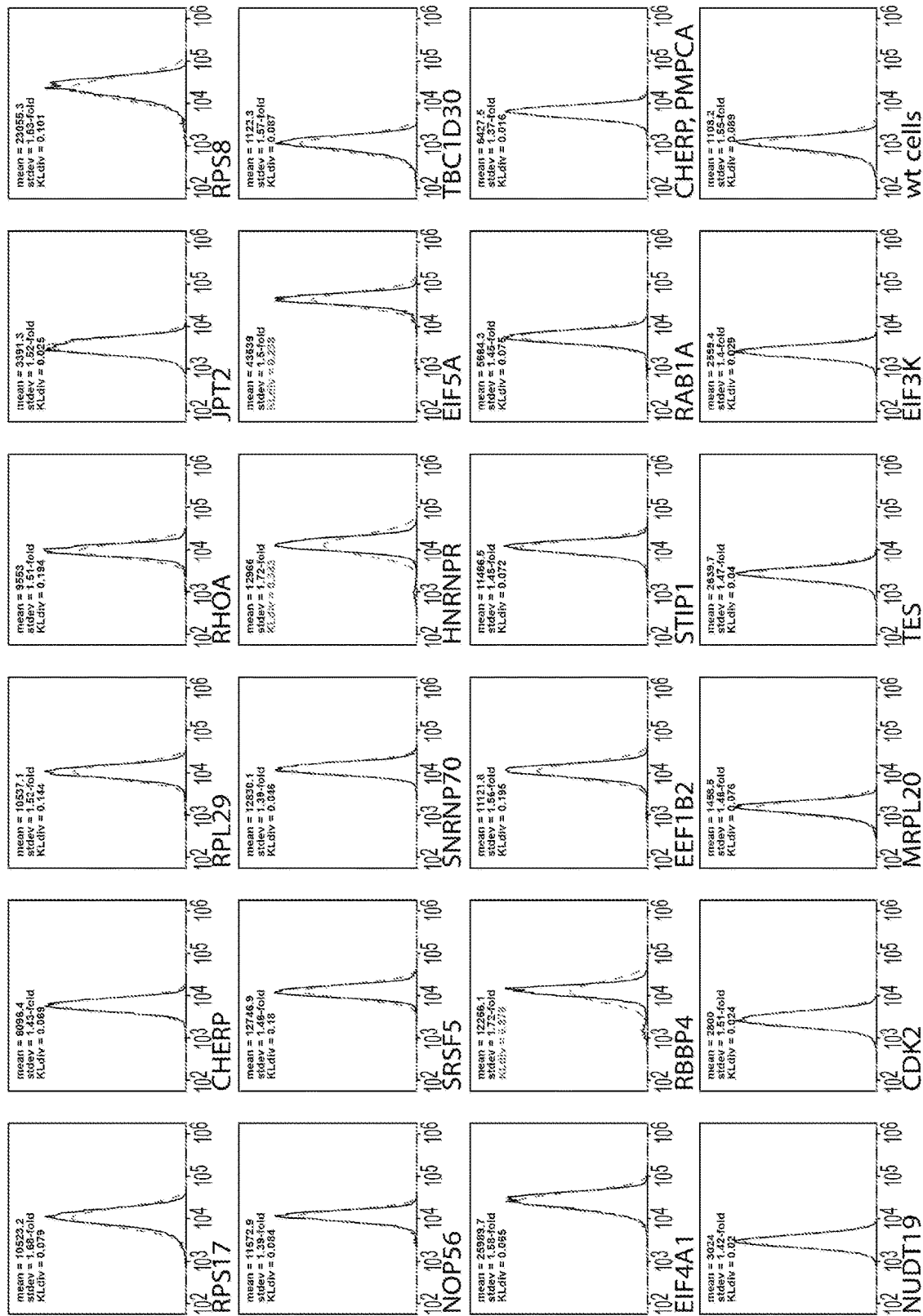

To quantify protein abundances at large scale, Applicants first confirmed that single-cell expression of most tagged proteins could be modeled by log-normal distributions (FIG. 29). When Applicants pre-enriched the library of tagged cells for detectable fluorescence, FACS-sorted it into six protein expression bins, and performed bin-wise TTISS (FIG. 23a), the distribution of individual proteins across the six bins was reproducible among sorting replicates (FIG. 23b). To quantify large numbers of proteins in the library, Applicants gated on protein representation based on the TTISS data with varying cut-offs and found that the estimated mean expression values were very highly correlated between replicates for up to 1,000 top represented proteins (FIG. 23c).

In contrast to mass-spectrometry, SBP measures the expression distribution of proteins among single cells, allowing us to identify proteins that are heterogeneously expressed across cells in a population, as well as to relate proteins to each other by the similarity of their distributions. For example, RRM2 was the most heterogeneously expressed protein in the library by its single cell expression variance (FIG. 23d, e), and Applicants confirmed its bi-modal expression using a clonal reporter cell line (FIG. 23f). Because the cells were not cell-cycle synchronized before FACS, Applicants hypothesized that this protein might be regulated in a cell-cycle dependent fashion, as has been observed for other proteins (Sakaue-Sawano, A. et al. Visualizing spatiotemporal dynamics of multicellular cell-cycle progression. Cell 132, 487-498, doi: 10.1016/j.cell.2007.12.033 (2008)). To test this hypothesis, Applicants combined SBP with two transiently expressed cell-cycle reporters (FIG. 23g) and gated cells in G1/S or S/G2 phase during FACS of the tagging libraries. Indeed, RRM2 was enriched in the S/G2 cell-cycle phase (FIG. 23h), and a clonal RRM2 reporter showed markedly reduced expression in cells with low DNA content (FIG. 23i). Applicants further validated this finding by quantifying RRM2 using western blotting of synchronized or cell-cycle phase enriched cells (FIG. 23j), confirming cell-cycle dependent protein regulation.

Figure 24B:
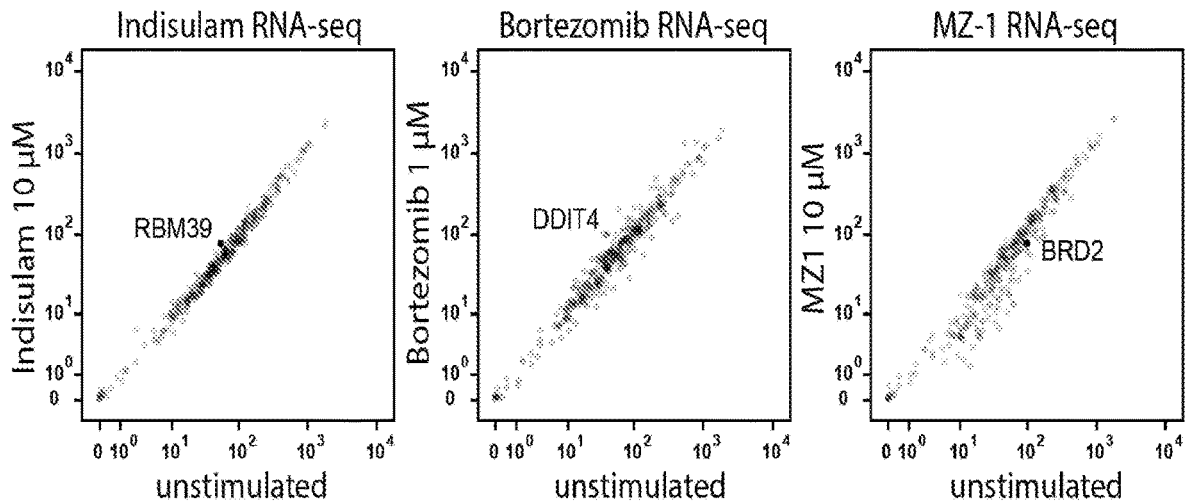
Figure 24C:
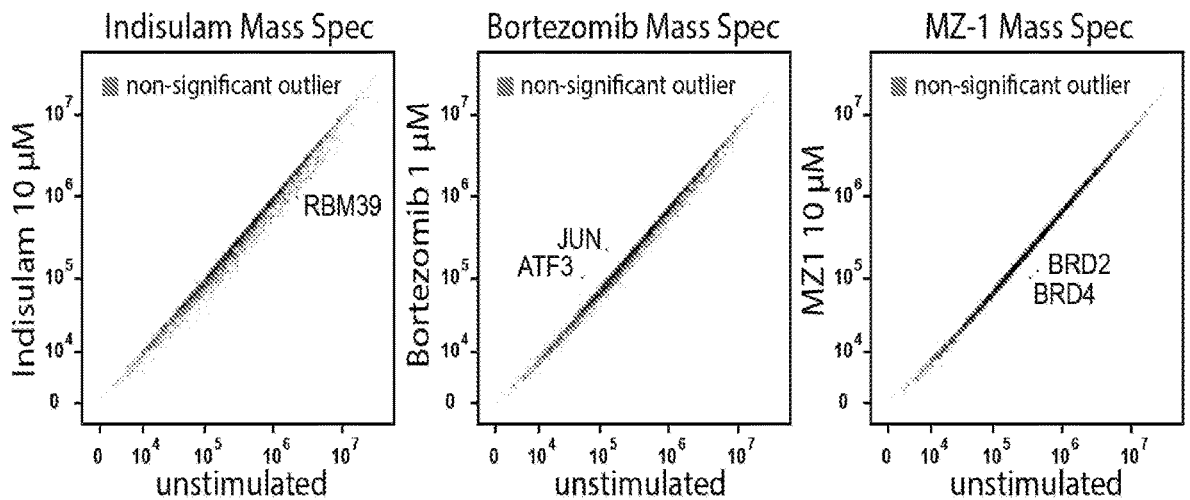
Figures 24D, 24E:
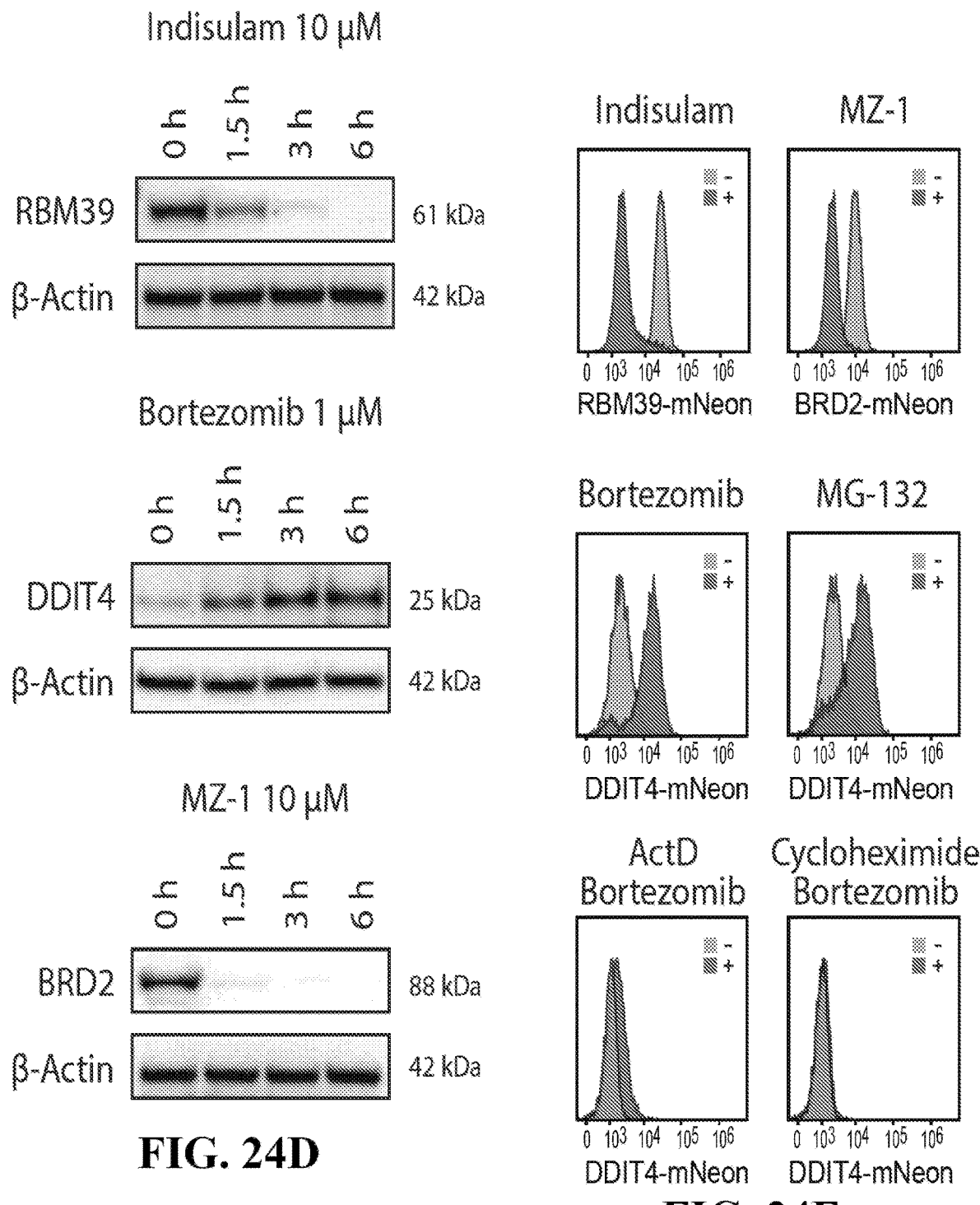

SBP can also help identify drug targets in a systematic manner, by highlighting proteins whose levels change following drug treatment, as many small-molecule drugs function by binding to and regulating cellular proteins. To this end, Applicants performed SBP using a tagging library stimulated with each of three drugs or DMSO as a control. Treatment with the first drug, Indisulam, which has shown anti-cancer activity in phase-II trials (Talbot, D. C. et al. A randomized phase II pharmacokinetic and pharmacodynamic study of indisulam as second-line therapy in patients with advanced non-small cell lung cancer. Clin Cancer Res 13, 1816-1822, doi: 10.1158/1078-0432.CCR-06-0249 (2007)), led to a highly specific depletion of the splicing factor RBM39 (FIG. 24a, left panel), which Applicants confirmed by western blot (FIG. 24d, top) and FACS of a clonal reporter cell line (FIG. 24e). Indeed, a recent study reported RBM39 degradation by Indisulam, which was discovered through studying resistance-conferring mutations in tumor cells (Han, T. et al. Anticancer sulfonamides target splicing by inducing RBM39 degradation via recruitment to DCAF15. Science 356, doi: 10.1126/science.aal3755 (2017)). Notably, SBP was highly specific: RBM39 was the only significantly depleted protein in two replicate runs (FIG. 30a, left), with a dramatically larger effect size than the next potentially depleted protein (−2.1 bins vs. −0.37 bins). This is in marked contrast to the effect at the RNA level, which showed no significant change in the level of RBM39 (FIG. 24b, left panel). In comparison, triplicate TMT-based whole proteome mass spectrometry also revealed RBM39 as a strong (2-fold down-regulated) but not statistically significant hit (FIG. 24c left, FIG. 30b, left).

Similarly, when cells were treated with another anticancer drug, the proteasome inhibitor Bortezomib, the topmost change by SBP was a strong increase (+1.6 bins) in the level of DDIT4 (FIG. 24a, middle), which, although not statistically significant in the SBP data, was confirmed by both western blot and FACS (FIG. 24d, middle, and FIG. 24e) and which is consistent with previous reports (Decaux, O. et al. Inhibition of mTORC1 activity by REDD1 induction in myeloma cells resistant to bortezomib cytotoxicity. Cancer Sci 101, 889-897, doi: 10.1111/j. 1349-7006.2009.01467.x (2010); and Barakat, D. J. et al. C/EBPbeta regulates sensitivity to bortezomib in prostate cancer cells by inducing REDD1 and autophagosome-lysosome fusion. Cancer Lett 375, 152-161, doi: 10.1016/j.canlet.2016.03.005 (2016)). Of note, Applicants also found DDIT4 to be regulated by MG-132, another proteasome inhibitor (FIG. 24e, middle right). Blocking transcription did not abolish DDIT4 up-regulation, whereas translation was required (FIG. 24e, bottom). Again, RNA-Seq could not identify DDIT4 as a target (FIG. 24b, middle), and quantitative mass spectrometry failed to quantify it, although two outliers were identified (ATF3 and JUN, neither of which are represented in the SBP library) (FIG. 24c, middle). Finally, SBP determined that the third drug, MZ-1, led to a significant decrease of its known degradation target BRD2 (Zengerle, M., Chan, K. H. & Ciulli, A. Selective Small Molecule Induced Degradation of the BET Bromodomain Protein BRD4. ACS Chem Biol 10, 1770-1777, doi: 10.1021/acschembio.5b00216 (2015)) (FIG. 24a, right, FIG. 30a, right), which Applicants confirmed by western blot and FACS (FIG. 24d, bottom, FIG. 24e). Although BRD2 could not be identified by RNA-Seq (FIG. 3b, right panel), it was a strong (2.3-fold down-regulated) albeit not statistically significant hit in mass spectrometry analysis, as was the related known target BRD4 (which is not represented in the SBP library) (FIG. 24c, FIG. 30b). All three of these proteins were tagged more than once in the library, and UMI sequencing confirmed that two or more independent clones showed altered protein levels (FIG. 31a). All regulated protein hits were observed in an independent replicate SBP screen (FIG. 31b).

Some cellular protein functions are regulated by protein localization, interaction, and/or modification. To demonstrate SBP's utility for such events, Applicants performed the same quantification protocol on purified nuclei from the cellular tagging library (FIG. 25a). Comparing the levels of protein in nuclei versus cells revealed a marked sub-population of predicted nuclear proteins (FIG. 25b), which matched literature reports for 58/61 clones (95.1%) and the confocal imaging of library clones for 16/16 (100%) of clones (FIG. 25c and FIG. 28).

SBP allows scalable and specific protein quantification and localization in single cells using commonly available laboratory equipment, providing a new tool for delineating the cellular responses induced by drugs, chemicals, endogenous signaling molecules, pathogens, irradiation, or specific genetic perturbations. SBP is scalable at all levels: cell libraries are generated by a pooled transfection approach, and screened in a pooled manner as well. Furthermore, the ability to seamlessly integrate SBP with additional fluorescence-based reporters for cellular states, such as cell cycle, offers a new approach for exploring the heterogeneity of populations of cells at the level of the proteome. SBP is specific and accurate, due to the redundancy of the library, which reduces false positives, a feature that could be further improved by scaling up the library complexity. Currently, uneven representation of genes in the library might be caused by a combination of gRNA-dependent IVT efficiency, gRNA-dependent Cas9 efficiency, gene expression allowing efficient G418 selection, and random sampling by starting with a limited number of cells.

SBP can be readily extended to other cell lines, and can thus generate diverse cell line resources. In some cases, it could also be applied in vivo, for example by generating a library ex vivo and transferring it into a mouse model, followed by cell isolation or by assays in situ (Feldman, D. et al. Pooled optical screens in human cells. bioRxiv, doi: 10.1101/383943 (2018)). An important enhancement would be to increase SBP's sensitivity, which is currently limited by fluorescence signal intensity over auto-fluorescence. This can be addressed by using a small epitope tag combined with antibody staining, which could also reduce possible impacts of tag addition to overall protein structure. Cas9 variants with engineered PAM recognition motifs matching the three stop codons TAG, TAA, and TGA would reduce the number of amino acids lost due to tagging to a maximum of one amino acid. Moreover, use of these PAM variants would expand the landscape of taggable proteins, which is currently restricted to ~94% of the human proteome because of the PAM requirement for targeting Cas9. By leveraging the power of next-generation sequencing, which has transformed our ability to monitor the genome and transcriptome, SBP opens the way for routine large-scale analysis of the proteome.

Example 10—Scalable Analysis of Proteome Dynamics Using Barcoded Gene Tagging

Cellular responses to the environment are ultimately defined by protein dynamics. Although RNA sequencing is a powerful tool that can be used as a proxy for understanding these dynamics, mapping the flow of information through cellular signaling pathways requires direct, scalable measurements of protein abundance, localization, and post-translational modification, which cannot be obtained through transcriptomics. To analyze these parameters, a number of methods have been developed based on either affinity reagents, tagged protein overexpression[1], or mass spectrometry [2]. However, high-quality validated antibodies or aptamers do not exist for all human proteins[3,4], tagged overexpression is inherently prone to causing artifacts, and whole-proteome mass spectrometry is technically challenging and has limited sensitivity[5]. In yeast, genome-scale protein tagging libraries have enabled powerful in-depth studies of the proteome[6,7], and there has been some progress toward systematically tagging genes in human cells lines[8-11], but the approaches that have been reported to date are low throughput and not amenable to pooled analyses, limiting their scalability. Applicants therefore sought to develop an approach that leveraged the accessibility of sequencing technology to directly readout protein dynamics to answer questions about protein stability, localization, and translation. To accomplish this, Applicants first generated a library of human cells containing thousands of protein-coding genes endogenously tagged with a fluorescent protein. In addition, each tag contains a silent identifier DNA sequence, which enables pooled screening approaches for downstream proteome analysis. By subjecting this library of tagged cells to FACS and sorting cells into bins ranging from low to high protein levels and then sequencing the silent identifiers in each bin, Applicants developed a scalable method, which Applicants call PATTERNS (Proteome Analysis Through Tagging Endogenous pRoteiNs and Sequencing), for assessing mammalian proteome dynamics in single cells.

To achieve the scalability needed for large-scale protein analysis, Applicants leveraged CRISPR-mediated NHEJ tagging to generate a polyclonal library of tagged HEK293T cells. Applicants adapted a Ligase-IV dependent approach[12,13] for pooled genome-scale library generation by optimizing the transfection of Cas9 RNPs loaded with a pool of guide RNAs spanning the human protein-coding genes and an mNeonGreen donor (FIGS. 32A and 26A-D). Applicants used 23,095 single guide RNAs (Table 2), each targeting as close as possible to the C-terminus given Cas9 PAM constraints, as it has been found that C-terminal tagging is generally less disruptive to protein expression and localization than N-terminal tagging[14]. The mNeonGreen donor also contains a silent random barcode within the coding sequence to allow efficient sequencing-based deconvolution of the library for downstream protein identification (FIG. 27). To assess successful tag integration, Applicants developed a tagmentation-based sequencing method (FIG. 32A) that efficiently identifies tag integration sites and their corresponding silent barcodes (FIG. 32B). Using this method, Applicants determined that among two library transfection replicates (FIG. 32C), the representation of tagged loci was highly correlated (FIG. 32D). In the combined library of cells, most tagged loci (72.9%) were represented by at least two independent tagging events (FIG. 32C). 11,290 out of 18,823 targeted protein-coding genes were successfully tagged, with an average loss of 5 amino acids per protein. Tagging frequencies weakly correlated with gene expression levels, as assessed by RNA-sequencing (FIG. 36B).

To develop PATTERNS, Applicants subjected the library of tagged cells to FACS, sorting cells into eight bins spaced equally based on fluorescence levels. Then Applicants sequenced the cells in each bin using the silent barcode to obtain a distribution of protein levels (FIG. 32A,E,F). Sorting the same library of cells twice gave highly reproducible distributions (FIG. 33F). Applicants used these distributions to obtain quantitative mean protein levels gauged by immunoblotting (FIG. 37). Although the majority of protein coding genes was successfully tagged in the library, the broad distribution of tagging efficiencies as well as technical limits imposed by FACS sorting could reduce the number of proteins reliably quantified by PATTERNS. To assess this, Applicants first ranked proteins by their representation in the library and then examined the correlation between the mean protein levels between two sorting replicates. Applicants found that PATTERNS could reproducibly quantify correlate up to 4,000 proteins (R=0.971) (FIG. 32G). Protein quantification results were also highly correlated for the overlapping top-1000 represented proteins between libraries of cells from two independent transfection replicates (FIG. 38A). Comparison of protein quantification results obtained with PATTERNS to RNA expression data showed poor correlation, as has been reported for other protein quantification data 15 (FIG. 38B).

A key advantage of PATTERNS is that it measures the distribution of protein levels in a population of single cells, allowing identification of proteins that are heterogeneously expressed. Applicants identified several proteins that clearly displayed broadened or bimodal distributions, suggesting these proteins are present at different levels in different cells (FIG. 33A). As the cell population was not synchronized, Applicants reasoned that proteins with bimodal distribution patterns may be cell-cycle regulated, and indeed, two of the identified hits, CDT1 and Geminin, are known cell-cycle regulated proteins employed as reporters in the two-color FUCCI system[16]. In addition to CDT1 and GMNN, RRM2 exhibited a bimodal abundance distribution, suggesting it is also cell-cycle regulated. Applicants validated this observation using an RRM2 reporter cell line, which recapitulated the bimodal abundance distribution and showed that RRM2 levels covary with cellular DNA content (FIG. 33B,C). Applicants synchronized cells and performed western blots on RRM2 as well as two additional heterogeneously expressed hits, ID4 and MIF, all three of which exhibited cell cycle-dependent fluctuations (FIG. 33D). Because fluorescence intensities can be normalized to absolute numbers of fluorophore molecules per cell, PATTERNS also allows comparisons between the relative abundance of groups of proteins (FIG. 37). For example, Applicants find mRNA binding proteins to be more abundant than transcription factors (FIG. 38C).

PATTERNS can also provide information about the localization of proteins, which has important ramifications for their function. Applicants performed PATTERNS on PFA-fixed purified nuclei to identify nuclear localized proteins in the library of tagged cells (FIG. 34A). Applicants detected 325 nuclear proteins (13% of all quantified proteins), including all represented histone proteins (FIG. 34B). Comparing the list of nuclear detected proteins to localization data based on antibody staining, nuclear mass spectrometry, and Hyper-LOPIT methods showed strong agreement (82-95%) for these 325 proteins (FIG. 34C). Applicants note however that very lowly expressed proteins may be missed by PATTERNS, in part due to loss of fluorescence during PFA fixation. To validate the localization results, Applicants imaged 43 tagged cell lines comprising a mix of nuclear and non-nuclear localized proteins and confirmed that PATTERNS correctly predicted the localization of 95% of the imaged proteins (FIG. 34D,E).

Applicants next applied PATTERNS to identify changes at the protein level in response to small molecules, a key goal of the pharmaceutical industry. Applicants first investigated the effects of the proteasome inhibitor Bortezomib, which is used to treat progressive multiple myeloma and has been reported to have a broad effect on the proteome 17 18. Applicants treated the library of tagged HEK293T cells with Bortezomib for 6 hours, and then FACS sorted and sequenced to identify proteins whose levels changed upon drug treatment. PATTERNS identified 55 proteins significantly affected by Bortezomib (FIG. 35A). Applicants confirmed four PATTERNS hits, DDIT4, ID1, ID2, and JUN, by western blot and FACS of reporter cell lines (FIG. 35D, and FIG. 39E, middle). DDIT4/REDD1 induction has been observed in response to various stresses (arsenic, hypoxia, heat shock, and DNA damage) and has been investigated as a resistance mechanism of cancer cells during Bortezomib treatment19,20. ID1 are ID2 are negative regulators of bHLH transcription factors21, which are known to be regulated by proteasomal degradation22. Similarly, the c-Jun oncoprotein is known to be destabilized due to proteasomal degradation23. Of the 55 PATTERNS hits, only GADD45B was regulated at the transcript level (FIG. 35B). Triplicate TMT-based whole proteome mass spectrometry revealed two upregulated proteins: JUN, which is among the top hits by PATTERNS, and ATF3, which is not represented in the library of tagged cells (FIG. 35C). Similarly, when Applicants applied PATTERNS to study MZ-1, a PROTAC drug that was designed to degrade BRD proteins 24, Applicants observed degradation of two BRD protein family members, BRD2 and BRD3, among 20 significantly affected proteins (FIG. 39A-E).

Applicants next took advantage of the scalability of PATTERNS to screen for small molecules that induce protein level changes in a high-throughput manner. To this end, Applicants stimulated the HEK293T library of tagged cells with 15 pools of small molecules, each containing 80 drug-like compounds (Table 3), for 6 hours. In Pool 4, PATTERNS identified two candidate proteins, RBM39 and DDIT4 (FIG. 35E). The level of DDIT4, which is a regulator of autophagy, was affected by Bortezomib as well as most of the drug pools, suggesting the change may be non-specific, and Applicants therefore focused only on RBM39 (FIG. 35A, 41). RBM39 was recently identified as the target of the anti-cancer drug Indisulam, which was found by screening cancer cell lines for drug resistance25. Indeed, treating the library of tagged cells with Indisulam alone and then performing PATTERNS showed specific depletion of RBM39 (FIG. 39F), which Applicants confirmed by western blot (FIG. 35H) and FACS of a clonal reporter cell line (FIG. 39E, top panel). Notably, PATTERNS was highly specific: after treatment with Indisulam, RBM39 was the only significantly depleted protein in two biological replicates (FIG. 40A, left). This is in marked contrast to the effect at the RNA level, which showed no significant change in the level of RBM39 (FIG. 35F). Whole proteome mass spectrometry also revealed RBM39 as a strong (2-fold down-regulated) but not statistically significant hit (FIG. 35G, FIG. 40B, left).

Treatment of the library of tagged cells with a second pool of small molecules, Pool 5, led to changes in several proteins, including MSH6 and PRKDC, which also co-appear in one other pool (FIG. 34I, FIG. 41). In contrast to RBM39, the compounds regulating MSH6 and PKRDC were not immediately evident from the published literature. Therefore, to identify the compounds responsible for the observed MSH6 protein level changes, Applicants generated a fluorescent MSH6 reporter cell line and assayed all single compounds from respective drug Pool 5 by FACS. Three Hsp90-inhibiting compounds were identified that led to downregulation of MSH6 (SNX2112, SNX-5422, and KW-2478) (FIG. 35J). Applicants investigated the kinetics of the reduction of MSH6 levels by treating cells with SNX2112, and Applicants saw a significant depletion in MSH6 levels in under two hours (FIG. 35K, left panel), which we also observed for PRKDC (FIG. 35K, right panel).

Figure 42A:
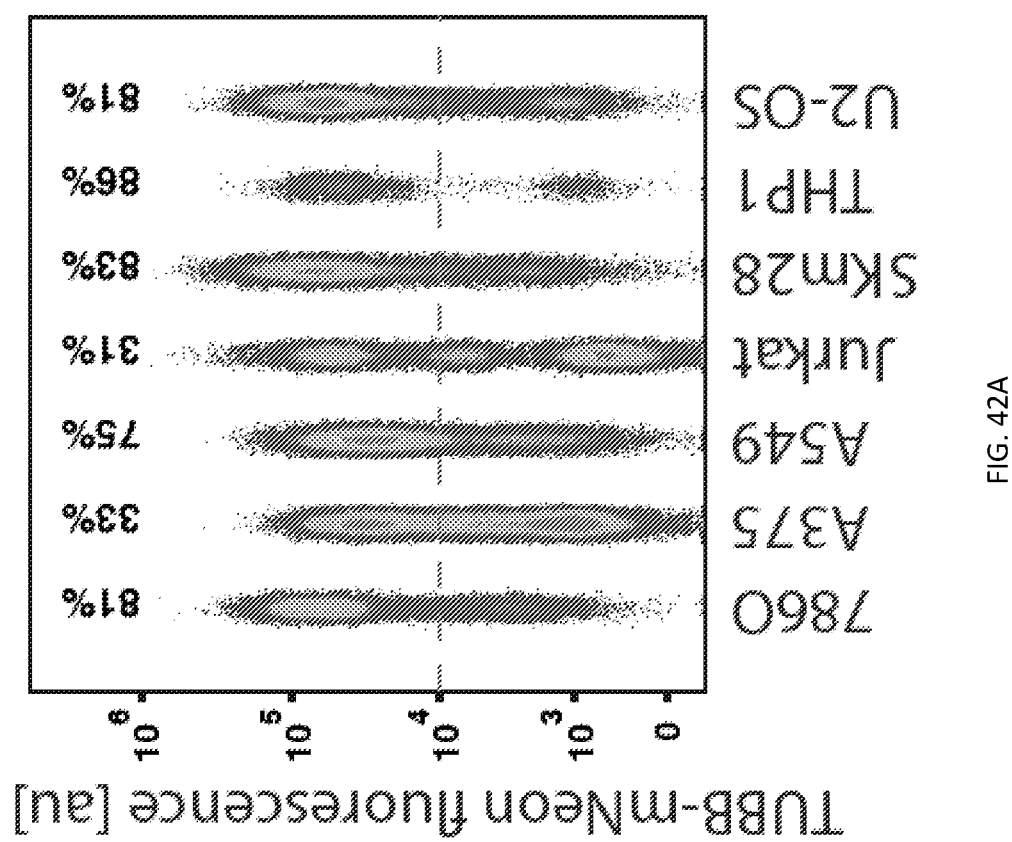

Finally, Applicants explored the feasibility of applying PATTERNS in other cells lines, which may be particularly useful for the identification of therapeutically-relevant proteins regulated by small molecules. Applicants therefore generated libraries of tagged cells in THP-1 monocytes and SKMEL28 melanoma cells by developing an electroporation protocol to achieve large-scale tagging in non-transfectable cell lines (FIG. 42A, B, F). Applicants then applied PATTERNS to these libraries of tagged cells to identify additional protein targets of small molecules. Treatment of tagged THP-1 monocytes for 6 hours with Phorbol 12-Myristate 13-Acetate (PMA) followed by PATTERNS revealed four proteins (out of 400 proteins represented in the THP-1 monocyte library) whose levels were altered by the treatment, including FOS and EGR1, which are known to be upregulated by PMA[26] (FIG. 42C-E). Similarly, PATTERNS-based quantification of 500 proteins in SKMEL28 melanoma cells revealed one protein downregulated after 6 hours of treatment with Vemurafenib (FIG. 42G-I). Together, these results demonstrate that scalable drug screening using PATTERNS in diverse cell types can provide a novel avenue to identification of specific protein degraders, which have the potential to greatly expand the range of targetable proteins[27].

PATTERNS allows quantification and localization of thousands of proteins in single cells using commonly available laboratory equipment, providing an accessible tool for delineating cellular responses at the protein level induced by chemicals, pathogens, or genetic perturbations. PATTERNS is scalable, rapid, and cost-efficient at all levels: cell libraries are generated and screened in a pooled fashion, while silent tag barcodes allow highly efficient library de-convolution using a simple PCR reaction and barcode sequencing. Furthermore, because most genes are tagged more than once during the library generation step, the resulting library of cells contains multiple clones with the same protein tagged, which creates a buffer against artifacts arising from cellular heterogeneity. Finally, PATTERNS provides information about how protein levels vary across individual cells, offering a new approach to understanding proteome dynamics at the single-cell level.

Currently, the sensitivity of PATTERNS is limited by fluorescence signal intensity over auto-fluorescence, which might be enhanced by using a small epitope tag combined with antibody staining. Such an approach could also reduce possible impacts on overall protein structure arising from addition of a fluorescent tag. Similarly, Cas9 variants with engineered PAM recognition motifs matching the three stop codons TAG, TAA, and TGA would reduce the number of amino acids lost due to tagging to a maximum of one amino acid. Moreover, use of these PAM variants would expand the landscape of taggable proteins through providing more flexibility to optimize guide design and by relaxing the PAM requirement currently restricting PATTERNS to ~94% of the human proteome.

Going forward, PATTERNS can be applied in a number of interesting ways. First, by overlaying PATTERNS data with transcriptomic data, such as in the drug screens, it is possible to rapidly distinguish between affects at the transcriptomic level from those that act on the level of protein stability and translation. Second, because a silent barcode identifier is incorporated into every tag, PATTERNS is compatible with multiplex in-situ barcode sequencing[28] and high-resolution microscopy, which will allow researchers to monitor thousands of proteins in live single cells in parallel. Third, in contrast to other proteomic approaches, cells can be subjected to PATTERNS multiple times, enabling monitoring of fluctuations in protein levels in single cells. Fourth, PATTERNS could be combined with a localization- or interaction-dependent fluorescent tag to enable large-scale studies of organellar protein localization or protein-protein interactions. By leveraging the power of next-generation sequencing, which has transformed our ability to monitor the genome and transcriptome, PATTERNS opens the way for routine large-scale analysis of proteome dynamics[19].

Example 11—Methods

Generation of sgRNA pools. DNA oligonucleotide pools with the sequence 5'-GCCAAGCATTTAGGTGACAC-TATAG-N20-GTTTCAGAGCTATGCTGGAAACAGC-3' were ordered from Twist Biosciences and resuspended in 30 µl of water (5 ng/µl), amplified using NEBNext polymerase (300 µl volume, 15 ng template, 8 cycles, Ta=65° C.) using primers SP6-fwd and gRNA-rev, and purified using a PCR purification column (Qiagen) (Sequences of genomic target site, adjacent mapping sequence, and oligonucleotide sequences are listed in Table 2 and SEQ ID NOs: 1-69285). 80 ng template product was used in a 20 µl IVT reaction (HiScribe SP6 kit, NEB) and incubated for 4 h at 37° C. RNA was purified using a PCR purification column (Qiagen), measured using a NanoDrop (Thermo) spectrometer, and re-annealed in 0.1× annealing buffer (IDT) by ramping from 95° C. to room temperature over 12 minutes.

Generation of donor DNA. Three separate PCRs were performed using NEBNext polymerase, with primers Donor-mNeon-UMI-PTO-fwd+0/+1/+2 and Donor-NeoR-PTO-rev (Table 1 and SEQ ID NOs: 69286-69328), template plasmid pCRISPaint-mNeon-T2A-NeoR (SEQ ID NO: 69341) for 30 cycles with Ta=65° C. PCR products were purified using 100 µl of PCR volume per PCR purification column (Qiagen). Typical yields were 5-10 µg DNA per column. Clean PCR products were verified using agarose gels and quantified using a NanoDrop spectrometer.

RNP-mediated gene tagging. 25,000 HEK293T NeoR-KO cells were plated per well in a 96-well plate. The next day, 100 ng SpCas9-3×NLS (IDT), 10 ng sgRNA, and 100 ng donor DNA were mixed with 25 µl OptiMEM (Thermo). In parallel, 0.5 µl Lipofectamine 2000 was mixed with 25 µl OptiMEM. After five minutes, both solutions were mixed and incubated for 20 minutes. 8 µl transfection mix were added per well in a 96-well plate. The cells were analyzed after two days of incubation. For the generation of complex tagging libraries, the protocol was scaled up linearly.

Library-scale RNP-mediated gene tagging. On day one, 18 million HEK293T NeoR-KO cells were plated per 15-cm dish into 32 dishes. On day two, 4 ml of scaled-up transfection mix (see above) were gently added per dish. On day seven, cells were trypsinized and re-plated in media containing 300 µg/ml G418 (Invivogen). The selection media was changed every 4-8 days. On day 25, the library was pre-enriched for detectable fluorescence by FACS sorting, gating on the top-30% mNeon-positive population. The library was expanded for a week and frozen for future use.

RNP-mediated gene tagging in other cell lines. Non-confluent cells were trypsinized and/or washed and adjusted to a density 2E7/ml in warm OptiMEM. 125 µl of cell suspension were mixed with 125 µl OptiMEM containing 2.5 µg donor DNA, 2.5 µg Cas9 protein, and 250 ng sgRNA. The mix was incubated for 15 minutes at room temperature, and transferred to a 4 mm electroporation cuvette (BioRad). Cells were electroporated on a Gene Pulser Xcell Electroporation System (BioRad) using the following settings: 265V, 975 µF, and 720 Ohm. Cells were recovered immediately in 5 ml of pre-warmed growth medium. For library generation in THP-1 and SKMEL28 cells, the above protocol was scaled up 10-fold.

Antibiotic selection. Puromycin was added to a final concentration of 3 µg/ml (4 days), Blasticidin was added to a final concentration of 15 µg/ml (4 days), or G418 was added to a final concentration of 300 µg/ml (7 days). Selection was carried out for 4 days. During G418 selection, cells were replated once every three days.

Transposition-based Tag Integration Site Sequencing (TTISS). 800,000 cells were resuspended in 80 µl direct lysis buffer (1 mM CaCl$_2$), 3 mM MgCl$_2$, 1 mM EDTA, 1% Triton X-100, 10 mM Tris pH 7.5, 0.2 mg/ml Proteinase K), lysed at 65° C. for 10 minutes, and kept on ice or frozen at −20° C. 25 µl 5×TAPS buffer (50 mM TAPS-NaOH pH 8.5, 25 mM MgCl$_2$), and 21 µl transposon-loaded Tn5 (16 mg/ml, produced as described in Picelli, S. et al. Tn5 transposase and tagmentation procedures for massively scaled sequencing projects. Genome Res 24, 2033-2040, doi: 10.1101/gr.177881.114 (2014), titrated batch-wise for optimal fragment sizes) were added, mixed well, and incubated at 55° C. for 10 minutes. The reaction was mixed with 625 µl buffer PB (Qiagen) and purified using a plasmid miniprep column (Qiagen). Typical yields were 15 µg per column. The tagmentation size distribution was verified on an agarose gel to range from 200 bp to 1 kb. All DNA from a single column was used as template in a 300 µl KOD extreme hot start PCR (Roche) with primers TTISS-mNeon-fwd1 and Tn5-Loading-R2 (Table 1), 12 cycles, Ta=60° C. 6 µl of PCR reaction was used as template in a secondary 50 µl KOD extreme hot start PCR with a unique combination of barcoded primers TTISS-mNeon-fwd2-D50× and TTISS-rev2-D70x(Table 1), 20 cycles, Ta=65° C. Barcoded PCRs were pooled on ice, purified using a PCR column (Qiagen), and run on an agarose gel. Products of 250 bp-1 kb were excised, purified using a gel purification kit (Qiagen), and re-purified using a PCR column (Qiagen). Samples were quantified using a NanoDrop spectrometer and sequenced using a NextSeq High Output kit (Illumina) with 30% PhiX spike-in and the following read settings: 120 cycles read 1, 25 cycles read 2, 8 cycles index 1, and 8 cycles index 2.

TTISS data analysis. For whole-genome tagging detection, 25 bp forward (fwd) reads and 25 bp reverse (rev) reads were mapped to the human genome sequence (hg38) using BrowserGenome.org while not allowing mismatches. For silent barcode dictionary generation, 25 bp fwd reads and 25 bp rev reads were mapped to 75 bp windows of the human genome sequence (hg38) upstream of all gRNA target sites of the library while not allowing mismatches, and hits were filtered to be in-frame with the annotated overlapping ORF (RefSeq). Silent barcode bases from successfully mapped reads were extracted and converted to a 28-bit hash value, which was stored in a table together with its target gene information. When quantifying unique library coverage, barcodes with a Hamming distance of 1 were collapsed in order to account for sequencing errors. All software was written as interactive web tools in JavaScript that is available online.

Alternatively, 22 bp forward (fwd) reads and 8 bp reverse (rev) reads were aligned to 1 kb windows of the human genomic sequence (hg38) upstream of gRNA target sites not allowing mismatches, and hits were filtered to be in-frame with the annotated ORF (RefSeq). For gRNA-wise protein quantification, counts per gRNA from six adjacent sorted bins were used to calculate the weighted mean bin and variance. For UMI-based evaluation, a dictionary of UMIs was created per sequencing run by calculating a 28-bit hash of nine UMI bases together with one constant donor base and 22 target bases from successfully aligned fwd reads using the same alignment parameters as for gRNA-wise protein quantification. The hash was used to count UMI occurrences and store UMI sequence/target information in an array with typically below 10 conflicts per run. UMIs were collapsed with an edit distance of 1 in order to account for sequencing errors. The UMI dictionary was used to count bin- and UMI-wise reads using the same hash function. Counts per UMI from six adjacent sorted bins were used to calculate the weighted mean bin and variance. All software was written as interactive web tools in JavaScript and will be available through GitHub.

Microscopy. Cells were seeded on glass bottom 96-well plates two days before imaging. The medium was changed to FluoroBrite DMEM (Thermo), and images were acquired using a Nikon Eclipse Ti spinning disc confocal microscope (CSU-W1, Yokogawa) using a 40× water immersion objective.

Analytical flow cytometry. For optional genomic DNA staining, 1/20 volume of Hoechst 33342 (10 mg/ml, Thermo) was added to live cells for 15 minutes at 37° C. Cells were washed in PBS, trypsinized, resuspended in media, and analyzed on a CytoFLEX (Beckman Coulter) in 96-well plate mode.

Nuclei preparation for FACS sorting. A 15-cm dish of cells were trypsinized, PBS washed, re-suspended in 2 ml hypotonic buffer and kept on ice for 20 minutes. Cells were fixed by re-suspending, adding 280 µl ice-cold PFA 4%, thoroughly mixing, and incubating on ice for exactly one minute. 100 µl 10% NP-40 were added, the suspension was vortexed for 10 seconds, and was kept on ice for 10 minutes. 600 µl 5% BSA in PBS were added, nuclei were spun down for 5 minutes at 200 g, and were re-suspended in PBS.

FACS sorting. Cells were trypsinized, washed in Fluoro-Brite DMEM Media (Thermo) and sorted using a Sony MA900 (where not denoted otherwise) or a MoFlo Astrios sorter (for THP-1 screens, THP-1 screens, SKMEL28 screens) using a 488 nm laser. Cells were collected in 1 ml growth medium and kept on ice until pelleting and lysis.

De-convolution of sorted libraries using Silent Barcode Sequencing. Cells or nuclei were spun down and re-suspended in at least 100 µl direct lysis buffer (1 mM CaCl$_2$, 3 mM MgCl$_2$, 1 mM EDTA, 1% Triton X-100, 10 mM Tris pH 7.5, 0.2 mg/ml Proteinase K) per 1 million cells/nuclei. Samples were heated to 65° C. for 10 minutes (except in the case of nucleI, which were heated for 1 h), and subsequently incubated at 95° C. for 15 minutes. 100 µl first PCR reactions were performed using NEBNext (NEB), 40 µl lysate per reaction, primers PATTERNS-seq-fwd and PATTERNS-seq-rev (Table 1), and cycling parameters: 16 cycles, 30 seconds elongation time, 65° C. annealing temperature. 25 µl secondary PCR reactions were performed using 4 µl first PCR reaction as a template, a unique Illumina-fwd-D50× and Illumina-rev-D70× barcode primer combination (Table 1) and equal cycling conditions. PCR products were pooled, purified, and sequenced as described above for TTISS sequencing (76-cycle single-end high-output NextSeq run with dual-indexing).

Analysis of Silent Barcode Sequencing data. Silent barcode bases were extracted from raw sequencing reads and were converted to a 28-bit integer value. Using a barcode lookup table, reads were collapsed into target loci, and a matrix of screening conditions vs. sorted bins was incremented for every successfully mapped read. Total read counts in every position of the matrix were normalized by the ratio of sorted cells (from control sort for simplification) divided by total reads with correctly mapped 10 bp reverse primer sequence, which helped to even out PCR saturation artifacts. For calculating mean protein levels, normalized barcode coverage across eight sorted bins is used to calculate a linearly weighted average of previously determined bin-wise protein levels, which can be relative quantitative (e.g., arbitrary fluorescence units from FACS re-analysis of sorted bins), or absolute estimated numbers of molecules per cell. All data were analyzed using a custom JavaScript-based analysis tool that is available online.

Immunoblotting. Cells were lysed in 6-well plates in 400 µl 2×LDS buffer (Thermo) supplemented with 2×Bolt reducing agent (Thermo), heated to 95° C. for 15 minutes, and cooled on ice. 9 µl lysate was loaded per lane of Bolt 4-12% Bis-Tris Plus gels (Thermo) and run at 100 V for 1:15 h. Blotting was performed using the iBlot PVDF kit (Thermo) and program P-3 for 4 minutes. After blocking for 1 h in TBST 5% BSA, primary antibodies were bound over night at 4° C. in TBST 5% BSA. After triple washing, HRP-conjugated secondary antibodies (Cell Signaling Technology) were bound at 1:5000 dilution in TBST 5% BSA for 1 h at room temperature. Blots were imaged using Pierce ECL (Thermo) on a Chemidoc luminescence imager (Biorad). Primary antibodies used were: RBM39 clone 4G8 (Novus Biologicals), DDIT4 clone EPR18716 (Abcam), BRD2 clone D89B4 (Cell Signaling Technology), RRM2 clone 1E1 (Sigma), HRP-coupled beta-Actin clone 13E5 (Cell Signaling Technology), and cell cycle antibody cocktail (ab136810, Abcam).

Cell cycle synchronization. 625,000 HEK293T cells were plated per 6-well plate in medium supplemented with 3.5 mM Thymidine (Sigma). After 19 h, cells were washed twice in PBS and grown in medium for 9 h. Then, the medium was changed back to 3.5 mM Thymidine for 15 h, cells were washed twice in PBS, and cells were grown in medium. Western blot lysates were obtained every two hours after washing individual wells with PBS and kept frozen at −20° C.

RNA-seq. Whole-cell RNA was purified using an RNeasy Plus Mini Kit (Qiagen). Poly (A) mRNA was enriched using the Poly(A) mRNA Magnetic Isolation Module (NEB). Sequencing libraries were prepared using the NEBNext Ultra II Directional RNA Library Prep kit (NEB), quantified using a NanoDrop (Thermo), and sequenced on the NextSeq sequencer (Illumina). Reads were aligned to the human genome and gene expression was quantified using the online tool BrowserGenome.org (Schmid-Burgk, J. L. & Hornung, V. BrowserGenome.org: web-based RNA-seq data analysis and visualization. Nat Methods 12, 1001, doi: 10.1038/nmeth.3615 (2015)).

Mass spectrometry. Cells were grown and stimulated in 10 cm dishes, washed three times in cold PBS, and scraped into 1 ml 8 M urea in water per dish. Protein content of the lysates was quantified using Pierce 660 reagent and a NanoDrop spectrometer. Samples were reduced, iodoacetamide alkylated, digested with Trypsin, labeled with 10-plex TMT (VWR cat no PI90110), and combined. After SPE clean-up and volume reduction by SpeedVac, the combined sample was run on a C18 reverse phase LC using a pH 10 A buffer, and eight fractions were collected. The volume was reduced to 20 µl by SpeedVac. Each fraction was run on an EASY nLC HPLC attached to a Thermo QE-HFX mass spectrometer in nanospray configuration using a 90 minutes acquisition time. Proteins were quantified using the MaxQuant software package.

Statistical analysis. Mass spectrometry reporter intensity data were imported into Perseus software, log-2-transformed, and filtered for missing values as well as reverse peptides or potential contaminants. Data were median-subtracted and significant outliers were determined by performing two-sided unpaired t-tests, correcting for multiple testing using an FDR=5% and s0=0.1, performing 250 randomizations. PATTERNS mean protein level bin data were processed in the same way except without the filtering and normalization steps. Volcano plots were generated using the Perseus software, and all other plots were created using custom code.

Tables:

TABLE 1

Primers

| Primer name | SEQ ID NO: | Sequence |
|---|---|---|
| Donor-mNeon-PTO-fwd +0 | 69286 | /5phos/G*G*C* GGC TCT GGT GGC AGT GGA GGN GGN TCN GTN TCN AAR GGN GAR GAR GAY AAY GCN TCN CTN CCA G |
| Donor-mNeon-PTO-fwd +1 | 69287 | /5phos/C* G*G*C TCT GGT GGC AGT GGA GGN GGN TCN GTN TCN AAR GGN GAR GAR GAY AAY GCN TCN CTN CCA G |
| Donor-mNeon-PTO-fwd +2 | 69288 | /5phos/G*C* G*GC TCT GGT GGC AGT GGA GGN GGN TCN GTN TCN AAR GGN GAR GAR GAY AAY GCN TCN CTN CCA G |
| Donor-NeoR-PTO-rev | 69289 | /5phos/T*T*A TCAGAAGAACTCGTCAAGAAGGC |
| Tn5-Loading-R2 | 69290 | GTCTCGTGGGCTCGG AGATGTGTATAAGAGACAG |
| Tn5-loading-ME | 69291 | /5Phos/CTGTCTCTTATACA/3ddC/ |
| TTISS-mNeon-fwd1 | 69292 | CCGTTGATGGAGCCAAAGATGTG |
| TTISS-mNeon-fwd2-D501 | 69293 | AATGATACGGCGACCACCGAGATCTACACTATAGCCTACACTCTTTCCCTACACGAC Gctcttccgatct ATGTGTAACTCATGTGTCGCTGG |
| TTISS-nn Neon-fwd2-D502 | 69294 | AATGATACGGCGACCACCGAGATCTACACATAGAGGCACACTCTTTCCCTACACGAC Gctcttccgatct ATGTGTAACTCATGTGTCGCTGG |
| TTISS-rev2-D701 | 69295 | CAAGCAGAAGACGGCATACGAGATCGAGTAAT GTCTCGTGGGCTCGGAGATGTGT |
| TTISS-rev2-D702 | 69296 | CAAGCAGAAGACGGCATACGAGATTCTCCGGA GTCTCGTGGGCTCGGAGATGTGT |
| TTISS-rev2-D703 | 69297 | CAAGCAGAAGACGGCATACGAGATAATGAGCG GTCTCGTGGGCTCGGAGATGTGT |

TABLE 1-continued

Primers

| Primer name | SEQ ID NO: | Sequence |
|---|---|---|
| TTISS-rev2-D704 | 69298 | CAAGCAGAAGACGGCATACGAGATGGAATCTC GTCTCGTGGGCTCGGAGATGTGT |
| TTISS-rev2-D705 | 69299 | CAAGCAGAAGACGGCATACGAGATTTCTGAAT GTCTCGTGGGCTCGGAGATGTGT |
| TTISS-rev2-D706 | 69300 | CAAGCAGAAGACGGCATACGAGATACGAATTC GTCTCGTGGGCTCGGAGATGTGT |
| TTISS-rev2-D707 | 69301 | CAAGCAGAAGACGGCATACGAGATAGCTTCAG GTCTCGTGGGCTCGGAGATGTGT |
| TTISS-rev2-D708 | 69302 | CAAGCAGAAGACGGCATACGAGATGCGCATTA GTCTCGTGGGCTCGGAGATGTGT |
| TTISS-rev2-D709 | 69303 | CAAGCAGAAGACGGCATACGAGATCATAGCCG GTCTCGTGGGCTCGGAGATGTGT |
| TTISS-rev2-D710 | 69304 | CAAGCAGAAGACGGCATACGAGATTTCGCGGA GTCTCGTGGGCTCGGAGATGTGT |
| TTISS-rev2-D711 | 69305 | CAAGCAGAAGACGGCATACGAGATGCGCGAGA GTCTCGTGGGCTCGGAGATGTGT |
| TTISS-rev2-D712 | 69306 | CAAGCAGAAGACGGCATACGAGATCTATCGCT GTCTCGTGGGCTCGGAGATGTGT |
| PATTERNS-seq-fwd | 69307 | ACACTCTTTCCCTACACGACGCTCTTCCGATCT GATGTGTAACTCATGTGTCGCTG |
| PATTERNS-seq-rev | 69308 | TGACTGGAGTTCAGACGTGTGCTCTTCCGATCTCGGCTCTGGTGGCAGTGGAGG |
| Illumina-fwd-D501 | 69309 | AATGATACGGCGACCACCGAGATCTACACTATAGCCTACACTCTTTCCCTACACGACGCT |
| Illumina-fwd-D502 | 69310 | AATGATACGGCGACCACCGAGATCTACACATAGAGGCACACTCTTTCCCTACACGACGCT |
| Illumina-fwd-D503 | 69311 | AATGATACGGCGACCACCGAGATCTACACCCTATCCTACACTCTTTCCCTACACGACGCT |
| Illumina-fwd-D504 | 69312 | AATGATACGGCGACCACCGAGATCTACACGGCTCTGAACACTCTTTCCCTACACGACGCT |
| Illumina-fwd-D505 | 69313 | AATGATACGGCGACCACCGAGATCTACACAGGCGAAGACACTCTTTCCCTACACGACGCT |
| Illumina-fwd-D506 | 69314 | AATGATACGGCGACCACCGAGATCTACACTAATCTTAACACTCTTTCCCTACACGACGCT |
| Illumina-fwd-D507 | 69315 | AATGATACGGCGACCACCGAGATCTACACCAGGACGTACACTCTTTCCCTACACGACGCT |
| Illumina-fwd-D508 | 69316 | AATGATACGGCGACCACCGAGATCTACACGTACTGACACACTCTTTCCCTACACGACGCT |
| Illumina-rev-D701 | 69317 | CAAGCAGAAGACGGCATACGAGATCGAGTAATGTGACTGGAGTTCAGACGTGTGCT |
| Illumina-rev-D702 | 69318 | CAAGCAGAAGACGGCATACGAGATTCTCCGGAGTGACTGGAGTTCAGACGTGTGCT |
| Illumina-rev-D703 | 69319 | CAAGCAGAAGACGGCATACGAGATAATGAGCGGTGACTGGAGTTCAGACGTGTGCT |
| Illumina-rev-D704 | 69320 | CAAGCAGAAGACGGCATACGAGATGGAATCTCGTGACTGGAGTTCAGACGTGTGCT |
| Illumina-rev-D705 | 69321 | CAAGCAGAAGACGGCATACGAGATTTCTGAATGTGACTGGAGTTCAGACGTGTGCT |
| Illumina-rev-D706 | 69322 | CAAGCAGAAGACGGCATACGAGATACGAATTCGTGACTGGAGTTCAGACGTGTGCT |
| Illumina-rev-D707 | 69323 | CAAGCAGAAGACGGCATACGAGATAGCTTCAGGTGACTGGAGTTCAGACGTGTGCT |
| Illumina-rev-D708 | 69324 | CAAGCAGAAGACGGCATACGAGATGCGCATTAGTGACTGGAGTTCAGACGTGTGCT |
| Illumina-rev-D709 | 69325 | CAAGCAGAAGACGGCATACGAGATCATAGCCGGTGACTGGAGTTCAGACGTGTGCT |

TABLE 1-continued

Primers

| Primer name | SEQ ID NO: | Sequence |
|---|---|---|
| Illumina-rev-D710 | 69326 | CAAGCAGAAGACGGCATACGAGATTTCGCGGAGTGACTGGAGTTCAGACGTGTGCT |
| Illumina-rev-D711 | 69327 | CAAGCAGAAGACGGCATACGAGATGCGCGAGAGTGACTGGAGTTCAGACGTGTGCT |
| Illumina-rev-D712 | 69328 | CAAGCAGAAGACGGCATACGAGATCTATCGCTGTGACTGGAGTTCAGACGTGTGCT |

TABLE 2

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| A*01:01:01:01 | 1 | 23096 | 46191 |
| A*03:01:0:01 | 2 | 23097 | 46192 |
| A1BG | 3 | 23098 | 46193 |
| A1CF | 4 | 23099 | 46194 |
| A2M | 5 | 23100 | 46195 |
| A2ML1 | 6 | 23101 | 46196 |
| A3GALT2 | 7 | 23102 | 46197 |
| A4GALT | 8 | 23103 | 46198 |
| A4GNT | 9 | 23104 | 46199 |
| AAAS | 10 | 23105 | 46200 |
| AACS | 11 | 23106 | 46201 |
| AACS | 12 | 23107 | 46202 |
| AADAC | 13 | 23108 | 46203 |
| AADACL2 | 14 | 23109 | 46204 |
| AADACL3 | 15 | 23110 | 46205 |
| AADACL4 | 16 | 23111 | 46206 |
| AADAT | 17 | 23112 | 46207 |
| AAED1 | 18 | 23113 | 46208 |
| AAGAB | 19 | 23114 | 46209 |
| AAK1 | 20 | 23115 | 46210 |
| AAMDC | 21 | 23116 | 46211 |
| AAMDC | 22 | 23117 | 46212 |
| AAMDC | 23 | 23118 | 46213 |
| AAMP | 24 | 23119 | 46214 |
| AANAT | 25 | 23120 | 46215 |
| AAR2 | 26 | 23121 | 46216 |
| AARD | 27 | 23122 | 46217 |
| AARS | 28 | 23123 | 46218 |
| AARS2 | 29 | 23124 | 46219 |
| AARSD1 | 30 | 23125 | 46220 |
| AASDH | 31 | 23126 | 46221 |
| AASDH | 32 | 23127 | 46222 |
| AASDH | 33 | 23128 | 46223 |
| AASDHPPT | 34 | 23129 | 46224 |
| AASS | 35 | 23130 | 46225 |
| AATF | 36 | 23131 | 46226 |
| AATK | 37 | 23132 | 46227 |
| ABAT | 38 | 23133 | 46228 |
| ABCA1 | 39 | 23134 | 46229 |
| ABCA10 | 40 | 23135 | 46230 |
| ABCA12 | 41 | 23136 | 46231 |
| ABCA13 | 42 | 23137 | 46232 |
| ABCA2 | 43 | 23138 | 46233 |
| ABCA3 | 44 | 23139 | 46234 |
| ABCA4 | 45 | 23140 | 46235 |
| ABCA5 | 46 | 23141 | 46236 |
| ABCA6 | 47 | 23142 | 46237 |
| ABCA7 | 48 | 23143 | 46238 |
| ABCA8 | 49 | 23144 | 46239 |
| ABCA9 | 50 | 23145 | 46240 |
| ABCB1 | 51 | 23146 | 46241 |
| ABCB10 | 52 | 23147 | 46242 |
| ABCB11 | 53 | 23148 | 46243 |
| ABCB4 | 54 | 23149 | 46244 |
| ABCB5 | 55 | 23150 | 46245 |
| ABCB5 | 56 | 23151 | 46246 |
| ABCB5 | 57 | 23152 | 46247 |
| ABCB6 | 58 | 23153 | 46248 |
| ABCB7 | 59 | 23154 | 46249 |
| ABCB8 | 60 | 23155 | 46250 |
| ABCB9 | 61 | 23156 | 46251 |
| ABCB9 | 62 | 23157 | 46252 |
| ABCC1 | 63 | 23158 | 46253 |
| ABCC10 | 64 | 23159 | 46254 |
| ABCC11 | 65 | 23160 | 46255 |
| ABCC12 | 66 | 23161 | 46256 |
| ABCC2 | 67 | 23162 | 46257 |
| ABCC3 | 68 | 23163 | 46258 |
| ABCC3 | 69 | 23164 | 46259 |
| ABCC4 | 70 | 23165 | 46260 |
| ABCC4 | 71 | 23166 | 46261 |
| ABCC5 | 72 | 23167 | 46262 |
| ABCC5 | 73 | 23168 | 46263 |
| ABCC6 | 74 | 23169 | 46264 |
| ABCC6 | 75 | 23170 | 46265 |
| ABCC8 | 76 | 23171 | 46266 |
| ABCC9 | 77 | 23172 | 46267 |
| ABCC9 | 78 | 23173 | 46268 |
| ABCD1 | 79 | 23174 | 46269 |
| ABCD2 | 80 | 23175 | 46270 |
| ABCD3 | 81 | 23176 | 46271 |
| ABCD3 | 82 | 23177 | 46272 |
| ABCD4 | 83 | 23178 | 46273 |
| ABCD4 | 84 | 23179 | 46274 |
| ABCD4 | 85 | 23180 | 46275 |
| ABCE1 | 86 | 23181 | 46276 |
| ABCF1 | 87 | 23182 | 46277 |
| ABCF2 | 88 | 23183 | 46278 |
| ABCF2 | 89 | 23184 | 46279 |
| ABCF3 | 90 | 23185 | 46280 |
| ABCG1 | 91 | 23186 | 46281 |
| ABCG2 | 92 | 23187 | 46282 |
| ABCG2 | 93 | 23188 | 46283 |
| ABCG4 | 94 | 23189 | 46284 |
| ABCG5 | 95 | 23190 | 46285 |
| ABCG8 | 96 | 23191 | 46286 |
| ABHD1 | 97 | 23192 | 46287 |
| ABHD10 | 98 | 23193 | 46288 |
| ABHD10 | 99 | 23194 | 46289 |
| ABHD11 | 100 | 23195 | 46290 |
| ABHD11 | 101 | 23196 | 46291 |
| ABHD11 | 102 | 23197 | 46292 |
| ABHD12 | 103 | 23198 | 46293 |
| ABHD12 | 104 | 23199 | 46294 |
| ABHD12B | 105 | 23200 | 46295 |
| ABHD13 | 106 | 23201 | 46296 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| ABHD14A | 107 | 23202 | 46297 |
| ABHD14B | 108 | 23203 | 46298 |
| ABHD15 | 109 | 23204 | 46299 |
| ABHD16A | 110 | 23205 | 46300 |
| ABHD16B | 111 | 23206 | 46301 |
| ABHD17A | 112 | 23207 | 46302 |
| ABHD17B | 113 | 23208 | 46303 |
| ABHD17C | 114 | 23209 | 46304 |
| ABHD18 | 115 | 23210 | 46305 |
| ABHD2 | 116 | 23211 | 46306 |
| ABHD3 | 117 | 23212 | 46307 |
| ABHD4 | 118 | 23213 | 46308 |
| ABHD5 | 119 | 23214 | 46309 |
| ABHD6 | 120 | 23215 | 46310 |
| ABHD8 | 121 | 23216 | 46311 |
| ABI1 | 122 | 23217 | 46312 |
| ABI2 | 123 | 23218 | 46313 |
| ABI3 | 124 | 23219 | 46314 |
| ABI3BP | 125 | 23220 | 46315 |
| ABL1 | 126 | 23221 | 46316 |
| ABL2 | 127 | 23222 | 46317 |
| ABL2 | 128 | 23223 | 46318 |
| ABLIM1 | 129 | 23224 | 46319 |
| ABLIM2 | 130 | 23225 | 46320 |
| ABLIM2 | 131 | 23226 | 46321 |
| ABLIM3 | 132 | 23227 | 46322 |
| ABLIM3 | 133 | 23228 | 46323 |
| ABO | 134 | 23229 | 46324 |
| ABR | 135 | 23230 | 46325 |
| ABR | 136 | 23231 | 46326 |
| ABRA | 137 | 23232 | 46327 |
| ABRACL | 138 | 23233 | 46328 |
| ABRAXAS1 | 139 | 23234 | 46329 |
| ABRAXAS2 | 140 | 23235 | 46330 |
| ABT1 | 141 | 23236 | 46331 |
| ABTB1 | 142 | 23237 | 46332 |
| ABTB2 | 143 | 23238 | 46333 |
| ACAA1 | 144 | 23239 | 46334 |
| ACAA2 | 145 | 23240 | 46335 |
| ACACA | 146 | 23241 | 46336 |
| ACACB | 147 | 23242 | 46337 |
| ACAD10 | 148 | 23243 | 46338 |
| ACAD11 | 149 | 23244 | 46339 |
| ACAD8 | 150 | 23245 | 46340 |
| ACAD9 | 151 | 23246 | 46341 |
| ACADL | 152 | 23247 | 46342 |
| ACADM | 153 | 23248 | 46343 |
| ACADS | 154 | 23249 | 46344 |
| ACADSB | 155 | 23250 | 46345 |
| ACADVL | 156 | 23251 | 46346 |
| ACAN | 157 | 23252 | 46347 |
| ACAP1 | 158 | 23253 | 46348 |
| ACAP2 | 159 | 23254 | 46349 |
| ACAP3 | 160 | 23255 | 46350 |
| ACAT1 | 161 | 23256 | 46351 |
| ACAT2 | 162 | 23257 | 46352 |
| ACBD3 | 163 | 23258 | 46353 |
| ACBD4 | 164 | 23259 | 46354 |
| ACBD4 | 165 | 23260 | 46355 |
| ACBD4 | 166 | 23261 | 46356 |
| ACBD5 | 167 | 23262 | 46357 |
| ACBD5 | 168 | 23263 | 46358 |
| ACBD6 | 169 | 23264 | 46359 |
| ACBD7 | 170 | 23265 | 46360 |
| ACCS | 171 | 23266 | 46361 |
| ACCSL | 172 | 23267 | 46362 |
| ACD | 173 | 23268 | 46363 |
| ACE | 174 | 23269 | 46364 |
| ACE2 | 175 | 23270 | 46365 |
| ACER1 | 176 | 23271 | 46366 |
| ACER2 | 177 | 23272 | 46367 |
| ACER3 | 178 | 23273 | 46368 |
| ACER3 | 179 | 23274 | 46369 |
| ACHE | 180 | 23275 | 46370 |
| ACHE | 181 | 23276 | 46371 |
| ACIN1 | 182 | 23277 | 46372 |
| ACKR1 | 183 | 23278 | 46373 |
| ACKR2 | 184 | 23279 | 46374 |
| ACKR3 | 185 | 23280 | 46375 |
| ACKR4 | 186 | 23281 | 46376 |
| ACLY | 187 | 23282 | 46377 |
| ACMSD | 188 | 23283 | 46378 |
| ACO1 | 189 | 23284 | 46379 |
| ACO2 | 190 | 23285 | 46380 |
| ACOD1 | 191 | 23286 | 46381 |
| ACOT11 | 192 | 23287 | 46382 |
| ACOT11 | 193 | 23288 | 46383 |
| ACOT12 | 194 | 23289 | 46384 |
| ACOT13 | 195 | 23290 | 46385 |
| ACOT2 | 196 | 23291 | 46386 |
| ACOT4 | 197 | 23292 | 46387 |
| ACOT6 | 198 | 23293 | 46388 |
| ACOT7 | 199 | 23294 | 46389 |
| ACOT8 | 200 | 23295 | 46390 |
| ACOT9 | 201 | 23296 | 46391 |
| ACOX1 | 202 | 23297 | 46392 |
| ACOX2 | 203 | 23298 | 46393 |
| ACOX3 | 204 | 23299 | 46394 |
| ACOX3 | 205 | 23300 | 46395 |
| ACOXL | 206 | 23301 | 46396 |
| ACP1 | 207 | 23302 | 46397 |
| ACP1 | 208 | 23303 | 46398 |
| ACP2 | 209 | 23304 | 46399 |
| ACP4 | 210 | 23305 | 46400 |
| ACP5 | 211 | 23306 | 46401 |
| ACP6 | 212 | 23307 | 46402 |
| ACP6 | 213 | 23308 | 46403 |
| ACP7 | 214 | 23309 | 46404 |
| ACPP | 215 | 23310 | 46405 |
| ACPP | 216 | 23311 | 46406 |
| ACR | 217 | 23312 | 46407 |
| ACRBP | 218 | 23313 | 46408 |
| ACRV1 | 219 | 23314 | 46409 |
| ACSBG1 | 220 | 23315 | 46410 |
| ACSBG2 | 221 | 23316 | 46411 |
| ACSF2 | 222 | 23317 | 46412 |
| ACSF3 | 223 | 23318 | 46413 |
| ACSL1 | 224 | 23319 | 46414 |
| ACSL3 | 225 | 23320 | 46415 |
| ACSL4 | 226 | 23321 | 46416 |
| ACSL5 | 227 | 23322 | 46417 |
| ACSL6 | 228 | 23323 | 46418 |
| ACSM1 | 229 | 23324 | 46419 |
| ACSM2A | 230 | 23325 | 46420 |
| ACSM2B | 231 | 23326 | 46421 |
| ACSM3 | 232 | 23327 | 46422 |
| ACSM3 | 233 | 23328 | 46423 |
| ACSM4 | 234 | 23329 | 46424 |
| ACSM5 | 235 | 23330 | 46425 |
| ACSM5 | 236 | 23331 | 46426 |
| ACSM5 | 237 | 23332 | 46427 |
| ACSM6 | 238 | 23333 | 46428 |
| ACSS1 | 239 | 23334 | 46429 |
| ACSS1 | 240 | 23335 | 46430 |
| ACSS2 | 241 | 23336 | 46431 |
| ACSS3 | 242 | 23337 | 46432 |
| ACTA1 | 243 | 23338 | 46433 |
| ACTA2 | 244 | 23339 | 46434 |
| ACTB | 245 | 23340 | 46435 |
| ACTBL2 | 246 | 23341 | 46436 |
| ACTC1 | 247 | 23342 | 46437 |
| ACTG1 | 248 | 23343 | 46438 |
| ACTG2 | 249 | 23344 | 46439 |
| ACTL10 | 250 | 23345 | 46440 |
| ACTL6A | 251 | 23346 | 46441 |
| ACTL6B | 252 | 23347 | 46442 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| ACTL7A | 253 | 23348 | 46443 |
| ACTL7B | 254 | 23349 | 46444 |
| ACTL8 | 255 | 23350 | 46445 |
| ACTL9 | 256 | 23351 | 46446 |
| ACTN1 | 257 | 23352 | 46447 |
| ACTN2 | 258 | 23353 | 46448 |
| ACTN3 | 259 | 23354 | 46449 |
| ACTN4 | 260 | 23355 | 46450 |
| ACTR10 | 261 | 23356 | 46451 |
| ACTR1A | 262 | 23357 | 46452 |
| ACTR1B | 263 | 23358 | 46453 |
| ACTR2 | 264 | 23359 | 46454 |
| ACTR3 | 265 | 23360 | 46455 |
| ACTR3B | 266 | 23361 | 46456 |
| ACTR3C | 267 | 23362 | 46457 |
| ACTR3C | 268 | 23363 | 46458 |
| ACTR3C | 269 | 23364 | 46459 |
| ACTR5 | 270 | 23365 | 46460 |
| ACTR6 | 271 | 23366 | 46461 |
| ACTR8 | 272 | 23367 | 46462 |
| ACTRT1 | 273 | 23368 | 46463 |
| ACTRT2 | 274 | 23369 | 46464 |
| ACTRT3 | 275 | 23370 | 46465 |
| ACVR1 | 276 | 23371 | 46466 |
| ACVR1B | 277 | 23372 | 46467 |
| ACVR1C | 278 | 23373 | 46468 |
| ACVR2A | 279 | 23374 | 46469 |
| ACVR2B | 280 | 23375 | 46470 |
| ACVRL1 | 281 | 23376 | 46471 |
| ACY1 | 282 | 23377 | 46472 |
| ACY3 | 283 | 23378 | 46473 |
| ACYP1 | 284 | 23379 | 46474 |
| ACYP2 | 285 | 23380 | 46475 |
| ACYP2 | 286 | 23381 | 46476 |
| ACYP2 | 287 | 23382 | 46477 |
| ADA | 288 | 23383 | 46478 |
| ADA2 | 289 | 23384 | 46479 |
| ADAD1 | 290 | 23385 | 46480 |
| ADAD2 | 291 | 23386 | 46481 |
| ADAL | 292 | 23387 | 46482 |
| ADAL | 293 | 23388 | 46483 |
| ADAM10 | 294 | 23389 | 46484 |
| ADAM11 | 295 | 23390 | 46485 |
| ADAM12 | 296 | 23391 | 46486 |
| ADAM12 | 297 | 23392 | 46487 |
| ADAM15 | 298 | 23393 | 46488 |
| ADAM15 | 299 | 23394 | 46489 |
| ADAM15 | 300 | 23395 | 46490 |
| ADAM17 | 301 | 23396 | 46491 |
| ADAM18 | 302 | 23397 | 46492 |
| ADAM18 | 303 | 23398 | 46493 |
| ADAM19 | 304 | 23399 | 46494 |
| ADAM2 | 305 | 23400 | 46495 |
| ADAM20 | 306 | 23401 | 46496 |
| ADAM21 | 307 | 23402 | 46497 |
| ADAM22 | 308 | 23403 | 46498 |
| ADAM22 | 309 | 23404 | 46499 |
| ADAM22 | 310 | 23405 | 46500 |
| ADAM23 | 311 | 23406 | 46501 |
| ADAM28 | 312 | 23407 | 46502 |
| ADAM28 | 313 | 23408 | 46503 |
| ADAM29 | 314 | 23409 | 46504 |
| ADAM30 | 315 | 23410 | 46505 |
| ADAM32 | 316 | 23411 | 46506 |
| ADAM33 | 317 | 23412 | 46507 |
| ADAM7 | 318 | 23413 | 46508 |
| ADAM8 | 319 | 23414 | 46509 |
| ADAM8 | 320 | 23415 | 46510 |
| ADAM9 | 321 | 23416 | 46511 |
| ADAMDEC1 | 322 | 23417 | 46512 |
| ADAMTS1 | 323 | 23418 | 46513 |
| ADAMTS10 | 324 | 23419 | 46514 |
| ADAMTS12 | 325 | 23420 | 46515 |
| ADAMTS12 | 326 | 23421 | 46516 |
| ADAMTS13 | 327 | 23422 | 46517 |
| ADAMTS14 | 328 | 23423 | 46518 |
| ADAMTS15 | 329 | 23424 | 46519 |
| ADAMTS16 | 330 | 23425 | 46520 |
| ADAMTS17 | 331 | 23426 | 46521 |
| ADAMTS18 | 332 | 23427 | 46522 |
| ADAMTS19 | 333 | 23428 | 46523 |
| ADAMTS2 | 334 | 23429 | 46524 |
| ADAMTS2 | 335 | 23430 | 46525 |
| ADAMTS20 | 336 | 23431 | 46526 |
| ADAMTS3 | 337 | 23432 | 46527 |
| ADAMTS4 | 338 | 23433 | 46528 |
| ADAMTS4 | 339 | 23434 | 46529 |
| ADAMTS5 | 340 | 23435 | 46530 |
| ADAMTS6 | 341 | 23436 | 46531 |
| ADAMTS7 | 342 | 23437 | 46532 |
| ADAMTS8 | 343 | 23438 | 46533 |
| ADAMTS9 | 344 | 23439 | 46534 |
| ADAMTSL1 | 345 | 23440 | 46535 |
| ADAMTSL1 | 346 | 23441 | 46536 |
| ADAMTSL2 | 347 | 23442 | 46537 |
| ADAMTSL3 | 348 | 23443 | 46538 |
| ADAMTSL3 | 349 | 23444 | 46539 |
| ADAMTSL4 | 350 | 23445 | 46540 |
| ADAMTSL4 | 351 | 23446 | 46541 |
| ADAMTSL5 | 352 | 23447 | 46542 |
| ADAP1 | 353 | 23448 | 46543 |
| ADAP2 | 354 | 23449 | 46544 |
| ADAR | 355 | 23450 | 46545 |
| ADARB1 | 356 | 23451 | 46546 |
| ADARB1 | 357 | 23452 | 46547 |
| ADARB1 | 358 | 23453 | 46548 |
| ADARB2 | 359 | 23454 | 46549 |
| ADAT1 | 360 | 23455 | 46550 |
| ADAT2 | 361 | 23456 | 46551 |
| ADAT3 | 362 | 23457 | 46552 |
| ADCK1 | 363 | 23458 | 46553 |
| ADCK2 | 364 | 23459 | 46554 |
| ADCK5 | 365 | 23460 | 46555 |
| ADCY1 | 366 | 23461 | 46556 |
| ADCY1 | 367 | 23462 | 46557 |
| ADCY10 | 368 | 23463 | 46558 |
| ADCY2 | 369 | 23464 | 46559 |
| ADCY3 | 370 | 23465 | 46560 |
| ADCY4 | 371 | 23466 | 46561 |
| ADCY5 | 372 | 23467 | 46562 |
| ADCY6 | 373 | 23468 | 46563 |
| ADCY7 | 374 | 23469 | 46564 |
| ADCY7 | 375 | 23470 | 46565 |
| ADCY8 | 376 | 23471 | 46566 |
| ADCY9 | 377 | 23472 | 46567 |
| ADCYAP1 | 378 | 23473 | 46568 |
| ADCYAP1R1 | 379 | 23474 | 46569 |
| ADD1 | 380 | 23475 | 46570 |
| ADD1 | 381 | 23476 | 46571 |
| ADD2 | 382 | 23477 | 46572 |
| ADD2 | 383 | 23478 | 46573 |
| ADD2 | 384 | 23479 | 46574 |
| ADD3 | 385 | 23480 | 46575 |
| ADGB | 386 | 23481 | 46576 |
| ADGRA1 | 387 | 23482 | 46577 |
| ADGRA2 | 388 | 23483 | 46578 |
| ADGRA3 | 389 | 23484 | 46579 |
| ADGRB1 | 390 | 23485 | 46580 |
| ADGRB2 | 391 | 23486 | 46581 |
| ADGRB3 | 392 | 23487 | 46582 |
| ADGRD1 | 393 | 23488 | 46583 |
| ADGRE1 | 394 | 23489 | 46584 |
| ADGRE2 | 395 | 23490 | 46585 |
| ADGRE3 | 396 | 23491 | 46586 |
| ADGRE5 | 397 | 23492 | 46587 |
| ADGRF1 | 398 | 23493 | 46588 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| ADGRF1 | 399 | 23494 | 46589 |
| ADGRF2 | 400 | 23495 | 46590 |
| ADGRF3 | 401 | 23496 | 46591 |
| ADGRF3 | 402 | 23497 | 46592 |
| ADGRF3 | 403 | 23498 | 46593 |
| ADGRF4 | 404 | 23499 | 46594 |
| ADGRF5 | 405 | 23500 | 46595 |
| ADGRG1 | 406 | 23501 | 46596 |
| ADGRG2 | 407 | 23502 | 46597 |
| ADGRG3 | 408 | 23503 | 46598 |
| ADGRG4 | 409 | 23504 | 46599 |
| ADGRG5 | 410 | 23505 | 46600 |
| ADGRG5 | 411 | 23506 | 46601 |
| ADGRG6 | 412 | 23507 | 46602 |
| ADGRG6 | 413 | 23508 | 46603 |
| ADGRG7 | 414 | 23509 | 46604 |
| ADGRL1 | 415 | 23510 | 46605 |
| ADGRL2 | 416 | 23511 | 46606 |
| ADGRL2 | 417 | 23512 | 46607 |
| ADGRL2 | 418 | 23513 | 46608 |
| ADGRL2 | 419 | 23514 | 46609 |
| ADGRL3 | 420 | 23515 | 46610 |
| ADGRL3 | 421 | 23516 | 46611 |
| ADGRL4 | 422 | 23517 | 46612 |
| ADGRV1 | 423 | 23518 | 46613 |
| ADH1A | 424 | 23519 | 46614 |
| ADH1B | 425 | 23520 | 46615 |
| ADH1C | 426 | 23521 | 46616 |
| ADH4 | 427 | 23522 | 46617 |
| ADH5 | 428 | 23523 | 46618 |
| ADH6 | 429 | 23524 | 46619 |
| ADH7 | 430 | 23525 | 46620 |
| ADHFE1 | 431 | 23526 | 46621 |
| ADI1 | 432 | 23527 | 46622 |
| ADIG | 433 | 23528 | 46623 |
| ADIPOQ | 434 | 23529 | 46624 |
| ADIPOR1 | 435 | 23530 | 46625 |
| ADIPOR2 | 436 | 23531 | 46626 |
| ADIRF | 437 | 23532 | 46627 |
| ADK | 438 | 23533 | 46628 |
| ADM | 439 | 23534 | 46629 |
| ADM2 | 440 | 23535 | 46630 |
| ADM5 | 441 | 23536 | 46631 |
| ADNP | 442 | 23537 | 46632 |
| ADNP2 | 443 | 23538 | 46633 |
| ADO | 444 | 23539 | 46634 |
| ADORA1 | 445 | 23540 | 46635 |
| ADORA2A | 446 | 23541 | 46636 |
| ADORA2B | 447 | 23542 | 46637 |
| ADORA3 | 448 | 23543 | 46638 |
| ADPGK | 449 | 23544 | 46639 |
| ADPRH | 450 | 23545 | 46640 |
| ADPRHL1 | 451 | 23546 | 46641 |
| ADPRHL2 | 452 | 23547 | 46642 |
| ADPRM | 453 | 23548 | 46643 |
| ADRA1A | 454 | 23549 | 46644 |
| ADRA1A | 455 | 23550 | 46645 |
| ADRA1A | 456 | 23551 | 46646 |
| ADRA1A | 457 | 23552 | 46647 |
| ADRA1A | 458 | 23553 | 46648 |
| ADRA1A | 459 | 23554 | 46649 |
| ADRA1B | 460 | 23555 | 46650 |
| ADRA1D | 461 | 23556 | 46651 |
| ADRA2A | 462 | 23557 | 46652 |
| ADRA2B | 463 | 23558 | 46653 |
| ADRA2C | 464 | 23559 | 46654 |
| ADRB1 | 465 | 23560 | 46655 |
| ADRB2 | 466 | 23561 | 46656 |
| ADRB3 | 467 | 23562 | 46657 |
| ADRM1 | 468 | 23563 | 46658 |
| ADSL | 469 | 23564 | 46659 |
| ADSS | 470 | 23565 | 46660 |
| ADSSL1 | 471 | 23566 | 46661 |
| ADTRP | 472 | 23567 | 46662 |
| AEBP1 | 473 | 23568 | 46663 |
| AEBP2 | 474 | 23569 | 46664 |
| AEBP2 | 475 | 23570 | 46665 |
| AEN | 476 | 23571 | 46666 |
| AES | 477 | 23572 | 46667 |
| AFAP1 | 478 | 23573 | 46668 |
| AFAP1L1 | 479 | 23574 | 46669 |
| AFAP1L1 | 480 | 23575 | 46670 |
| AFAP1L2 | 481 | 23576 | 46671 |
| AFDN | 482 | 23577 | 46672 |
| AFDN | 483 | 23578 | 46673 |
| AFF1 | 484 | 23579 | 46674 |
| AFF2 | 485 | 23580 | 46675 |
| AFF3 | 486 | 23581 | 46676 |
| AFF4 | 487 | 23582 | 46677 |
| AFG1L | 488 | 23583 | 46678 |
| AFG3L2 | 489 | 23584 | 46679 |
| AFM | 490 | 23585 | 46680 |
| AFMID | 491 | 23586 | 46681 |
| AFP | 492 | 23587 | 46682 |
| AFTPH | 493 | 23588 | 46683 |
| AGA | 494 | 23589 | 46684 |
| AGAP1 | 495 | 23590 | 46685 |
| AGAP1 | 496 | 23591 | 46686 |
| AGAP11 | 497 | 23592 | 46687 |
| AGAP2 | 498 | 23593 | 46688 |
| AGAP3 | 499 | 23594 | 46689 |
| AGAP3 | 500 | 23595 | 46690 |
| AGAP4 | 501 | 23596 | 46691 |
| AGAP6 | 502 | 23597 | 46692 |
| AGAP9 | 503 | 23598 | 46693 |
| AGBL1 | 504 | 23599 | 46694 |
| AGBL2 | 505 | 23600 | 46695 |
| AGBL3 | 506 | 23601 | 46696 |
| AGBL3 | 507 | 23602 | 46697 |
| AGBL4 | 508 | 23603 | 46698 |
| AGBL5 | 509 | 23604 | 46699 |
| AGBL5 | 510 | 23605 | 46700 |
| AGER | 511 | 23606 | 46701 |
| AGER | 512 | 23607 | 46702 |
| AGER | 513 | 23608 | 46703 |
| AGER | 514 | 23609 | 46704 |
| AGFG1 | 515 | 23610 | 46705 |
| AGFG2 | 516 | 23611 | 46706 |
| AGGF1 | 517 | 23612 | 46707 |
| AGK | 518 | 23613 | 46708 |
| AGL | 519 | 23614 | 46709 |
| AGMAT | 520 | 23615 | 46710 |
| AGMO | 521 | 23616 | 46711 |
| AGO1 | 522 | 23617 | 46712 |
| AGO2 | 523 | 23618 | 46713 |
| AGO3 | 524 | 23619 | 46714 |
| AGO4 | 525 | 23620 | 46715 |
| AGPAT1 | 526 | 23621 | 46716 |
| AGPAT2 | 527 | 23622 | 46717 |
| AGPAT3 | 528 | 23623 | 46718 |
| AGPAT4 | 529 | 23624 | 46719 |
| AGPAT5 | 530 | 23625 | 46720 |
| AGPS | 531 | 23626 | 46721 |
| AGR2 | 532 | 23627 | 46722 |
| AGR3 | 533 | 23628 | 46723 |
| AGRN | 534 | 23629 | 46724 |
| AGRP | 535 | 23630 | 46725 |
| AGT | 536 | 23631 | 46726 |
| AGTPBP1 | 537 | 23632 | 46727 |
| AGTR1 | 538 | 23633 | 46728 |
| AGTR2 | 539 | 23634 | 46729 |
| AGTRAP | 540 | 23635 | 46730 |
| AGTRAP | 541 | 23636 | 46731 |
| AGTRAP | 542 | 23637 | 46732 |
| AGXT | 543 | 23638 | 46733 |
| AGXT2 | 544 | 23639 | 46734 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| AHCTF1 | 545 | 23640 | 46735 |
| AHCTF1 | 546 | 23641 | 46736 |
| AHCY | 547 | 23642 | 46737 |
| AHCYL1 | 548 | 23643 | 46738 |
| AHCYL2 | 549 | 23644 | 46739 |
| AHDC1 | 550 | 23645 | 46740 |
| AHI1 | 551 | 23646 | 46741 |
| AHI1 | 552 | 23647 | 46742 |
| AHI1 | 553 | 23648 | 46743 |
| AHNAK | 554 | 23649 | 46744 |
| AHNAK | 555 | 23650 | 46745 |
| AHNAK2 | 556 | 23651 | 46746 |
| AHR | 557 | 23652 | 46747 |
| AHRR | 558 | 23653 | 46748 |
| AHSA1 | 559 | 23654 | 46749 |
| AHSA2 | 560 | 23655 | 46750 |
| AHSA2 | 561 | 23656 | 46751 |
| AHSG | 562 | 23657 | 46752 |
| AHSP | 563 | 23658 | 46753 |
| AICDA | 564 | 23659 | 46754 |
| AIDA | 565 | 23660 | 46755 |
| AIF1 | 566 | 23661 | 46756 |
| AIF1L | 567 | 23662 | 46757 |
| AIF1L | 568 | 23663 | 46758 |
| AIFM1 | 569 | 23664 | 46759 |
| AIFM1 | 570 | 23665 | 46760 |
| AIFM2 | 571 | 23666 | 46761 |
| AIFM3 | 572 | 23667 | 46762 |
| AIG1 | 573 | 23668 | 46763 |
| AIG1 | 574 | 23669 | 46764 |
| AIM2 | 575 | 23670 | 46765 |
| AIMP1 | 576 | 23671 | 46766 |
| AIMP2 | 577 | 23672 | 46767 |
| AIP | 578 | 23673 | 46768 |
| AIP | 579 | 23674 | 46769 |
| AIPL1 | 580 | 23675 | 46770 |
| AIPL1 | 581 | 23676 | 46771 |
| AIRE | 582 | 23677 | 46772 |
| AJAP1 | 583 | 23678 | 46773 |
| AJUBA | 584 | 23679 | 46774 |
| AJUBA | 585 | 23680 | 46775 |
| AJUBA | 586 | 23681 | 46776 |
| AK1 | 587 | 23682 | 46777 |
| AK2 | 588 | 23683 | 46778 |
| AK2 | 589 | 23684 | 46779 |
| AK2 | 590 | 23685 | 46780 |
| AK2 | 591 | 23686 | 46781 |
| AK3 | 592 | 23687 | 46782 |
| AK4 | 593 | 23688 | 46783 |
| AK5 | 594 | 23689 | 46784 |
| AK6 | 595 | 23690 | 46785 |
| AK7 | 596 | 23691 | 46786 |
| AK7 | 597 | 23692 | 46787 |
| AK8 | 598 | 23693 | 46788 |
| AK9 | 599 | 23694 | 46789 |
| AK9 | 600 | 23695 | 46790 |
| AKAIN1 | 601 | 23696 | 46791 |
| AKAIN1 | 602 | 23697 | 46792 |
| AKAP1 | 603 | 23698 | 46793 |
| AKAP10 | 604 | 23699 | 46794 |
| AKAP11 | 605 | 23700 | 46795 |
| AKAP12 | 606 | 23701 | 46796 |
| AKAP13 | 607 | 23702 | 46797 |
| AKAP14 | 608 | 23703 | 46798 |
| AKAP14 | 609 | 23704 | 46799 |
| AKAP17A | 610 | 23705 | 46800 |
| AKAP3 | 611 | 23706 | 46801 |
| AKAP4 | 612 | 23707 | 46802 |
| AKAP5 | 613 | 23708 | 46803 |
| AKAP6 | 614 | 23709 | 46804 |
| AKAP7 | 615 | 23710 | 46805 |
| AKAP8 | 616 | 23711 | 46806 |
| AKAP8L | 617 | 23712 | 46807 |
| AKAP9 | 618 | 23713 | 46808 |
| AKIP1 | 619 | 23714 | 46809 |
| AKIRIN1 | 620 | 23715 | 46810 |
| AKIRIN2 | 621 | 23716 | 46811 |
| AKNA | 622 | 23717 | 46812 |
| AKNAD1 | 623 | 23718 | 46813 |
| AKR1A1 | 624 | 23719 | 46814 |
| AKR1B1 | 625 | 23720 | 46815 |
| AKR1B10 | 626 | 23721 | 46816 |
| AKR1B15 | 627 | 23722 | 46817 |
| AKR1C2 | 628 | 23723 | 46818 |
| AKR1C2 | 629 | 23724 | 46819 |
| AKR1C3 | 630 | 23725 | 46820 |
| AKR1C3 | 631 | 23726 | 46821 |
| AKR1C4 | 632 | 23727 | 46822 |
| AKR1D1 | 633 | 23728 | 46823 |
| AKR1D1 | 634 | 23729 | 46824 |
| AKR1E2 | 635 | 23730 | 46825 |
| AKR7A2 | 636 | 23731 | 46826 |
| AKR7A3 | 637 | 23732 | 46827 |
| AKR7L | 638 | 23733 | 46828 |
| AKT1 | 639 | 23734 | 46829 |
| AKT1S1 | 640 | 23735 | 46830 |
| AKT2 | 641 | 23736 | 46831 |
| AKT3 | 642 | 23737 | 46832 |
| AKT3 | 643 | 23738 | 46833 |
| AKTIP | 644 | 23739 | 46834 |
| ALAD | 645 | 23740 | 46835 |
| ALAS1 | 646 | 23741 | 46836 |
| ALAS2 | 647 | 23742 | 46837 |
| ALB | 648 | 23743 | 46838 |
| ALCAM | 649 | 23744 | 46839 |
| ALCAM | 650 | 23745 | 46840 |
| ALCAM | 651 | 23746 | 46841 |
| ALDH16A1 | 652 | 23747 | 46842 |
| ALDH18A1 | 653 | 23748 | 46843 |
| ALDH1A1 | 654 | 23749 | 46844 |
| ALDH1A2 | 655 | 23750 | 46845 |
| ALDH1A3 | 656 | 23751 | 46846 |
| ALDH1B1 | 657 | 23752 | 46847 |
| ALDH1L1 | 658 | 23753 | 46848 |
| ALDH1L2 | 659 | 23754 | 46849 |
| ALDH2 | 660 | 23755 | 46850 |
| ALDH3A1 | 661 | 23756 | 46851 |
| ALDH3A2 | 662 | 23757 | 46852 |
| ALDH3A2 | 663 | 23758 | 46853 |
| ALDH3B1 | 664 | 23759 | 46854 |
| ALDH3B2 | 665 | 23760 | 46855 |
| ALDH4A1 | 666 | 23761 | 46856 |
| ALDH5A1 | 667 | 23762 | 46857 |
| ALDH6A1 | 668 | 23763 | 46858 |
| ALDH7A1 | 669 | 23764 | 46859 |
| ALDH8A1 | 670 | 23765 | 46860 |
| ALDH9A1 | 671 | 23766 | 46861 |
| ALDOA | 672 | 23767 | 46862 |
| ALDOB | 673 | 23768 | 46863 |
| ALDOC | 674 | 23769 | 46864 |
| ALG1 | 675 | 23770 | 46865 |
| ALG10 | 676 | 23771 | 46866 |
| ALG10B | 677 | 23772 | 46867 |
| ALG11 | 678 | 23773 | 46868 |
| ALG12 | 679 | 23774 | 46869 |
| ALG13 | 680 | 23775 | 46870 |
| ALG13 | 681 | 23776 | 46871 |
| ALG13 | 682 | 23777 | 46872 |
| ALG14 | 683 | 23778 | 46873 |
| ALG14 | 684 | 23779 | 46874 |
| ALG1L | 685 | 23780 | 46875 |
| ALG1L2 | 686 | 23781 | 46876 |
| ALG2 | 687 | 23782 | 46877 |
| ALG3 | 688 | 23783 | 46878 |
| ALG5 | 689 | 23784 | 46879 |
| ALG6 | 690 | 23785 | 46880 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| ALG8 | 691 | 23786 | 46881 |
| ALG8 | 692 | 23787 | 46882 |
| ALG9 | 693 | 23788 | 46883 |
| ALG9 | 694 | 23789 | 46884 |
| ALG9 | 695 | 23790 | 46885 |
| ALG9 | 696 | 23791 | 46886 |
| ALK | 697 | 23792 | 46887 |
| ALKAL1 | 698 | 23793 | 46888 |
| ALKAL2 | 699 | 23794 | 46889 |
| ALKBH1 | 700 | 23795 | 46890 |
| ALKBH2 | 701 | 23796 | 46891 |
| ALKBH2 | 702 | 23797 | 46892 |
| ALKBH3 | 703 | 23798 | 46893 |
| ALKBH4 | 704 | 23799 | 46894 |
| ALKBH5 | 705 | 23800 | 46895 |
| ALKBH6 | 706 | 23801 | 46896 |
| ALKBH6 | 707 | 23802 | 46897 |
| ALKBH7 | 708 | 23803 | 46898 |
| ALKBH8 | 709 | 23804 | 46899 |
| ALLC | 710 | 23805 | 46900 |
| ALMS1 | 711 | 23806 | 46901 |
| ALOX12 | 712 | 23807 | 46902 |
| ALOX12B | 713 | 23808 | 46903 |
| ALOX15 | 714 | 23809 | 46904 |
| ALOX15B | 715 | 23810 | 46905 |
| ALOX5 | 716 | 23811 | 46906 |
| ALOX5AP | 717 | 23812 | 46907 |
| ALOXE3 | 718 | 23813 | 46908 |
| ALPI | 719 | 23814 | 46909 |
| ALPK1 | 720 | 23815 | 46910 |
| ALPK2 | 721 | 23816 | 46911 |
| ALPK3 | 722 | 23817 | 46912 |
| ALPL | 723 | 23818 | 46913 |
| ALPP | 724 | 23819 | 46914 |
| ALS2 | 725 | 23820 | 46915 |
| ALS2 | 726 | 23821 | 46916 |
| ALS2CL | 727 | 23822 | 46917 |
| ALS2CR12 alternate allele | 728 | 23823 | 46918 |
| | 729 | 23824 | 46919 |
| ALX1 | 730 | 23825 | 46920 |
| ALX3 | 731 | 23826 | 46921 |
| ALX4 | 732 | 23827 | 46922 |
| ALYREF | 733 | 23828 | 46923 |
| AMACR | 734 | 23829 | 46924 |
| AMACR | 735 | 23830 | 46925 |
| AMACR | 736 | 23831 | 46926 |
| AMBN | 737 | 23832 | 46927 |
| AMBP | 738 | 23833 | 46928 |
| AMBRA1 | 739 | 23834 | 46929 |
| AMD1 | 740 | 23835 | 46930 |
| AMDHD1 | 741 | 23836 | 46931 |
| AMDHD2 | 742 | 23837 | 46932 |
| AMDHD2 | 743 | 23838 | 46933 |
| AMELX | 744 | 23839 | 46934 |
| AMELY | 745 | 23840 | 46935 |
| AMER1 | 746 | 23841 | 46936 |
| AMER2 | 747 | 23842 | 46937 |
| AMER3 | 748 | 23843 | 46938 |
| AMFR | 749 | 23844 | 46939 |
| AMH | 750 | 23845 | 46940 |
| AMHR2 | 751 | 23846 | 46941 |
| AMHR2 | 752 | 23847 | 46942 |
| AMIGO1 | 753 | 23848 | 46943 |
| AMIGO2 | 754 | 23849 | 46944 |
| AMIGO3 | 755 | 23850 | 46945 |
| AMMECR1 | 756 | 23851 | 46946 |
| AMMECR1L | 757 | 23852 | 46947 |
| AMN | 758 | 23853 | 46948 |
| AMN1 | 759 | 23854 | 46949 |
| AMOT | 760 | 23855 | 46950 |
| AMOTL1 | 761 | 23856 | 46951 |
| AMOTL2 | 762 | 23857 | 46952 |
| AMPD1 | 763 | 23858 | 46953 |
| AMPD2 | 764 | 23859 | 46954 |
| AMPD3 | 765 | 23860 | 46955 |
| AMPH | 766 | 23861 | 46956 |
| AMT | 767 | 23862 | 46957 |
| AMT | 768 | 23863 | 46958 |
| AMTN | 769 | 23864 | 46959 |
| AMY1A | 770 | 23865 | 46960 |
| AMY2A | 771 | 23866 | 46961 |
| AMY2B | 772 | 23867 | 46962 |
| AMZ1 | 773 | 23868 | 46963 |
| AMZ1 | 774 | 23869 | 46964 |
| AMZ1 | 775 | 23870 | 46965 |
| AMZ2 | 776 | 23871 | 46966 |
| ANAPC1 | 777 | 23872 | 46967 |
| ANAPC10 | 778 | 23873 | 46968 |
| ANAPC10 | 779 | 23874 | 46969 |
| ANAPC10 | 780 | 23875 | 46970 |
| ANAPC11 | 781 | 23876 | 46971 |
| ANAPC11 | 782 | 23877 | 46972 |
| ANAPC13 | 783 | 23878 | 46973 |
| ANAPC13 | 784 | 23879 | 46974 |
| ANAPC13 | 785 | 23880 | 46975 |
| ANAPC15 | 786 | 23881 | 46976 |
| ANAPC15 | 787 | 23882 | 46977 |
| ANAPC16 | 788 | 23883 | 46978 |
| ANAPC2 | 789 | 23884 | 46979 |
| ANAPC4 | 790 | 23885 | 46980 |
| ANAPC5 | 791 | 23886 | 46981 |
| ANAPC7 | 792 | 23887 | 46982 |
| ANAPC7 | 793 | 23888 | 46983 |
| ANG | 794 | 23889 | 46984 |
| ANG | 795 | 23890 | 46985 |
| ANGEL1 | 796 | 23891 | 46986 |
| ANGEL2 | 797 | 23892 | 46987 |
| ANGPT1 | 798 | 23893 | 46988 |
| ANGPT2 | 799 | 23894 | 46989 |
| ANGPT4 | 800 | 23895 | 46990 |
| ANGPT4 | 801 | 23896 | 46991 |
| ANGPTL1 | 802 | 23897 | 46992 |
| ANGPTL2 | 803 | 23898 | 46993 |
| ANGPTL3 | 804 | 23899 | 46994 |
| ANGPTL4 | 805 | 23900 | 46995 |
| ANGPTL5 | 806 | 23901 | 46996 |
| ANGPTL6 | 807 | 23902 | 46997 |
| ANGPTL7 | 808 | 23903 | 46998 |
| ANGPTL8 | 809 | 23904 | 46999 |
| ANHX | 810 | 23905 | 47000 |
| ANK1 | 811 | 23906 | 47001 |
| ANK1 | 812 | 23907 | 47002 |
| ANK2 | 813 | 23908 | 47003 |
| ANK2 | 814 | 23909 | 47004 |
| ANK2 | 815 | 23910 | 47005 |
| ANK3 | 816 | 23911 | 47006 |
| ANKAR | 817 | 23912 | 47007 |
| ANKDD1A | 818 | 23913 | 47008 |
| ANKDD1B | 819 | 23914 | 47009 |
| ANKEF1 | 820 | 23915 | 47010 |
| ANKFN1 | 821 | 23916 | 47011 |
| ANKFY1 | 822 | 23917 | 47012 |
| ANKH | 823 | 23918 | 47013 |
| ANKHD1 | 824 | 23919 | 47014 |
| ANKHD1 | 825 | 23920 | 47015 |
| ANKHD1-EIF4EBP3 | 826 | 23921 | 47016 |
| ANKIB1 | 827 | 23922 | 47017 |
| ANKK1 | 828 | 23923 | 47018 |
| ANKLE1 | 829 | 23924 | 47019 |
| ANKLE1 | 830 | 23925 | 47020 |
| ANKLE2 | 831 | 23926 | 47021 |
| ANKMY1 | 832 | 23927 | 47022 |
| ANKMY2 | 833 | 23928 | 47023 |
| ANKRA2 | 834 | 23929 | 47024 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| ANKRD1 | 835 | 23930 | 47025 |
| ANKRD10 | 836 | 23931 | 47026 |
| ANKRD10 | 837 | 23932 | 47027 |
| ANKRD11 | 838 | 23933 | 47028 |
| ANKRD12 | 839 | 23934 | 47029 |
| ANKRD13A | 840 | 23935 | 47030 |
| ANKRD13B | 841 | 23936 | 47031 |
| ANKRD13C | 842 | 23937 | 47032 |
| ANKRD13D | 843 | 23938 | 47033 |
| ANKRD16 | 844 | 23939 | 47034 |
| ANKRD16 | 845 | 23940 | 47035 |
| ANKRD17 | 846 | 23941 | 47036 |
| ANKRD18A | 847 | 23942 | 47037 |
| ANKRD18B | 848 | 23943 | 47038 |
| ANKRD2 | 849 | 23944 | 47039 |
| ANKRD20A3 | 850 | 23945 | 47040 |
| ANKRD20A4 | 851 | 23946 | 47041 |
| ANKRD22 | 852 | 23947 | 47042 |
| ANKRD23 | 853 | 23948 | 47043 |
| ANKRD24 | 854 | 23949 | 47044 |
| ANKRD26 | 855 | 23950 | 47045 |
| ANKRD27 | 856 | 23951 | 47046 |
| ANKRD28 | 857 | 23952 | 47047 |
| ANKRD28 | 858 | 23953 | 47048 |
| ANKRD29 | 859 | 23954 | 47049 |
| ANKRD30A | 860 | 23955 | 47050 |
| ANKRD30B | 861 | 23956 | 47051 |
| ANKRD31 | 862 | 23957 | 47052 |
| ANKRD33 | 863 | 23958 | 47053 |
| ANKRD33 | 864 | 23959 | 47054 |
| ANKRD33B | 865 | 23960 | 47055 |
| ANKRD34A | 866 | 23961 | 47056 |
| ANKRD34B | 867 | 23962 | 47057 |
| ANKRD34C | 868 | 23963 | 47058 |
| ANKRD35 | 869 | 23964 | 47059 |
| ANKRD36B | 870 | 23965 | 47060 |
| ANKRD36B | 871 | 23966 | 47061 |
| ANKRD36C | 872 | 23967 | 47062 |
| ANKRD37 | 873 | 23968 | 47063 |
| ANKRD39 | 874 | 23969 | 47064 |
| ANKRD40 | 875 | 23970 | 47065 |
| ANKRD42 | 876 | 23971 | 47066 |
| ANKRD42 | 877 | 23972 | 47067 |
| ANKRD42 | 878 | 23973 | 47068 |
| ANKRD42 | 879 | 23974 | 47069 |
| ANKRD42 | 880 | 23975 | 47070 |
| ANKRD42 | 881 | 23976 | 47071 |
| ANKRD44 | 882 | 23977 | 47072 |
| ANKRD44 | 883 | 23978 | 47073 |
| ANKRD45 | 884 | 23979 | 47074 |
| ANKRD46 | 885 | 23980 | 47075 |
| ANKRD46 | 886 | 23981 | 47076 |
| ANKRD49 | 887 | 23982 | 47077 |
| ANKRD50 | 888 | 23983 | 47078 |
| ANKRD52 | 889 | 23984 | 47079 |
| ANKRD53 | 890 | 23985 | 47080 |
| ANKRD53 | 891 | 23986 | 47081 |
| ANKRD54 | 892 | 23987 | 47082 |
| ANKRD55 | 893 | 23988 | 47083 |
| ANKRD6 | 894 | 23989 | 47084 |
| ANKRD60 | 895 | 23990 | 47085 |
| ANKRD61 | 896 | 23991 | 47086 |
| ANKRD62 | 897 | 23992 | 47087 |
| ANKRD63 | 898 | 23993 | 47088 |
| ANKRD65 | 899 | 23994 | 47089 |
| ANKRD65 | 900 | 23995 | 47090 |
| ANKRD66 | 901 | 23996 | 47091 |
| ANKRD7 | 902 | 23997 | 47092 |
| ANKRD9 | 903 | 23998 | 47093 |
| ANKS1A | 904 | 23999 | 47094 |
| ANKS1B | 905 | 24000 | 47095 |
| ANKS1B | 906 | 24001 | 47096 |
| ANKS1B | 907 | 24002 | 47097 |
| ANKS3 | 908 | 24003 | 47098 |
| ANKS4B | 909 | 24004 | 47099 |
| ANKS6 | 910 | 24005 | 47100 |
| ANKUB1 | 911 | 24006 | 47101 |
| ANKUB1 | 912 | 24007 | 47102 |
| ANKZF1 | 913 | 24008 | 47103 |
| ANLN | 914 | 24009 | 47104 |
| ANO1 | 915 | 24010 | 47105 |
| ANO10 | 916 | 24011 | 47106 |
| ANO10 | 917 | 24012 | 47107 |
| ANO2 | 918 | 24013 | 47108 |
| ANO3 | 919 | 24014 | 47109 |
| ANO4 | 920 | 24015 | 47110 |
| ANO5 | 921 | 24016 | 47111 |
| ANO6 | 922 | 24017 | 47112 |
| ANO6 | 923 | 24018 | 47113 |
| ANO7 | 924 | 24019 | 47114 |
| ANO7 | 925 | 24020 | 47115 |
| ANO8 | 926 | 24021 | 47116 |
| ANO9 | 927 | 24022 | 47117 |
| ANOS1 | 928 | 24023 | 47118 |
| ANP32A | 929 | 24024 | 47119 |
| ANP32B | 930 | 24025 | 47120 |
| ANP32C | 931 | 24026 | 47121 |
| ANP32D | 932 | 24027 | 47122 |
| ANP32E | 933 | 24028 | 47123 |
| ANP32E | 934 | 24029 | 47124 |
| ANPEP | 935 | 24030 | 47125 |
| ANTXR1 | 936 | 24031 | 47126 |
| ANTXR1 | 937 | 24032 | 47127 |
| ANTXR1 | 938 | 24033 | 47128 |
| ANTXR2 | 939 | 24034 | 47129 |
| ANTXR2 | 940 | 24035 | 47130 |
| ANTXRL | 941 | 24036 | 47131 |
| ANXA1 | 942 | 24037 | 47132 |
| ANXA10 | 943 | 24038 | 47133 |
| ANXA11 | 944 | 24039 | 47134 |
| ANXA13 | 945 | 24040 | 47135 |
| ANXA2 | 946 | 24041 | 47136 |
| ANXA2R | 947 | 24042 | 47137 |
| ANXA3 | 948 | 24043 | 47138 |
| ANXA4 | 949 | 24044 | 47139 |
| ANXA5 | 950 | 24045 | 47140 |
| ANXA6 | 951 | 24046 | 47141 |
| ANXA7 | 952 | 24047 | 47142 |
| ANXA8 | 953 | 24048 | 47143 |
| ANXA9 | 954 | 24049 | 47144 |
| AOAH | 955 | 24050 | 47145 |
| AOAH | 956 | 24051 | 47146 |
| AOC1 | 957 | 24052 | 47147 |
| AOC2 | 958 | 24053 | 47148 |
| AOC3 | 959 | 24054 | 47149 |
| AOC3 | 960 | 24055 | 47150 |
| AOX1 | 961 | 24056 | 47151 |
| AP1AR | 962 | 24057 | 47152 |
| AP1B1 | 963 | 24058 | 47153 |
| AP1G1 | 964 | 24059 | 47154 |
| AP1G2 | 965 | 24060 | 47155 |
| AP1M1 | 966 | 24061 | 47156 |
| AP1M2 | 967 | 24062 | 47157 |
| AP1S1 | 968 | 24063 | 47158 |
| AP1S2 | 969 | 24064 | 47159 |
| AP1S3 | 970 | 24065 | 47160 |
| AP2A1 | 971 | 24066 | 47161 |
| AP2A2 | 972 | 24067 | 47162 |
| AP2B1 | 973 | 24068 | 47163 |
| AP2M1 | 974 | 24069 | 47164 |
| AP2S1 | 975 | 24070 | 47165 |
| AP3B1 | 976 | 24071 | 47166 |
| AP3B2 | 977 | 24072 | 47167 |
| AP3B2 | 978 | 24073 | 47168 |
| AP3D1 | 979 | 24074 | 47169 |
| AP3M1 | 980 | 24075 | 47170 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| AP3M2 | 981 | 24076 | 47171 |
| AP3S1 | 982 | 24077 | 47172 |
| AP3S1 | 983 | 24078 | 47173 |
| AP3S2 | 984 | 24079 | 47174 |
| AP4B1 | 985 | 24080 | 47175 |
| AP4E1 | 986 | 24081 | 47176 |
| AP4M1 | 987 | 24082 | 47177 |
| AP4S1 | 988 | 24083 | 47178 |
| AP4S1 | 989 | 24084 | 47179 |
| AP4S1 | 990 | 24085 | 47180 |
| AP5B1 | 991 | 24086 | 47181 |
| AP5M1 | 992 | 24087 | 47182 |
| AP5S1 | 993 | 24088 | 47183 |
| AP5Z1 | 994 | 24089 | 47184 |
| APAF1 | 995 | 24090 | 47185 |
| APAF1 | 996 | 24091 | 47186 |
| APBA1 | 997 | 24092 | 47187 |
| APBA2 | 998 | 24093 | 47188 |
| APBA2 | 999 | 24094 | 47189 |
| APBA3 | 1000 | 24095 | 47190 |
| APBB1 | 1001 | 24096 | 47191 |
| APBB1IP | 1002 | 24097 | 47192 |
| APBB2 | 1003 | 24098 | 47193 |
| APBB3 | 1004 | 24099 | 47194 |
| APC | 1005 | 24100 | 47195 |
| APC2 | 1006 | 24101 | 47196 |
| APCDD1 | 1007 | 24102 | 47197 |
| APCDD1L | 1008 | 24103 | 47198 |
| APCS | 1009 | 24104 | 47199 |
| APEH | 1010 | 24105 | 47200 |
| APELA | 1011 | 24106 | 47201 |
| APEX1 | 1012 | 24107 | 47202 |
| APEX2 | 1013 | 24108 | 47203 |
| APH1A | 1014 | 24109 | 47204 |
| APH1A | 1015 | 24110 | 47205 |
| APH1B | 1016 | 24111 | 47206 |
| API5 | 1017 | 24112 | 47207 |
| API5 | 1018 | 24113 | 47208 |
| APIP | 1019 | 24114 | 47209 |
| APLF | 1020 | 24115 | 47210 |
| APLN | 1021 | 24116 | 47211 |
| APLNR | 1022 | 24117 | 47212 |
| APLP1 | 1023 | 24118 | 47213 |
| APLP2 | 1024 | 24119 | 47214 |
| APMAP | 1025 | 24120 | 47215 |
| APOA1 | 1026 | 24121 | 47216 |
| APOA2 | 1027 | 24122 | 47217 |
| APOA4 | 1028 | 24123 | 47218 |
| APOA5 | 1029 | 24124 | 47219 |
| APOB | 1030 | 24125 | 47220 |
| APOBEC1 | 1031 | 24126 | 47221 |
| APOBEC2 | 1032 | 24127 | 47222 |
| APOBEC3B | 1033 | 24128 | 47223 |
| APOBEC3D | 1034 | 24129 | 47224 |
| APOBEC3F | 1035 | 24130 | 47225 |
| APOBEC3F | 1036 | 24131 | 47226 |
| APOBEC3G | 1037 | 24132 | 47227 |
| APOBEC3G | 1038 | 24133 | 47228 |
| APOBEC3G | 1039 | 24134 | 47229 |
| APOBEC3H | 1040 | 24135 | 47230 |
| APOBEC3H | 1041 | 24136 | 47231 |
| APOBEC4 | 1042 | 24137 | 47232 |
| APOBR | 1043 | 24138 | 47233 |
| APOC1 | 1044 | 24139 | 47234 |
| APOC2 | 1045 | 24140 | 47235 |
| APOC3 | 1046 | 24141 | 47236 |
| APOC4 | 1047 | 24142 | 47237 |
| APOD | 1048 | 24143 | 47238 |
| APOE | 1049 | 24144 | 47239 |
| APOF | 1050 | 24145 | 47240 |
| APOH | 1051 | 24146 | 47241 |
| APOL1 | 1052 | 24147 | 47242 |
| APOL2 | 1053 | 24148 | 47243 |
| APOL3 | 1054 | 24149 | 47244 |
| APOL4 | 1055 | 24150 | 47245 |
| APOL5 | 1056 | 24151 | 47246 |
| APOL6 | 1057 | 24152 | 47247 |
| APOLD1 | 1058 | 24153 | 47248 |
| APOM | 1059 | 24154 | 47249 |
| APOO | 1060 | 24155 | 47250 |
| APOOL | 1061 | 24156 | 47251 |
| APOPT1 | 1062 | 24157 | 47252 |
| APOPT1 | 1063 | 24158 | 47253 |
| APOPT1 | 1064 | 24159 | 47254 |
| APOPT1 | 1065 | 24160 | 47255 |
| APP | 1066 | 24161 | 47256 |
| APPBP2 | 1067 | 24162 | 47257 |
| APPL1 | 1068 | 24163 | 47258 |
| APPL2 | 1069 | 24164 | 47259 |
| APRT | 1070 | 24165 | 47260 |
| APRT | 1071 | 24166 | 47261 |
| APTX | 1072 | 24167 | 47262 |
| APTX | 1073 | 24168 | 47263 |
| AQP1 | 1074 | 24169 | 47264 |
| AQP1 | 1075 | 24170 | 47265 |
| AQP10 | 1076 | 24171 | 47266 |
| AQP11 | 1077 | 24172 | 47267 |
| AQP12A | 1078 | 24173 | 47268 |
| AQP2 | 1079 | 24174 | 47269 |
| AQP3 | 1080 | 24175 | 47270 |
| AQP3 | 1081 | 24176 | 47271 |
| AQP4 | 1082 | 24177 | 47272 |
| AQP5 | 1083 | 24178 | 47273 |
| AQP6 | 1084 | 24179 | 47274 |
| AQP7 | 1085 | 24180 | 47275 |
| AQP7 | 1086 | 24181 | 47276 |
| AQP7 | 1087 | 24182 | 47277 |
| AQP8 | 1088 | 24183 | 47278 |
| AQP9 | 1089 | 24184 | 47279 |
| AQP9 | 1090 | 24185 | 47280 |
| AQR | 1091 | 24186 | 47281 |
| AR | 1092 | 24187 | 47282 |
| AR | 1093 | 24188 | 47283 |
| AR | 1094 | 24189 | 47284 |
| AR | 1095 | 24190 | 47285 |
| AR | 1096 | 24191 | 47286 |
| ARAF | 1097 | 24192 | 47287 |
| ARAF | 1098 | 24193 | 47288 |
| ARAP1 | 1099 | 24194 | 47289 |
| ARAP2 | 1100 | 24195 | 47290 |
| ARAP3 | 1101 | 24196 | 47291 |
| ARC | 1102 | 24197 | 47292 |
| ARCN1 | 1103 | 24198 | 47293 |
| AREG | 1104 | 24199 | 47294 |
| AREL1 | 1105 | 24200 | 47295 |
| ARF1 | 1106 | 24201 | 47296 |
| ARF3 | 1107 | 24202 | 47297 |
| ARF4 | 1108 | 24203 | 47298 |
| ARF5 | 1109 | 24204 | 47299 |
| ARF6 | 1110 | 24205 | 47300 |
| ARFGAP1 | 1111 | 24206 | 47301 |
| ARFGAP1 | 1112 | 24207 | 47302 |
| ARFGAP2 | 1113 | 24208 | 47303 |
| ARFGAP3 | 1114 | 24209 | 47304 |
| ARFGEF1 | 1115 | 24210 | 47305 |
| ARFGEF2 | 1116 | 24211 | 47306 |
| ARFGEF3 | 1117 | 24212 | 47307 |
| ARFIP1 | 1118 | 24213 | 47308 |
| ARFIP2 | 1119 | 24214 | 47309 |
| ARFRP1 | 1120 | 24215 | 47310 |
| ARFRP1 | 1121 | 24216 | 47311 |
| ARFRP1 | 1122 | 24217 | 47312 |
| ARG1 | 1123 | 24218 | 47313 |
| ARG2 | 1124 | 24219 | 47314 |
| ARGFX | 1125 | 24220 | 47315 |
| ARGLU1 | 1126 | 24221 | 47316 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| ARHGAP1 | 1127 | 24222 | 47317 |
| ARHGAP10 | 1128 | 24223 | 47318 |
| ARHGAP11A | 1129 | 24224 | 47319 |
| ARHGAP11A | 1130 | 24225 | 47320 |
| ARHGAP11B | 1131 | 24226 | 47321 |
| ARHGAP12 | 1132 | 24227 | 47322 |
| ARHGAP15 | 1133 | 24228 | 47323 |
| ARHGAP17 | 1134 | 24229 | 47324 |
| ARHGAP18 | 1135 | 24230 | 47325 |
| ARHGAP19 | 1136 | 24231 | 47326 |
| ARHGAP20 | 1137 | 24232 | 47327 |
| ARHGAP21 | 1138 | 24233 | 47328 |
| ARHGAP22 | 1139 | 24234 | 47329 |
| ARHGAP22 | 1140 | 24235 | 47330 |
| ARHGAP23 | 1141 | 24236 | 47331 |
| ARHGAP24 | 1142 | 24237 | 47332 |
| ARHGAP25 | 1143 | 24238 | 47333 |
| ARHGAP26 | 1144 | 24239 | 47334 |
| ARHGAP27 | 1145 | 24240 | 47335 |
| ARHGAP27 | 1146 | 24241 | 47336 |
| ARHGAP28 | 1147 | 24242 | 47337 |
| ARHGAP29 | 1148 | 24243 | 47338 |
| ARHGAP30 | 1149 | 24244 | 47339 |
| ARHGAP31 | 1150 | 24245 | 47340 |
| ARHGAP32 | 1151 | 24246 | 47341 |
| ARHGAP33 | 1152 | 24247 | 47342 |
| ARHGAP35 | 1153 | 24248 | 47343 |
| ARHGAP36 | 1154 | 24249 | 47344 |
| ARHGAP39 | 1155 | 24250 | 47345 |
| ARHGAP4 | 1156 | 24251 | 47346 |
| ARHGAP40 | 1157 | 24252 | 47347 |
| ARHGAP42 | 1158 | 24253 | 47348 |
| ARHGAP44 | 1159 | 24254 | 47349 |
| ARHGAP44 | 1160 | 24255 | 47350 |
| ARHGAP45 | 1161 | 24256 | 47351 |
| ARHGAP5 | 1162 | 24257 | 47352 |
| ARHGAP6 | 1163 | 24258 | 47353 |
| ARHGAP6 | 1164 | 24259 | 47354 |
| ARHGAP8 | 1165 | 24260 | 47355 |
| ARHGAP8 | 1166 | 24261 | 47356 |
| ARHGAP9 | 1167 | 24262 | 47357 |
| ARHGAP9 | 1168 | 24263 | 47358 |
| ARHGDIA | 1169 | 24264 | 47359 |
| ARHGDIA | 1170 | 24265 | 47360 |
| ARHGDIA | 1171 | 24266 | 47361 |
| ARHGDIB | 1172 | 24267 | 47362 |
| ARHGDIG | 1173 | 24268 | 47363 |
| ARHGEF1 | 1174 | 24269 | 47364 |
| ARHGEF10 | 1175 | 24270 | 47365 |
| ARHGEF10L | 1176 | 24271 | 47366 |
| ARHGEF11 | 1177 | 24272 | 47367 |
| ARHGEF12 | 1178 | 24273 | 47368 |
| ARHGEF15 | 1179 | 24274 | 47369 |
| ARHGEF16 | 1180 | 24275 | 47370 |
| ARHGEF17 | 1181 | 24276 | 47371 |
| ARHGEF18 | 1182 | 24277 | 47372 |
| ARHGEF19 | 1183 | 24278 | 47373 |
| ARHGEF2 | 1184 | 24279 | 47374 |
| ARHGEF25 | 1185 | 24280 | 47375 |
| ARHGEF26 | 1186 | 24281 | 47376 |
| ARHGEF26 | 1187 | 24282 | 47377 |
| ARHGEF28 | 1188 | 24283 | 47378 |
| ARHGEF3 | 1189 | 24284 | 47379 |
| ARHGEF33 | 1190 | 24285 | 47380 |
| ARHGEF35 | 1191 | 24286 | 47381 |
| ARHGEF37 | 1192 | 24287 | 47382 |
| ARHGEF38 | 1193 | 24288 | 47383 |
| ARHGEF38 | 1194 | 24289 | 47384 |
| ARHGEF39 | 1195 | 24290 | 47385 |
| ARHGEF4 | 1196 | 24291 | 47386 |
| ARHGEF4 | 1197 | 24292 | 47387 |
| ARHGEF40 | 1198 | 24293 | 47388 |
| ARHGEF5 | 1199 | 24294 | 47389 |
| ARHGEF6 | 1200 | 24295 | 47390 |
| ARHGEF7 | 1201 | 24296 | 47391 |
| ARHGEF7 | 1202 | 24297 | 47392 |
| ARHGEF9 | 1203 | 24298 | 47393 |
| ARID1A | 1204 | 24299 | 47394 |
| ARID1B | 1205 | 24300 | 47395 |
| ARID2 | 1206 | 24301 | 47396 |
| ARID2 | 1207 | 24302 | 47397 |
| ARID3A | 1208 | 24303 | 47398 |
| ARID3B | 1209 | 24304 | 47399 |
| ARID3C | 1210 | 24305 | 47400 |
| ARID4A | 1211 | 24306 | 47401 |
| ARID4B | 1212 | 24307 | 47402 |
| ARID5A | 1213 | 24308 | 47403 |
| ARID5B | 1214 | 24309 | 47404 |
| ARIH1 | 1215 | 24310 | 47405 |
| ARIH2 | 1216 | 24311 | 47406 |
| ARIH2 | 1217 | 24312 | 47407 |
| ARIH2 | 1218 | 24313 | 47408 |
| ARIH2OS | 1219 | 24314 | 47409 |
| ARL1 | 1220 | 24315 | 47410 |
| ARL10 | 1221 | 24316 | 47411 |
| ARL10 | 1222 | 24317 | 47412 |
| ARL11 | 1223 | 24318 | 47413 |
| ARL13A | 1224 | 24319 | 47414 |
| ARL13B | 1225 | 24320 | 47415 |
| ARL14 | 1226 | 24321 | 47416 |
| ARL14EP | 1227 | 24322 | 47417 |
| ARL14EPL | 1228 | 24323 | 47418 |
| ARL15 | 1229 | 24324 | 47419 |
| ARL16 | 1230 | 24325 | 47420 |
| ARL17A | 1231 | 24326 | 47421 |
| ARL17A | 1232 | 24327 | 47422 |
| ARL17A | 1233 | 24328 | 47423 |
| ARL17A | 1234 | 24329 | 47424 |
| ARL17A | 1235 | 24330 | 47425 |
| ARL17B | 1236 | 24331 | 47426 |
| ARL2 | 1237 | 24332 | 47427 |
| ARL2BP | 1238 | 24333 | 47428 |
| ARL3 | 1239 | 24334 | 47429 |
| ARL4A | 1240 | 24335 | 47430 |
| ARL4C | 1241 | 24336 | 47431 |
| ARL4D | 1242 | 24337 | 47432 |
| ARL5A | 1243 | 24338 | 47433 |
| ARL5B | 1244 | 24339 | 47434 |
| ARL5C | 1245 | 24340 | 47435 |
| ARL6 | 1246 | 24341 | 47436 |
| ARL6 | 1247 | 24342 | 47437 |
| ARL6IP1 | 1248 | 24343 | 47438 |
| ARL6IP4 | 1249 | 24344 | 47439 |
| ARL6IP4 | 1250 | 24345 | 47440 |
| ARL6IP5 | 1251 | 24346 | 47441 |
| ARL6IP6 | 1252 | 24347 | 47442 |
| ARL8A | 1253 | 24348 | 47443 |
| ARL8A | 1254 | 24349 | 47444 |
| ARL8B | 1255 | 24350 | 47445 |
| ARL9 | 1256 | 24351 | 47446 |
| ARMC1 | 1257 | 24352 | 47447 |
| ARMC10 | 1258 | 24353 | 47448 |
| ARMC12 | 1259 | 24354 | 47449 |
| ARMC2 | 1260 | 24355 | 47450 |
| ARMC3 | 1261 | 24356 | 47451 |
| ARMC3 | 1262 | 24357 | 47452 |
| ARMC4 | 1263 | 24358 | 47453 |
| ARMC5 | 1264 | 24359 | 47454 |
| ARMC5 | 1265 | 24360 | 47455 |
| ARMC6 | 1266 | 24361 | 47456 |
| ARMC7 | 1267 | 24362 | 47457 |
| ARMC7 | 1268 | 24363 | 47458 |
| ARMC7 | 1269 | 24364 | 47459 |
| ARMC7 | 1270 | 24365 | 47460 |
| ARMC8 | 1271 | 24366 | 47461 |
| ARMC8 | 1272 | 24367 | 47462 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| ARMC9 | 1273 | 24368 | 47463 |
| ARMC9 | 1274 | 24369 | 47464 |
| ARMCX1 | 1275 | 24370 | 47465 |
| ARMCX2 | 1276 | 24371 | 47466 |
| ARMCX3 | 1277 | 24372 | 47467 |
| ARMCX4 | 1278 | 24373 | 47468 |
| ARMCX5 | 1279 | 24374 | 47469 |
| ARMCX6 | 1280 | 24375 | 47470 |
| ARMS2 | 1281 | 24376 | 47471 |
| ARMT1 | 1282 | 24377 | 47472 |
| ARNT | 1283 | 24378 | 47473 |
| ARNT2 | 1284 | 24379 | 47474 |
| ARNTL | 1285 | 24380 | 47475 |
| ARNTL2 | 1286 | 24381 | 47476 |
| ARNTL2 | 1287 | 24382 | 47477 |
| ARPC1A | 1288 | 24383 | 47478 |
| ARPC1B | 1289 | 24384 | 47479 |
| ARPC2 | 1290 | 24385 | 47480 |
| ARPC3 | 1291 | 24386 | 47481 |
| ARPC4 | 1292 | 24387 | 47482 |
| ARPC4 | 1293 | 24388 | 47483 |
| ARPC4-TTLL3 | 1294 | 24389 | 47484 |
| ARPC5 | 1295 | 24390 | 47485 |
| ARPC5L | 1296 | 24391 | 47486 |
| ARPIN | 1297 | 24392 | 47487 |
| ARPIN | 1298 | 24393 | 47488 |
| ARPP19 | 1299 | 24394 | 47489 |
| ARPP21 | 1300 | 24395 | 47490 |
| ARPP21 | 1301 | 24396 | 47491 |
| ARPP21 | 1302 | 24397 | 47492 |
| ARR3 | 1303 | 24398 | 47493 |
| ARRB1 | 1304 | 24399 | 47494 |
| ARRB2 | 1305 | 24400 | 47495 |
| ARRB2 | 1306 | 24401 | 47496 |
| ARRDC1 | 1307 | 24402 | 47497 |
| ARRDC1 | 1308 | 24403 | 47498 |
| ARRDC2 | 1309 | 24404 | 47499 |
| ARRDC3 | 1310 | 24405 | 47500 |
| ARRDC4 | 1311 | 24406 | 47501 |
| ARRDC5 | 1312 | 24407 | 47502 |
| ARSA | 1313 | 24408 | 47503 |
| ARSB | 1314 | 24409 | 47504 |
| ARSB | 1315 | 24410 | 47505 |
| ARSD | 1316 | 24411 | 47506 |
| ARSD | 1317 | 24412 | 47507 |
| ARSE | 1318 | 24413 | 47508 |
| ARSF | 1319 | 24414 | 47509 |
| ARSG | 1320 | 24415 | 47510 |
| ARSG | 1321 | 24416 | 47511 |
| ARSH | 1322 | 24417 | 47512 |
| ARSI | 1323 | 24418 | 47513 |
| ARSJ | 1324 | 24419 | 47514 |
| ARSJ | 1325 | 24420 | 47515 |
| ARSK | 1326 | 24421 | 47516 |
| ART1 | 1327 | 24422 | 47517 |
| ART3 | 1328 | 24423 | 47518 |
| ART4 | 1329 | 24424 | 47519 |
| ART5 | 1330 | 24425 | 47520 |
| ART5 | 1331 | 24426 | 47521 |
| ARTN | 1332 | 24427 | 47522 |
| ARV1 | 1333 | 24428 | 47523 |
| ARVCF | 1334 | 24429 | 47524 |
| ARX | 1335 | 24430 | 47525 |
| AS3MT | 1336 | 24431 | 47526 |
| ASAH1 | 1337 | 24432 | 47527 |
| ASAH2 | 1338 | 24433 | 47528 |
| ASAP1 | 1339 | 24434 | 47529 |
| ASAP2 | 1340 | 24435 | 47530 |
| ASAP3 | 1341 | 24436 | 47531 |
| ASB1 | 1342 | 24437 | 47532 |
| ASB10 | 1343 | 24438 | 47533 |
| ASB11 | 1344 | 24439 | 47534 |
| ASB12 | 1345 | 24440 | 47535 |
| ASB13 | 1346 | 24441 | 47536 |
| ASB14 | 1347 | 24442 | 47537 |
| ASB15 | 1348 | 24443 | 47538 |
| ASB16 | 1349 | 24444 | 47539 |
| ASB17 | 1350 | 24445 | 47540 |
| ASB18 | 1351 | 24446 | 47541 |
| ASB2 | 1352 | 24447 | 47542 |
| ASB3 | 1353 | 24448 | 47543 |
| ASB4 | 1354 | 24449 | 47544 |
| ASB4 | 1355 | 24450 | 47545 |
| ASB5 | 1356 | 24451 | 47546 |
| ASB6 | 1357 | 24452 | 47547 |
| ASB6 | 1358 | 24453 | 47548 |
| ASB7 | 1359 | 24454 | 47549 |
| ASB7 | 1360 | 24455 | 47550 |
| ASB8 | 1361 | 24456 | 47551 |
| ASB9 | 1362 | 24457 | 47552 |
| ASB9 | 1363 | 24458 | 47553 |
| ASCC1 | 1364 | 24459 | 47554 |
| ASCC1 | 1365 | 24460 | 47555 |
| ASCC2 | 1366 | 24461 | 47556 |
| ASCC3 | 1367 | 24462 | 47557 |
| ASCC3 | 1368 | 24463 | 47558 |
| ASCC3 | 1369 | 24464 | 47559 |
| ASCL1 | 1370 | 24465 | 47560 |
| ASCL2 | 1371 | 24466 | 47561 |
| ASCL3 | 1372 | 24467 | 47562 |
| ASCL4 | 1373 | 24468 | 47563 |
| ASCL5 | 1374 | 24469 | 47564 |
| ASDURF | 1375 | 24470 | 47565 |
| ASF1A | 1376 | 24471 | 47566 |
| ASF1B | 1377 | 24472 | 47567 |
| ASGR1 | 1378 | 24473 | 47568 |
| ASGR2 | 1379 | 24474 | 47569 |
| ASH1L | 1380 | 24475 | 47570 |
| ASH2L | 1381 | 24476 | 47571 |
| ASIC1 | 1382 | 24477 | 47572 |
| ASIC2 | 1383 | 24478 | 47573 |
| ASIC3 | 1384 | 24479 | 47574 |
| ASIC3 | 1385 | 24480 | 47575 |
| ASIC3 | 1386 | 24481 | 47576 |
| ASIC4 | 1387 | 24482 | 47577 |
| ASIC5 | 1388 | 24483 | 47578 |
| ASIP | 1389 | 24484 | 47579 |
| ASL | 1390 | 24485 | 47580 |
| ASMT | 1391 | 24486 | 47581 |
| ASMTL | 1392 | 24487 | 47582 |
| ASNA1 | 1393 | 24488 | 47583 |
| ASNS | 1394 | 24489 | 47584 |
| ASNSD1 | 1395 | 24490 | 47585 |
| ASPA | 1396 | 24491 | 47586 |
| ASPDH | 1397 | 24492 | 47587 |
| ASPG | 1398 | 24493 | 47588 |
| ASPH | 1399 | 24494 | 47589 |
| ASPH | 1400 | 24495 | 47590 |
| ASPH | 1401 | 24496 | 47591 |
| ASPH | 1402 | 24497 | 47592 |
| ASPHD1 | 1403 | 24498 | 47593 |
| ASPHD2 | 1404 | 24499 | 47594 |
| ASPM | 1405 | 24500 | 47595 |
| ASPN | 1406 | 24501 | 47596 |
| ASPN | 1407 | 24502 | 47597 |
| ASPRV1 | 1408 | 24503 | 47598 |
| ASPSCR1 | 1409 | 24504 | 47599 |
| ASRGL1 | 1410 | 24505 | 47600 |
| ASS1 | 1411 | 24506 | 47601 |
| ASTE1 | 1412 | 24507 | 47602 |
| ASTL | 1413 | 24508 | 47603 |
| ASTN1 | 1414 | 24509 | 47604 |
| ASTN1 | 1415 | 24510 | 47605 |
| ASTN1 | 1416 | 24511 | 47606 |
| ASTN2 | 1417 | 24512 | 47607 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| ASTN2 | 1418 | 24513 | 47608 |
| ASTN2 | 1419 | 24514 | 47609 |
| ASTN2 | 1420 | 24515 | 47610 |
| ASTN2 | 1421 | 24516 | 47611 |
| ASXL1 | 1422 | 24517 | 47612 |
| ASXL1 | 1423 | 24518 | 47613 |
| ASXL2 | 1424 | 24519 | 47614 |
| ASXL3 | 1425 | 24520 | 47615 |
| ASZ1 | 1426 | 24521 | 47616 |
| ATAD1 | 1427 | 24522 | 47617 |
| ATAD2 | 1428 | 24523 | 47618 |
| ATAD2B | 1429 | 24524 | 47619 |
| ATAD3A | 1430 | 24525 | 47620 |
| ATAD3B | 1431 | 24526 | 47621 |
| ATAD3C | 1432 | 24527 | 47622 |
| ATAD5 | 1433 | 24528 | 47623 |
| ATAT1 | 1434 | 24529 | 47624 |
| ATAT1 | 1435 | 24530 | 47625 |
| ATAT1 | 1436 | 24531 | 47626 |
| ATCAY | 1437 | 24532 | 47627 |
| ATE1 | 1438 | 24533 | 47628 |
| ATF1 | 1439 | 24534 | 47629 |
| ATF2 | 1440 | 24535 | 47630 |
| ATF2 | 1441 | 24536 | 47631 |
| ATF2 | 1442 | 24537 | 47632 |
| ATF3 | 1443 | 24538 | 47633 |
| ATF3 | 1444 | 24539 | 47634 |
| ATF4 | 1445 | 24540 | 47635 |
| ATF5 | 1446 | 24541 | 47636 |
| ATF6 | 1447 | 24542 | 47637 |
| ATF6B | 1448 | 24543 | 47638 |
| ATF7 | 1449 | 24544 | 47639 |
| ATF7 | 1450 | 24545 | 47640 |
| ATF7IP | 1451 | 24546 | 47641 |
| ATF7IP | 1452 | 24547 | 47642 |
| ATF7IP2 | 1453 | 24548 | 47643 |
| ATF7IP2 | 1454 | 24549 | 47644 |
| ATG10 | 1455 | 24550 | 47645 |
| ATG101 | 1456 | 24551 | 47646 |
| ATG12 | 1457 | 24552 | 47647 |
| ATG12 | 1458 | 24553 | 47648 |
| ATG13 | 1459 | 24554 | 47649 |
| ATG14 | 1460 | 24555 | 47650 |
| ATG16L1 | 1461 | 24556 | 47651 |
| ATG16L2 | 1462 | 24557 | 47652 |
| ATG2A | 1463 | 24558 | 47653 |
| ATG2B | 1464 | 24559 | 47654 |
| ATG3 | 1465 | 24560 | 47655 |
| ATG3 | 1466 | 24561 | 47656 |
| ATG4A | 1467 | 24562 | 47657 |
| ATG4B | 1468 | 24563 | 47658 |
| ATG4B | 1469 | 24564 | 47659 |
| ATG4C | 1470 | 24565 | 47660 |
| ATG4D | 1471 | 24566 | 47661 |
| ATG5 | 1472 | 24567 | 47662 |
| ATG5 | 1473 | 24568 | 47663 |
| ATG7 | 1474 | 24569 | 47664 |
| ATG7 | 1475 | 24570 | 47665 |
| ATG9A | 1476 | 24571 | 47666 |
| ATG9B | 1477 | 24572 | 47667 |
| ATIC | 1478 | 24573 | 47668 |
| ATL1 | 1479 | 24574 | 47669 |
| ATL2 | 1480 | 24575 | 47670 |
| ATL2 | 1481 | 24576 | 47671 |
| ATL3 | 1482 | 24577 | 47672 |
| ATM | 1483 | 24578 | 47673 |
| ATM | 1484 | 24579 | 47674 |
| ATMIN | 1485 | 24580 | 47675 |
| ATN1 | 1486 | 24581 | 47676 |
| ATOH1 | 1487 | 24582 | 47677 |
| ATOH7 | 1488 | 24583 | 47678 |
| ATOH8 | 1489 | 24584 | 47679 |
| ATOX1 | 1490 | 24585 | 47680 |
| ATP10A | 1491 | 24586 | 47681 |
| ATP10B | 1492 | 24587 | 47682 |
| ATP10D | 1493 | 24588 | 47683 |
| ATP11A | 1494 | 24589 | 47684 |
| ATP11A | 1495 | 24590 | 47685 |
| ATP11AUN | 1496 | 24591 | 47686 |
| ATP11B | 1497 | 24592 | 47687 |
| ATP11C | 1498 | 24593 | 47688 |
| ATP11C | 1499 | 24594 | 47689 |
| ATP11C | 1500 | 24595 | 47690 |
| ATP12A | 1501 | 24596 | 47691 |
| ATP13A1 | 1502 | 24597 | 47692 |
| ATP13A2 | 1503 | 24598 | 47693 |
| ATP13A2 | 1504 | 24599 | 47694 |
| ATP13A3 | 1505 | 24600 | 47695 |
| ATP13A4 | 1506 | 24601 | 47696 |
| ATP13A5 | 1507 | 24602 | 47697 |
| ATP1A1 | 1508 | 24603 | 47698 |
| ATP1A2 | 1509 | 24604 | 47699 |
| ATP1A3 | 1510 | 24605 | 47700 |
| ATP1A4 | 1511 | 24606 | 47701 |
| ATP1B1 | 1512 | 24607 | 47702 |
| ATP1B2 | 1513 | 24608 | 47703 |
| ATP1B3 | 1514 | 24609 | 47704 |
| ATP1B4 | 1515 | 24610 | 47705 |
| ATP23 | 1516 | 24611 | 47706 |
| ATP23 | 1517 | 24612 | 47707 |
| ATP2A1 | 1518 | 24613 | 47708 |
| ATP2A1 | 1519 | 24614 | 47709 |
| ATP2A2 | 1520 | 24615 | 47710 |
| ATP2A2 | 1521 | 24616 | 47711 |
| ATP2A3 | 1522 | 24617 | 47712 |
| ATP2A3 | 1523 | 24618 | 47713 |
| ATP2A3 | 1524 | 24619 | 47714 |
| ATP2A3 | 1525 | 24620 | 47715 |
| ATP2B1 | 1526 | 24621 | 47716 |
| ATP2B1 | 1527 | 24622 | 47717 |
| ATP2B2 | 1528 | 24623 | 47718 |
| ATP2B2 | 1529 | 24624 | 47719 |
| ATP2B3 | 1530 | 24625 | 47720 |
| ATP2B3 | 1531 | 24626 | 47721 |
| ATP2B4 | 1532 | 24627 | 47722 |
| ATP2B4 | 1533 | 24628 | 47723 |
| ATP2C1 | 1534 | 24629 | 47724 |
| ATP2C1 | 1535 | 24630 | 47725 |
| ATP2C1 | 1536 | 24631 | 47726 |
| ATP2C2 | 1537 | 24632 | 47727 |
| ATP4A | 1538 | 24633 | 47728 |
| ATP4B | 1539 | 24634 | 47729 |
| ATP5A1 | 1540 | 24635 | 47730 |
| ATP5B | 1541 | 24636 | 47731 |
| ATP5C1 | 1542 | 24637 | 47732 |
| ATP5D | 1543 | 24638 | 47733 |
| ATP5D | 1544 | 24639 | 47734 |
| ATP5E | 1545 | 24640 | 47735 |
| ATP5F1 | 1546 | 24641 | 47736 |
| ATP5G1 | 1547 | 24642 | 47737 |
| ATP5G2 | 1548 | 24643 | 47738 |
| ATP5G3 | 1549 | 24644 | 47739 |
| ATP5G3 | 1550 | 24645 | 47740 |
| ATP5H | 1551 | 24646 | 47741 |
| ATP5I | 1552 | 24647 | 47742 |
| ATP5J | 1553 | 24648 | 47743 |
| ATP5J2 | 1554 | 24649 | 47744 |
| ATP5L | 1555 | 24650 | 47745 |
| ATP5L2 | 1556 | 24651 | 47746 |
| ATP5O | 1557 | 24652 | 47747 |
| ATP5S | 1558 | 24653 | 47748 |
| ATP5S | 1559 | 24654 | 47749 |
| ATP5S | 1560 | 24655 | 47750 |
| ATP6AP1 | 1561 | 24656 | 47751 |
| ATP6AP1L | 1562 | 24657 | 47752 |
| ATP6AP2 | 1563 | 24658 | 47753 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| ATP6V0A1 | 1564 | 24659 | 47754 |
| ATP6V0A2 | 1565 | 24660 | 47755 |
| ATP6V0A4 | 1566 | 24661 | 47756 |
| ATP6V0B | 1567 | 24662 | 47757 |
| ATP6V0B | 1568 | 24663 | 47758 |
| ATP6V0C | 1569 | 24664 | 47759 |
| ATP6V0D1 | 1570 | 24665 | 47760 |
| ATP6V0D2 | 1571 | 24666 | 47761 |
| ATP6V0E1 | 1572 | 24667 | 47762 |
| ATP6V0E2 | 1573 | 24668 | 47763 |
| ATP6V0E2 | 1574 | 24669 | 47764 |
| ATP6V1A | 1575 | 24670 | 47765 |
| ATP6V1B1 | 1576 | 24671 | 47766 |
| ATPSV1B2 | 1577 | 24672 | 47767 |
| ATPSV1C1 | 1578 | 24673 | 47768 |
| ATP6V1C2 | 1579 | 24674 | 47769 |
| ATP6V1D | 1580 | 24675 | 47770 |
| ATP6V1E1 | 1581 | 24676 | 47771 |
| ATP6V1E2 | 1582 | 24677 | 47772 |
| ATP6V1F | 1583 | 24678 | 47773 |
| ATP6V1G1 | 1584 | 24679 | 47774 |
| ATP6V1G2 | 1585 | 24680 | 47775 |
| ATP6V1G3 | 1586 | 24681 | 47776 |
| ATP6V1H | 1587 | 24682 | 47777 |
| ATP7A | 1588 | 24683 | 47778 |
| ATP7B | 1589 | 24684 | 47779 |
| ATP8A1 | 1590 | 24685 | 47780 |
| ATP8A2 | 1591 | 24686 | 47781 |
| ATP8B1 | 1592 | 24687 | 47782 |
| ATP8B2 | 1593 | 24688 | 47783 |
| ATP8B2 | 1594 | 24689 | 47784 |
| ATP8B3 | 1595 | 24690 | 47785 |
| ATP8B4 | 1596 | 24691 | 47786 |
| ATP9A | 1597 | 24692 | 47787 |
| ATP9B | 1598 | 24693 | 47788 |
| ATPAF1 | 1599 | 24694 | 47789 |
| ATPAF2 | 1600 | 24695 | 47790 |
| ATPIF1 | 1601 | 24696 | 47791 |
| ATPIF1 | 1602 | 24697 | 47792 |
| ATR | 1603 | 24698 | 47793 |
| ATRAID | 1604 | 24699 | 47794 |
| ATRIP | 1605 | 24700 | 47795 |
| ATRN | 1606 | 24701 | 47796 |
| ATRN | 1607 | 24702 | 47797 |
| ATRN | 1608 | 24703 | 47798 |
| ATRNL1 | 1609 | 24704 | 47799 |
| ATRNL1 | 1610 | 24705 | 47800 |
| ATRX | 1611 | 24706 | 47801 |
| ATXN1 | 1612 | 24707 | 47802 |
| ATXN10 | 1613 | 24708 | 47803 |
| ATXN1L | 1614 | 24709 | 47804 |
| ATXN2 | 1615 | 24710 | 47805 |
| ATXN2L | 1616 | 24711 | 47806 |
| ATXN2L | 1617 | 24712 | 47807 |
| ATXN2L | 1618 | 24713 | 47808 |
| ATXN2L | 1619 | 24714 | 47809 |
| ATXN3 | 1620 | 24715 | 47810 |
| ATXN3 | 1621 | 24716 | 47811 |
| ATXN3 | 1622 | 24717 | 47812 |
| ATXN3L | 1623 | 24718 | 47813 |
| ATXN7 | 1624 | 24719 | 47814 |
| ATXN7 | 1625 | 24720 | 47815 |
| ATXN7L1 | 1626 | 24721 | 47816 |
| ATXN7L1 | 1627 | 24722 | 47817 |
| ATXN7L1 | 1628 | 24723 | 47818 |
| ATXN7L2 | 1629 | 24724 | 47819 |
| ATXN7L2 | 1630 | 24725 | 47820 |
| ATXN7L3 | 1631 | 24726 | 47821 |
| ATXN7L3B | 1632 | 24727 | 47822 |
| AUH | 1633 | 24728 | 47823 |
| AUNIP | 1634 | 24729 | 47824 |
| AUNIP | 1635 | 24730 | 47825 |
| AUP1 | 1636 | 24731 | 47826 |
| AURKA | 1637 | 24732 | 47827 |
| AURKAIP1 | 1638 | 24733 | 47828 |
| AURKB | 1639 | 24734 | 47829 |
| AURKB | 1640 | 24735 | 47830 |
| AURKC | 1641 | 24736 | 47831 |
| AUTS2 | 1642 | 24737 | 47832 |
| AUTS2 | 1643 | 24738 | 47833 |
| AVEN | 1644 | 24739 | 47834 |
| AVIL | 1645 | 24740 | 47835 |
| AVL9 | 1646 | 24741 | 47836 |
| AVP | 1647 | 24742 | 47837 |
| AVPI1 | 1648 | 24743 | 47838 |
| AVPR1A | 1649 | 24744 | 47839 |
| AVPR1B | 1650 | 24745 | 47840 |
| AVPR2 | 1651 | 24746 | 47841 |
| AVPR2 | 1652 | 24747 | 47842 |
| AWAT1 | 1653 | 24748 | 47843 |
| AWAT2 | 1654 | 24749 | 47844 |
| AXDND1 | 1655 | 24750 | 47845 |
| AXIN1 | 1656 | 24751 | 47846 |
| AXIN2 | 1657 | 24752 | 47847 |
| AXL | 1658 | 24753 | 47848 |
| AZGP1 | 1659 | 24754 | 47849 |
| AZI2 | 1660 | 24755 | 47850 |
| AZI2 | 1661 | 24756 | 47851 |
| AZI2 | 1662 | 24757 | 47852 |
| AZIN1 | 1663 | 24758 | 47853 |
| AZIN1 | 1664 | 24759 | 47854 |
| AZIN2 | 1665 | 24760 | 47855 |
| AZIN2 | 1666 | 24761 | 47856 |
| AZU1 | 1667 | 24762 | 47857 |
| B2M | 1668 | 24763 | 47858 |
| B3GALNT1 | 1669 | 24764 | 47859 |
| B3GALNT2 | 1670 | 24765 | 47860 |
| B3GALNT2 | 1671 | 24766 | 47861 |
| B3GALT1 | 1672 | 24767 | 47862 |
| B3GALT2 | 1673 | 24768 | 47863 |
| B3GALT4 | 1674 | 24769 | 47864 |
| B3GALT5 | 1675 | 24770 | 47865 |
| B3GALT6 | 1676 | 24771 | 47866 |
| B3GAT1 | 1677 | 24772 | 47867 |
| B3GAT2 | 1678 | 24773 | 47868 |
| B3GAT3 | 1679 | 24774 | 47869 |
| B3GAT3 | 1680 | 24775 | 47870 |
| B3GLCT | 1681 | 24776 | 47871 |
| B3GNT2 | 1682 | 24777 | 47872 |
| B3GNT3 | 1683 | 24778 | 47873 |
| B3GNT4 | 1684 | 24779 | 47874 |
| B3GNT5 | 1685 | 24780 | 47875 |
| B3GNT6 | 1686 | 24781 | 47876 |
| B3GNT7 | 1687 | 24782 | 47877 |
| B3GNT8 | 1688 | 24783 | 47878 |
| B3GNT9 | 1689 | 24784 | 47879 |
| B3GNTL1 | 1690 | 24785 | 47880 |
| B4GALNT1 | 1691 | 24786 | 47881 |
| B4GALNT1 | 1692 | 24787 | 47882 |
| B4GALNT2 | 1693 | 24788 | 47883 |
| B4GALNT3 | 1694 | 24789 | 47884 |
| B4GALNT4 | 1695 | 24790 | 47885 |
| B4GALT1 | 1696 | 24791 | 47886 |
| B4GALT2 | 1697 | 24792 | 47887 |
| B4GALT3 | 1698 | 24793 | 47888 |
| B4GALT4 | 1699 | 24794 | 47889 |
| B4GALT5 | 1700 | 24795 | 47890 |
| B4GALT6 | 1701 | 24796 | 47891 |
| B4GALT7 | 1702 | 24797 | 47892 |
| B4GAT1 | 1703 | 24798 | 47893 |
| B9D1 | 1704 | 24799 | 47894 |
| B9D1 | 1705 | 24800 | 47895 |
| B9D1 | 1706 | 24801 | 47896 |
| B9D1 | 1707 | 24802 | 47897 |
| B9D1 | 1708 | 24803 | 47898 |
| B9D1 | 1709 | 24804 | 47899 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| B9D2 | 1710 | 24805 | 47900 |
| BAALC | 1711 | 24806 | 47901 |
| BAAT | 1712 | 24807 | 47902 |
| BABAM1 | 1713 | 24808 | 47903 |
| BABAM2 | 1714 | 24809 | 47904 |
| BABAM2 | 1715 | 24810 | 47905 |
| BABAM2 | 1716 | 24811 | 47906 |
| BABAM2 | 1717 | 24812 | 47907 |
| BACE1 | 1718 | 24813 | 47908 |
| BACE2 | 1719 | 24814 | 47909 |
| BACE2 | 1720 | 24815 | 47910 |
| BACH1 | 1721 | 24816 | 47911 |
| BACH2 | 1722 | 24817 | 47912 |
| BAD | 1723 | 24818 | 47913 |
| BAG1 | 1724 | 24819 | 47914 |
| BAG2 | 1725 | 24820 | 47915 |
| BAG3 | 1726 | 24821 | 47916 |
| BAG4 | 1727 | 24822 | 47917 |
| BAG5 | 1728 | 24823 | 47918 |
| BAG6 | 1729 | 24824 | 47919 |
| BAGE | 1730 | 24825 | 47920 |
| BAGE2 | 1731 | 24826 | 47921 |
| BAGE4 | 1732 | 24827 | 47922 |
| BAGE5 | 1733 | 24828 | 47923 |
| BAHCC1 | 1734 | 24829 | 47924 |
| BAHD1 | 1735 | 24830 | 47925 |
| BAIAP2 | 1736 | 24831 | 47926 |
| BAIAP2 | 1737 | 24832 | 47927 |
| BAIAP2 | 1738 | 24833 | 47928 |
| BAIAP2 | 1739 | 24834 | 47929 |
| BAIAP2L1 | 1740 | 24835 | 47930 |
| BAIAP2L2 | 1741 | 24836 | 47931 |
| BAIAP3 | 1742 | 24837 | 47932 |
| BAK1 | 1743 | 24838 | 47933 |
| BAMBI | 1744 | 24839 | 47934 |
| BANF1 | 1745 | 24840 | 47935 |
| BANF2 | 1746 | 24841 | 47936 |
| BANK1 | 1747 | 24842 | 47937 |
| BANP | 1748 | 24843 | 47938 |
| BAP1 | 1749 | 24844 | 47939 |
| BARD1 | 1750 | 24845 | 47940 |
| BARHL1 | 1751 | 24846 | 47941 |
| BARHL2 | 1752 | 24847 | 47942 |
| BARX1 | 1753 | 24848 | 47943 |
| BARX2 | 1754 | 24849 | 47944 |
| BASP1 | 1755 | 24850 | 47945 |
| BATF | 1756 | 24851 | 47946 |
| BATF2 | 1757 | 24852 | 47947 |
| BATF2 | 1758 | 24853 | 47948 |
| BATF3 | 1759 | 24854 | 47949 |
| BAX | 1760 | 24855 | 47950 |
| BAX | 1761 | 24856 | 47951 |
| BAX | 1762 | 24857 | 47952 |
| BAZ1A | 1763 | 24858 | 47953 |
| BAZ1B | 1764 | 24859 | 47954 |
| BAZ2A | 1765 | 24860 | 47955 |
| BAZ2B | 1766 | 24861 | 47956 |
| BBC3 | 1767 | 24862 | 47957 |
| BBC3 | 1768 | 24863 | 47958 |
| BBIP1 | 1769 | 24864 | 47959 |
| BBIP1 | 1770 | 24865 | 47960 |
| BBOF1 | 1771 | 24866 | 47961 |
| BBOX1 | 1772 | 24867 | 47962 |
| BBS1 | 1773 | 24868 | 47963 |
| BBS10 | 1774 | 24869 | 47964 |
| BBS12 | 1775 | 24870 | 47965 |
| BBS2 | 1776 | 24871 | 47966 |
| BBS4 | 1777 | 24872 | 47967 |
| BBS5 | 1778 | 24873 | 47968 |
| BBS7 | 1779 | 24874 | 47969 |
| BBS7 | 1780 | 24875 | 47970 |
| BBS9 | 1781 | 24876 | 47971 |
| BBS9 | 1782 | 24877 | 47972 |
| BBX | 1783 | 24878 | 47973 |
| BBX | 1784 | 24879 | 47974 |
| BCAM | 1785 | 24880 | 47975 |
| BCAM | 1786 | 24881 | 47976 |
| BCAN | 1787 | 24882 | 47977 |
| BCAN | 1788 | 24883 | 47978 |
| BCAP29 | 1789 | 24884 | 47979 |
| BCAP29 | 1790 | 24885 | 47980 |
| BCAP31 | 1791 | 24886 | 47981 |
| BCAR1 | 1792 | 24887 | 47982 |
| BCAR3 | 1793 | 24888 | 47983 |
| BCAS1 | 1794 | 24889 | 47984 |
| BCAS2 | 1795 | 24890 | 47985 |
| BCAS3 | 1796 | 24891 | 47986 |
| BCAS3 | 1797 | 24892 | 47987 |
| BCAS4 | 1798 | 24893 | 47988 |
| BCAS4 | 1799 | 24894 | 47989 |
| BCAT1 | 1800 | 24895 | 47990 |
| BCAT2 | 1801 | 24896 | 47991 |
| BCCIP | 1802 | 24897 | 47992 |
| BCCIP | 1803 | 24898 | 47993 |
| BCCIP | 1804 | 24899 | 47994 |
| BCDIN3D | 1805 | 24900 | 47995 |
| BCHE | 1806 | 24901 | 47996 |
| BCKDHA | 1807 | 24902 | 47997 |
| BCKDHB | 1808 | 24903 | 47998 |
| BCKDK | 1809 | 24904 | 47999 |
| BCKDK | 1810 | 24905 | 48000 |
| BCL10 | 1811 | 24906 | 48001 |
| BCL11A | 1812 | 24907 | 48002 |
| BCL11A | 1813 | 24908 | 48003 |
| BCL11B | 1814 | 24909 | 48004 |
| BCL2 | 1815 | 24910 | 48005 |
| BCL2 | 1816 | 24911 | 48006 |
| BCL2A1 | 1817 | 24912 | 48007 |
| BCL2A1 | 1818 | 24913 | 48008 |
| BCL2L1 | 1819 | 24914 | 48009 |
| BCL2L1 | 1820 | 24915 | 48010 |
| BCL2L10 | 1821 | 24916 | 48011 |
| BCL2L10 | 1822 | 24917 | 48012 |
| BCL2L11 | 1823 | 24918 | 48013 |
| BCL2L11 | 1824 | 24919 | 48014 |
| BCL2L11 | 1825 | 24920 | 48015 |
| BCL2L11 | 1826 | 24921 | 48016 |
| BCL2L11 | 1827 | 24922 | 48017 |
| BCL2L11 | 1828 | 24923 | 48018 |
| BCL2L11 | 1829 | 24924 | 48019 |
| BCL2L11 | 1830 | 24925 | 48020 |
| BCL2L12 | 1831 | 24926 | 48021 |
| BCL2L12 | 1832 | 24927 | 48022 |
| BCL2L13 | 1833 | 24928 | 48023 |
| BCL2L14 | 1834 | 24929 | 48024 |
| BCL2L14 | 1835 | 24930 | 48025 |
| BCL2L15 | 1836 | 24931 | 48026 |
| BCL2L2 | 1837 | 24932 | 48027 |
| BCL3 | 1838 | 24933 | 48028 |
| BCL6 | 1839 | 24934 | 48029 |
| BCL6B | 1840 | 24935 | 48030 |
| BCL7A | 1841 | 24936 | 48031 |
| BCL7B | 1842 | 24937 | 48032 |
| BCL7C | 1843 | 24938 | 48033 |
| BCL7C | 1844 | 24939 | 48034 |
| BCL9 | 1845 | 24940 | 48035 |
| BCL9L | 1846 | 24941 | 48036 |
| BCLAF1 | 1847 | 24942 | 48037 |
| BCLAF3 | 1848 | 24943 | 48038 |
| BCO1 | 1849 | 24944 | 48039 |
| BCO2 | 1850 | 24945 | 48040 |
| BCOR | 1851 | 24946 | 48041 |
| BCORL1 | 1852 | 24947 | 48042 |
| BCR | 1853 | 24948 | 48043 |
| BCS1L | 1854 | 24949 | 48044 |
| BDH1 | 1855 | 24950 | 48045 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| BDH2 | 1856 | 24951 | 48046 |
| BDKRB1 | 1857 | 24952 | 48047 |
| BDKRB2 | 1858 | 24953 | 48048 |
| BDNF | 1859 | 24954 | 48049 |
| BDP1 | 1860 | 24955 | 48050 |
| BEAN1 | 1861 | 24956 | 48051 |
| BEAN1 | 1862 | 24957 | 48052 |
| BECN1 | 1863 | 24958 | 48053 |
| BECN1 | 1864 | 24959 | 48054 |
| BECN2 | 1865 | 24960 | 48055 |
| BEGAIN | 1866 | 24961 | 48056 |
| BEND2 | 1867 | 24962 | 48057 |
| BEND2 | 1868 | 24963 | 48058 |
| BEND3 | 1869 | 24964 | 48059 |
| BEND4 | 1870 | 24965 | 48060 |
| BEND4 | 1871 | 24966 | 48061 |
| BEND5 | 1872 | 24967 | 48062 |
| BEND6 | 1873 | 24968 | 48063 |
| BEND6 | 1874 | 24969 | 48064 |
| BEND7 | 1875 | 24970 | 48065 |
| BEND7 | 1876 | 24971 | 48066 |
| BEST1 | 1877 | 24972 | 48067 |
| BEST1 | 1878 | 24973 | 48068 |
| BEST2 | 1879 | 24974 | 48069 |
| BEST3 | 1880 | 24975 | 48070 |
| BEST3 | 1881 | 24976 | 48071 |
| BEST3 | 1882 | 24977 | 48072 |
| BEST4 | 1883 | 24978 | 48073 |
| BET1 | 1884 | 24979 | 48074 |
| BET1 | 1885 | 24980 | 48075 |
| BET1L | 1886 | 24981 | 48076 |
| BEX2 | 1887 | 24982 | 48077 |
| BEX3 | 1888 | 24983 | 48078 |
| BEX4 | 1889 | 24984 | 48079 |
| BEX5 | 1890 | 24985 | 48080 |
| BFAR | 1891 | 24986 | 48081 |
| BFSP1 | 1892 | 24987 | 48082 |
| BFSP2 | 1893 | 24988 | 48083 |
| BGLAP | 1894 | 24989 | 48084 |
| BGN | 1895 | 24990 | 48085 |
| BHLHA15 | 1896 | 24991 | 48086 |
| BHLHA9 | 1897 | 24992 | 48087 |
| BHLHB9 | 1898 | 24993 | 48088 |
| BHLHE22 | 1899 | 24994 | 48089 |
| BHLHE23 | 1900 | 24995 | 48090 |
| BHLHE40 | 1901 | 24996 | 48091 |
| BHLHE41 | 1902 | 24997 | 48092 |
| BHMG1 | 1903 | 24998 | 48093 |
| BHMT | 1904 | 24999 | 48094 |
| BHMT2 | 1905 | 25000 | 48095 |
| BICC1 | 1906 | 25001 | 48096 |
| BICD1 | 1907 | 25002 | 48097 |
| BICD1 | 1908 | 25003 | 48098 |
| BICD2 | 1909 | 25004 | 48099 |
| BICD2 | 1910 | 25005 | 48100 |
| BICDL1 | 1911 | 25006 | 48101 |
| BICDL2 | 1912 | 25007 | 48102 |
| BICRA | 1913 | 25008 | 48103 |
| BICRAL | 1914 | 25009 | 48104 |
| BID | 1915 | 25010 | 48105 |
| BIK | 1916 | 25011 | 48106 |
| BIN1 | 1917 | 25012 | 48107 |
| BIN2 | 1918 | 25013 | 48108 |
| BIN3 | 1919 | 25014 | 48109 |
| BIRC2 | 1920 | 25015 | 48110 |
| BIRC3 | 1921 | 25016 | 48111 |
| BIRC5 | 1922 | 25017 | 48112 |
| BIRC5 | 1923 | 25018 | 48113 |
| BIRC6 | 1924 | 25019 | 48114 |
| BIRC7 | 1925 | 25020 | 48115 |
| BIRC8 | 1926 | 25021 | 48116 |
| BIVM | 1927 | 25022 | 48117 |
| BLCAP | 1928 | 25023 | 48118 |
| BUD | 1929 | 25024 | 48119 |
| BLK | 1930 | 25025 | 48120 |
| BLM | 1931 | 25026 | 48121 |
| BLMH | 1932 | 25027 | 48122 |
| BLNK | 1933 | 25028 | 48123 |
| BLOC1S1 | 1934 | 25029 | 48124 |
| BLOC1S2 | 1935 | 25030 | 48125 |
| BLOC1S3 | 1936 | 25031 | 48126 |
| BLOC1S4 | 1937 | 25032 | 48127 |
| BLOC1S5 | 1938 | 25033 | 48128 |
| BLOC1S5 | 1939 | 25034 | 48129 |
| BLOC1S6 | 1940 | 25035 | 48130 |
| BLOC1S6 | 1941 | 25036 | 48131 |
| BLVRA | 1942 | 25037 | 48132 |
| BLVRB | 1943 | 25038 | 48133 |
| BLZF1 | 1944 | 25039 | 48134 |
| BLZF1 | 1945 | 25040 | 48135 |
| BMF | 1946 | 25041 | 48136 |
| BMF | 1947 | 25042 | 48137 |
| BMI1 | 1948 | 25043 | 48138 |
| BMP1 | 1949 | 25044 | 48139 |
| BMP1 | 1950 | 25045 | 48140 |
| BMP10 | 1951 | 25046 | 48141 |
| BMP15 | 1952 | 25047 | 48142 |
| BMP2 | 1953 | 25048 | 48143 |
| BMP2K | 1954 | 25049 | 48144 |
| BMP2K | 1955 | 25050 | 48145 |
| BMP3 | 1956 | 25051 | 48146 |
| BMP4 | 1957 | 25052 | 48147 |
| BMP5 | 1958 | 25053 | 48148 |
| BMP5 | 1959 | 25054 | 48149 |
| BMP6 | 1960 | 25055 | 48150 |
| BMP7 | 1961 | 25056 | 48151 |
| BMP8A | 1962 | 25057 | 48152 |
| BMP8B | 1963 | 25058 | 48153 |
| BMPER | 1964 | 25059 | 48154 |
| BMPR1A | 1965 | 25060 | 48155 |
| BMPR1B | 1966 | 25061 | 48156 |
| BMPR2 | 1967 | 25062 | 48157 |
| BMS1 | 1968 | 25063 | 48158 |
| BMT2 | 1969 | 25064 | 48159 |
| BMX | 1970 | 25065 | 48160 |
| BNC1 | 1971 | 25066 | 48161 |
| BNC2 | 1972 | 25067 | 48162 |
| BNC2 | 1973 | 25068 | 48163 |
| BNIP1 | 1974 | 25069 | 48164 |
| BNIP2 | 1975 | 25070 | 48165 |
| BNIP3 | 1976 | 25071 | 48166 |
| BNIP3L | 1977 | 25072 | 48167 |
| BNIPL | 1978 | 25073 | 48168 |
| BOC | 1979 | 25074 | 48169 |
| BOC | 1980 | 25075 | 48170 |
| BOD1 | 1981 | 25076 | 48171 |
| BOD1L1 | 1982 | 25077 | 48172 |
| BOD1L2 | 1983 | 25078 | 48173 |
| BOK | 1984 | 25079 | 48174 |
| BOLA1 | 1985 | 25080 | 48175 |
| BOLA2 | 1986 | 25081 | 48176 |
| BOLA2 | 1987 | 25082 | 48177 |
| BOLA2-SMG1P6 | 1988 | 25083 | 48178 |
| BOLA3 | 1989 | 25084 | 48179 |
| BOLA3 | 1990 | 25085 | 48180 |
| BOLL | 1991 | 25086 | 48181 |
| BOLL | 1992 | 25087 | 48182 |
| BOP1 | 1993 | 25088 | 48183 |
| BORA | 1994 | 25089 | 48184 |
| BORCS5 | 1995 | 25090 | 48185 |
| BORCS6 | 1996 | 25091 | 48186 |
| BORCS7 | 1997 | 25092 | 48187 |
| BORCS8 | 1998 | 25093 | 48188 |
| BORCS8 | 1999 | 25094 | 48189 |
| BORCS8- | 2000 | 25095 | 48190 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| MEF2B | | | |
| BPGM | 2001 | 25096 | 48191 |
| BPHL | 2002 | 25097 | 48192 |
| BPI | 2003 | 25098 | 48193 |
| BPIFA1 | 2004 | 25099 | 48194 |
| BPIFA2 | 2005 | 25100 | 48195 |
| BPIFA3 | 2006 | 25101 | 48196 |
| BPIFB1 | 2007 | 25102 | 48197 |
| BPIFB2 | 2008 | 25103 | 48198 |
| BPIFB3 | 2009 | 25104 | 48199 |
| BPIFB4 | 2010 | 25105 | 48200 |
| BPIFB6 | 2011 | 25106 | 48201 |
| BPIFC | 2012 | 25107 | 48202 |
| BPNT1 | 2013 | 25108 | 48203 |
| BPTF | 2014 | 25109 | 48204 |
| BPY2 | 2015 | 25110 | 48205 |
| BRAF | 2016 | 25111 | 48206 |
| BRAP | 2017 | 25112 | 48207 |
| BRAT1 | 2018 | 25113 | 48208 |
| BRCA1 | 2019 | 25114 | 48209 |
| BRCA1 | 2020 | 25115 | 48210 |
| BRCA2 | 2021 | 25116 | 48211 |
| BRCC3 | 2022 | 25117 | 48212 |
| BRD1 | 2023 | 25118 | 48213 |
| BRD2 | 2024 | 25119 | 48214 |
| BRD3 | 2025 | 25120 | 48215 |
| BRD4 | 2026 | 25121 | 48216 |
| BRD4 | 2027 | 25122 | 48217 |
| BRD4 | 2028 | 25123 | 48218 |
| BRD7 | 2029 | 25124 | 48219 |
| BRD8 | 2030 | 25125 | 48220 |
| BRD8 | 2031 | 25126 | 48221 |
| BRD9 | 2032 | 25127 | 48222 |
| BRDT | 2033 | 25128 | 48223 |
| BRF1 | 2034 | 25129 | 48224 |
| BRF1 | 2035 | 25130 | 48225 |
| BRF2 | 2036 | 25131 | 48226 |
| BRI3 | 2037 | 25132 | 48227 |
| BRI3 | 2038 | 25133 | 48228 |
| BRI3BP | 2039 | 25134 | 48229 |
| BRICD5 | 2040 | 25135 | 48230 |
| BRINP1 | 2041 | 25136 | 48231 |
| BRINP2 | 2042 | 25137 | 48232 |
| BRINP3 | 2043 | 25138 | 48233 |
| BRIP1 | 2044 | 25139 | 48234 |
| BRIX1 | 2045 | 25140 | 48235 |
| BRK1 | 2046 | 25141 | 48236 |
| BRMS1 | 2047 | 25142 | 48237 |
| BRMS1 | 2048 | 25143 | 48238 |
| BRMS1L | 2049 | 25144 | 48239 |
| BROX | 2050 | 25145 | 48240 |
| BROX | 2051 | 25146 | 48241 |
| BRPF1 | 2052 | 25147 | 48242 |
| BRPF3 | 2053 | 25148 | 48243 |
| BRS3 | 2054 | 25149 | 48244 |
| BRSK1 | 2055 | 25150 | 48245 |
| BRSK2 | 2056 | 25151 | 48246 |
| BRSK2 | 2057 | 25152 | 48247 |
| BRSK2 | 2058 | 25153 | 48248 |
| BRWD1 | 2059 | 25154 | 48249 |
| BRWD1 | 2060 | 25155 | 48250 |
| BRWD1 | 2061 | 25156 | 48251 |
| BRWD3 | 2062 | 25157 | 48252 |
| BSCL2 | 2063 | 25158 | 48253 |
| BSCL2 | 2064 | 25159 | 48254 |
| BSDC1 | 2065 | 25160 | 48255 |
| BSDC1 | 2066 | 25161 | 48256 |
| BSG | 2067 | 25162 | 48257 |
| BSN | 2068 | 25163 | 48258 |
| BSND | 2069 | 25164 | 48259 |
| BSPH1 | 2070 | 25165 | 48260 |
| BSPRY | 2071 | 25166 | 48261 |
| BSPRY | 2072 | 25167 | 48262 |
| BST1 | 2073 | 25168 | 48263 |
| BST2 | 2074 | 25169 | 48264 |
| BSX | 2075 | 25170 | 48265 |
| BTAF1 | 2076 | 25171 | 48266 |
| BTBD1 | 2077 | 25172 | 48267 |
| BTBD1 | 2078 | 25173 | 48268 |
| BTBD10 | 2079 | 25174 | 48269 |
| BTBD11 | 2080 | 25175 | 48270 |
| BTBD16 | 2081 | 25176 | 48271 |
| BTBD17 | 2082 | 25177 | 48272 |
| BTBD18 | 2083 | 25178 | 48273 |
| BTBD19 | 2084 | 25179 | 48274 |
| BTBD2 | 2085 | 25180 | 48275 |
| BTBD3 | 2086 | 25181 | 48276 |
| BTBD6 | 2087 | 25182 | 48277 |
| BTBD7 | 2088 | 25183 | 48278 |
| BTBD7 | 2089 | 25184 | 48279 |
| BTBD8 | 2090 | 25185 | 48280 |
| BTBD9 | 2091 | 25186 | 48281 |
| BTC | 2092 | 25187 | 48282 |
| BTD | 2093 | 25188 | 48283 |
| BTD | 2094 | 25189 | 48284 |
| BTF3 | 2095 | 25190 | 48285 |
| BTF3L4 | 2096 | 25191 | 48286 |
| BTG1 | 2097 | 25192 | 48287 |
| BTG2 | 2098 | 25193 | 48288 |
| BTG3 | 2099 | 25194 | 48289 |
| BTG4 | 2100 | 25195 | 48290 |
| BTK | 2101 | 25196 | 48291 |
| BTLA | 2102 | 25197 | 48292 |
| BTN1A1 | 2103 | 25198 | 48293 |
| BTN2A1 | 2104 | 25199 | 48294 |
| BTN2A1 | 2105 | 25200 | 48295 |
| BTN2A1 | 2106 | 25201 | 48296 |
| BTN2A2 | 2107 | 25202 | 48297 |
| BTN2A2 | 2108 | 25203 | 48298 |
| BTN3A1 | 2109 | 25204 | 48299 |
| BTN3A1 | 2110 | 25205 | 48300 |
| BTN3A1 | 2111 | 25206 | 48301 |
| BTN3A2 | 2112 | 25207 | 48302 |
| BTN3A3 | 2113 | 25208 | 48303 |
| BTNL10 | 2114 | 25209 | 48304 |
| BTNL2 | 2115 | 25210 | 48305 |
| BTNL3 | 2116 | 25211 | 48306 |
| BTNL8 | 2117 | 25212 | 48307 |
| BTNL8 | 2118 | 25213 | 48308 |
| BTNL9 | 2119 | 25214 | 48309 |
| BTNL9 | 2120 | 25215 | 48310 |
| BTRC | 2121 | 25216 | 48311 |
| BUB1 | 2122 | 25217 | 48312 |
| BUB1B | 2123 | 25218 | 48313 |
| BUB3 | 2124 | 25219 | 48314 |
| BUB3 | 2125 | 25220 | 48315 |
| BUD13 | 2126 | 25221 | 48316 |
| BUD23 | 2127 | 25222 | 48317 |
| BUD31 | 2128 | 25223 | 48318 |
| BVES | 2129 | 25224 | 48319 |
| BYSL | 2130 | 25225 | 48320 |
| BZW1 | 2131 | 25226 | 48321 |
| BZW2 | 2132 | 25227 | 48322 |
| C10orf10 | 2133 | 25228 | 48323 |
| C10orf105 | 2134 | 25229 | 48324 |
| C10orf111 | 2135 | 25230 | 48325 |
| C10orf113 | 2136 | 25231 | 48326 |
| C10orf113 | 2137 | 25232 | 48327 |
| C10orf120 | 2138 | 25233 | 48328 |
| C10orf126 | 2139 | 25234 | 48329 |
| C10orf128 | 2140 | 25235 | 48330 |
| C10orf128 | 2141 | 25236 | 48331 |
| C10orf128 | 2142 | 25237 | 48332 |
| C10orf128 | 2143 | 25238 | 48333 |
| C10orf128 | 2144 | 25239 | 48334 |
| C10orf128 | 2145 | 25240 | 48335 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| C10orf142 | 2146 | 25241 | 48336 |
| C10orf25 | 2147 | 25242 | 48337 |
| C10orf53 | 2148 | 25243 | 48338 |
| C10orf53 | 2149 | 25244 | 48339 |
| C10orf55 | 2150 | 25245 | 48340 |
| C10orf62 | 2151 | 25246 | 48341 |
| C10orf67 | 2152 | 25247 | 48342 |
| C10orf67 | 2153 | 25248 | 48343 |
| C10orf71 | 2154 | 25249 | 48344 |
| C10orf76 | 2155 | 25250 | 48345 |
| C10orf82 | 2156 | 25251 | 48346 |
| C10orf82 | 2157 | 25252 | 48347 |
| C10orf88 | 2158 | 25253 | 48348 |
| C10orf90 | 2159 | 25254 | 48349 |
| C10orf90 | 2160 | 25255 | 48350 |
| C10orf91 | 2161 | 25256 | 48351 |
| C10orf95 | 2162 | 25257 | 48352 |
| C10orf99 | 2163 | 25258 | 48353 |
| C11orf1 | 2164 | 25259 | 48354 |
| C11orf16 | 2165 | 25260 | 48355 |
| C11orf21 | 2166 | 25261 | 48356 |
| C11orf24 | 2167 | 25262 | 48357 |
| C11orf40 | 2168 | 25263 | 48358 |
| C11orf42 | 2169 | 25264 | 48359 |
| C11orf44 | 2170 | 25265 | 48360 |
| C11orf45 | 2171 | 25266 | 48361 |
| C11orf49 | 2172 | 25267 | 48362 |
| C11orf49 | 2173 | 25268 | 48363 |
| C11orf49 | 2174 | 25269 | 48364 |
| C11orf52 | 2175 | 25270 | 48365 |
| C11orf53 | 2176 | 25271 | 48366 |
| C11orf54 | 2177 | 25272 | 48367 |
| C11orf57 | 2178 | 25273 | 48368 |
| C11orf58 | 2179 | 25274 | 48369 |
| C11orf63 | 2180 | 25275 | 48370 |
| C11orf63 | 2181 | 25276 | 48371 |
| C11orf65 | 2182 | 25277 | 48372 |
| C11orf65 | 2183 | 25278 | 48373 |
| C11orf65 | 2184 | 25279 | 48374 |
| C11orf68 | 2185 | 25280 | 48375 |
| C11orf70 | 2186 | 25281 | 48376 |
| C11orf70 | 2187 | 25282 | 48377 |
| C11orf71 | 2188 | 25283 | 48378 |
| C11orf71 | 2189 | 25284 | 48379 |
| C11orf74 | 2190 | 25285 | 48380 |
| C11orf80 | 2191 | 25286 | 48381 |
| C11orf84 | 2192 | 25287 | 48382 |
| C11orf86 | 2193 | 25288 | 48383 |
| C11orf87 | 2194 | 25289 | 48384 |
| C11orf88 | 2195 | 25290 | 48385 |
| C11orf91 | 2196 | 25291 | 48386 |
| C11orf94 | 2197 | 25292 | 48387 |
| C11orf95 | 2198 | 25293 | 48388 |
| C11orf96 | 2199 | 25294 | 48389 |
| C11orf97 | 2200 | 25295 | 48390 |
| C11orf98 | 2201 | 25296 | 48391 |
| C12orf10 | 2202 | 25297 | 48392 |
| C12orf29 | 2203 | 25298 | 48393 |
| C12orf4 | 2204 | 25299 | 48394 |
| C12orf40 | 2205 | 25300 | 48395 |
| C12orf40 | 2206 | 25301 | 48396 |
| C12orf42 | 2207 | 25302 | 48397 |
| C12orf43 | 2208 | 25303 | 48398 |
| C12orf45 | 2209 | 25304 | 48399 |
| C12orf49 | 2210 | 25305 | 48400 |
| C12orf49 | 2211 | 25306 | 48401 |
| C12orf50 | 2212 | 25307 | 48402 |
| C12orf54 | 2213 | 25308 | 48403 |
| C12orf56 | 2214 | 25309 | 48404 |
| C12orf57 | 2215 | 25310 | 48405 |
| C12orf60 | 2216 | 25311 | 48406 |
| C12orf65 | 2217 | 25312 | 48407 |
| C12orf66 | 2218 | 25313 | 48408 |
| C12orf66 | 2219 | 25314 | 48409 |
| C12orf71 | 2220 | 25315 | 48410 |
| C12orf73 | 2221 | 25316 | 48411 |
| C12orf74 | 2222 | 25317 | 48412 |
| C12orf74 | 2223 | 25318 | 48413 |
| C12orf75 | 2224 | 25319 | 48414 |
| C12orf76 | 2225 | 25320 | 48415 |
| C12orf77 | 2226 | 25321 | 48416 |
| C12orf80 | 2227 | 25322 | 48417 |
| C13orf42 | 2228 | 25323 | 48418 |
| C14orf119 | 2229 | 25324 | 48419 |
| C14orf132 | 2230 | 25325 | 48420 |
| C14orf132 | 2231 | 25326 | 48421 |
| C14orf166 | 2232 | 25327 | 48422 |
| C14orf177 | 2233 | 25328 | 48423 |
| C14orf178 | 2234 | 25329 | 48424 |
| C14orf180 | 2235 | 25330 | 48425 |
| C14orf180 | 2236 | 25331 | 48426 |
| C14orf2 | 2237 | 25332 | 48427 |
| C14orf28 | 2238 | 25333 | 48428 |
| C14orf37 | 2239 | 25334 | 48429 |
| C14orf37 | 2240 | 25335 | 48430 |
| C14orf39 | 2241 | 25336 | 48431 |
| C14orf93 | 2242 | 25337 | 48432 |
| C15orf32 | 2243 | 25338 | 48433 |
| C15orf32 | 2244 | 25339 | 48434 |
| C15orf39 | 2245 | 25340 | 48435 |
| C15orf40 | 2246 | 25341 | 48436 |
| C15orf40 | 2247 | 25342 | 48437 |
| C15orf40 | 2248 | 25343 | 48438 |
| C15orf40 | 2249 | 25344 | 48439 |
| C15orf40 | 2250 | 25345 | 48440 |
| C15orf41 | 2251 | 25346 | 48441 |
| C15orf41 | 2252 | 25347 | 48442 |
| C15orf41 | 2253 | 25348 | 48443 |
| C15orf48 | 2254 | 25349 | 48444 |
| C15orf52 | 2255 | 25350 | 48445 |
| C15orf53 | 2256 | 25351 | 48446 |
| C15orf56 | 2257 | 25352 | 48447 |
| C15orf59 | 2258 | 25353 | 48448 |
| C15orf61 | 2259 | 25354 | 48449 |
| C15orf62 | 2260 | 25355 | 48450 |
| C15orf65 | 2261 | 25356 | 48451 |
| C16orf45 | 2262 | 25357 | 48452 |
| C16orf46 | 2263 | 25358 | 48453 |
| C16orf46 | 2264 | 25359 | 48454 |
| C16orf47 | 2265 | 25360 | 48455 |
| C16orf52 | 2266 | 25361 | 48456 |
| C16orf54 | 2267 | 25362 | 48457 |
| C16orf58 | 2268 | 25363 | 48458 |
| C16orf62 | 2269 | 25364 | 48459 |
| C16orf70 | 2270 | 25365 | 48460 |
| C16orf71 | 2271 | 25366 | 48461 |
| C16orf72 | 2272 | 25367 | 48462 |
| C16orf74 | 2273 | 25368 | 48463 |
| C16orf78 | 2274 | 25369 | 48464 |
| C16orf82 | 2275 | 25370 | 48465 |
| C16orf86 | 2276 | 25371 | 48466 |
| C16orf87 | 2277 | 25372 | 48467 |
| C16orf87 | 2278 | 25373 | 48468 |
| C16orf89 | 2279 | 25374 | 48469 |
| C16orf89 | 2280 | 25375 | 48470 |
| C16orf90 | 2281 | 25376 | 48471 |
| C16orf91 | 2282 | 25377 | 48472 |
| C16orf92 | 2283 | 25378 | 48473 |
| C16orf92 | 2284 | 25379 | 48474 |
| C16orf95 | 2285 | 25380 | 48475 |
| C16orf95 | 2286 | 25381 | 48476 |
| C16orf96 | 2287 | 25382 | 48477 |
| C16orf97 | 2288 | 25383 | 48478 |
| C17orf100 | 2289 | 25384 | 48479 |
| C17orf102 | 2290 | 25385 | 48480 |
| C17orf105 | 2291 | 25386 | 48481 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| C17orf105 | 2292 | 25387 | 48482 |
| C17orf107 | 2293 | 25388 | 48483 |
| C17orf112 | 2294 | 25389 | 48484 |
| C17orf47 | 2295 | 25390 | 48485 |
| C17orf49 | 2296 | 25391 | 48486 |
| C17orf49 | 2297 | 25392 | 48487 |
| C17orf50 | 2298 | 25393 | 48488 |
| C17orf51 | 2299 | 25394 | 48489 |
| C17orf53 | 2300 | 25395 | 48490 |
| C17orf53 | 2301 | 25396 | 48491 |
| C17orf58 | 2302 | 25397 | 48492 |
| C17orf58 | 2303 | 25398 | 48493 |
| C17orf62 | 2304 | 25399 | 48494 |
| C17orf64 | 2305 | 25400 | 48495 |
| C17orf67 | 2306 | 25401 | 48496 |
| C17orf75 | 2307 | 25402 | 48497 |
| C17orf77 | 2308 | 25403 | 48498 |
| C17orf78 | 2309 | 25404 | 48499 |
| C17orf78 | 2310 | 25405 | 48500 |
| C17orf80 | 2311 | 25406 | 48501 |
| C17orf80 | 2312 | 25407 | 48502 |
| C17orf82 | 2313 | 25408 | 48503 |
| C17orf97 | 2314 | 25409 | 48504 |
| C17orf98 | 2315 | 25410 | 48505 |
| C17orf99 | 2316 | 25411 | 48506 |
| C18orf12 | 2317 | 25412 | 48507 |
| C18orf21 | 2318 | 25413 | 48508 |
| C18orf21 | 2319 | 25414 | 48509 |
| C18orf25 | 2320 | 25415 | 48510 |
| C18orf32 | 2321 | 25416 | 48511 |
| C18orf54 | 2322 | 25417 | 48512 |
| C18orf63 | 2323 | 25418 | 48513 |
| C18orf65 | 2324 | 25419 | 48514 |
| C18orf8 | 2325 | 25420 | 48515 |
| C19orf12 | 2326 | 25421 | 48516 |
| C19orf12 | 2327 | 25422 | 48517 |
| C19orf12 | 2328 | 25423 | 48518 |
| C19orf18 | 2329 | 25424 | 48519 |
| C19orf24 | 2330 | 25425 | 48520 |
| C19orf25 | 2331 | 25426 | 48521 |
| C19orf33 | 2332 | 25427 | 48522 |
| C19orf33 | 2333 | 25428 | 48523 |
| C19orf38 | 2334 | 25429 | 48524 |
| C19orf44 | 2335 | 25430 | 48525 |
| C19orf47 | 2336 | 25431 | 48526 |
| C19orf48 | 2337 | 25432 | 48527 |
| C19orf53 | 2338 | 25433 | 48528 |
| C19orf54 | 2339 | 25434 | 48529 |
| C19orf54 | 2340 | 25435 | 48530 |
| C19orf54 | 2341 | 25436 | 48531 |
| C19orf57 | 2342 | 25437 | 48532 |
| C19orf66 | 2343 | 25438 | 48533 |
| C19orf67 | 2344 | 25439 | 48534 |
| C19orf70 | 2345 | 25440 | 48535 |
| C19orf71 | 2346 | 25441 | 48536 |
| C19orf73 | 2347 | 25442 | 48537 |
| C19orf81 | 2348 | 25443 | 48538 |
| C19orf84 | 2349 | 25444 | 48539 |
| C1D | 2350 | 25445 | 48540 |
| C1GALT1 | 2351 | 25446 | 48541 |
| C1GALT1C1 | 2352 | 25447 | 48542 |
| C1GALT1C1L | 2353 | 25448 | 48543 |
| C1orf100 | 2354 | 25449 | 48544 |
| C1orf100 | 2355 | 25450 | 48545 |
| C1orf105 | 2356 | 25451 | 48546 |
| C1orf106 | 2357 | 25452 | 48547 |
| C1orf109 | 2358 | 25453 | 48548 |
| C1orf109 | 2359 | 25454 | 48549 |
| C1orf112 | 2360 | 25455 | 48550 |
| C1orf112 | 2361 | 25456 | 48551 |
| C1orf112 | 2362 | 25457 | 48552 |
| C1orf115 | 2363 | 25458 | 48553 |
| C1orf116 | 2364 | 25459 | 48554 |
| C1orf122 | 2365 | 25460 | 48555 |
| C1orf122 | 2366 | 25461 | 48556 |
| C1orf123 | 2367 | 25462 | 48557 |
| C1orf127 | 2368 | 25463 | 48558 |
| C1orf131 | 2369 | 25464 | 48559 |
| C1orf137 | 2370 | 25465 | 48560 |
| C1orf141 | 2371 | 25466 | 48561 |
| C1orf141 | 2372 | 25467 | 48562 |
| C1orf146 | 2373 | 25468 | 48563 |
| C1orf158 | 2374 | 25469 | 48564 |
| C1orf159 | 2375 | 25470 | 48565 |
| C1orf162 | 2376 | 25471 | 48566 |
| C1orf167 | 2377 | 25472 | 48567 |
| C1orf174 | 2378 | 25473 | 48568 |
| C1orf185 | 2379 | 25474 | 48569 |
| C1orf186 | 2380 | 25475 | 48570 |
| C1orf189 | 2381 | 25476 | 48571 |
| C1orf194 | 2382 | 25477 | 48572 |
| C1orf195 | 2383 | 25478 | 48573 |
| C1orf195 | 2384 | 25479 | 48574 |
| C1orf198 | 2385 | 25480 | 48575 |
| C1orf21 | 2386 | 25481 | 48576 |
| C1orf210 | 2387 | 25482 | 48577 |
| C1orf216 | 2388 | 25483 | 48578 |
| C1orf226 | 2389 | 25484 | 48579 |
| C1orf228 | 2390 | 25485 | 48580 |
| C1orf229 | 2391 | 25486 | 48581 |
| C1orf27 | 2392 | 25487 | 48582 |
| C1orf35 | 2393 | 25488 | 48583 |
| C1orf43 | 2394 | 25489 | 48584 |
| C1orf43 | 2395 | 25490 | 48585 |
| C1orf43 | 2396 | 25491 | 48586 |
| C1orf50 | 2397 | 25492 | 48587 |
| C1orf52 | 2398 | 25493 | 48588 |
| C1orf53 | 2399 | 25494 | 48589 |
| C1orf54 | 2400 | 25495 | 48590 |
| C1orf54 | 2401 | 25496 | 48591 |
| C1orf56 | 2402 | 25497 | 48592 |
| C1orf61 | 2403 | 25498 | 48593 |
| C1orf61 | 2404 | 25499 | 48594 |
| C1orf61 | 2405 | 25500 | 48595 |
| C1orf68 | 2406 | 25501 | 48596 |
| C1orf74 | 2407 | 25502 | 48597 |
| C1orf87 | 2408 | 25503 | 48598 |
| C1orf94 | 2409 | 25504 | 48599 |
| C1QA | 2410 | 25505 | 48600 |
| C1QB | 2411 | 25506 | 48601 |
| C1QBP | 2412 | 25507 | 48602 |
| C1QC | 2413 | 25508 | 48603 |
| C1QL1 | 2414 | 25509 | 48604 |
| C1QL2 | 2415 | 25510 | 48605 |
| C1QL3 | 2416 | 25511 | 48606 |
| C1QL4 | 2417 | 25512 | 48607 |
| C1QTNF1 | 2418 | 25513 | 48608 |
| C1QTNF12 | 2419 | 25514 | 48609 |
| C1QTNF2 | 2420 | 25515 | 48610 |
| C1QTNF3 | 2421 | 25516 | 48611 |
| C1QTNF4 | 2422 | 25517 | 48612 |
| C1QTNF5 | 2423 | 25518 | 48613 |
| C1QTNF5 | 2424 | 25519 | 48614 |
| C1QTNF6 | 2425 | 25520 | 48615 |
| C1QTNF7 | 2426 | 25521 | 48616 |
| C1QTNF8 | 2427 | 25522 | 48617 |
| C1QTNF9 | 2428 | 25523 | 48618 |
| C1QTNF9B | 2429 | 25524 | 48619 |
| C1R | 2430 | 25525 | 48620 |
| C1RL | 2431 | 25526 | 48621 |
| C1RL | 2432 | 25527 | 48622 |
| C1RL | 2433 | 25528 | 48623 |
| C1S | 2434 | 25529 | 48624 |
| C2 | 2435 | 25530 | 48625 |
| C2 | 2436 | 25531 | 48626 |
| C20orf141 | 2437 | 25532 | 48627 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| C20orf144 | 2438 | 25533 | 48628 |
| C20orf173 | 2439 | 25534 | 48629 |
| C20orf194 | 2440 | 25535 | 48630 |
| C20orf196 | 2441 | 25536 | 48631 |
| C20orf196 | 2442 | 25537 | 48632 |
| C20orf197 | 2443 | 25538 | 48633 |
| C20orf197 | 2444 | 25539 | 48634 |
| C20orf202 | 2445 | 25540 | 48635 |
| C20orf203 | 2446 | 25541 | 48636 |
| C20orf204 | 2447 | 25542 | 48637 |
| C20orf24 | 2448 | 25543 | 48638 |
| C20orf24 | 2449 | 25544 | 48639 |
| C20orf24 | 2450 | 25545 | 48640 |
| C20orf27 | 2451 | 25546 | 48641 |
| C20orf78 | 2452 | 25547 | 48642 |
| C20orf85 | 2453 | 25548 | 48643 |
| C20orf96 | 2454 | 25549 | 48644 |
| C21orf140 | 2455 | 25550 | 48645 |
| C21orf2 | 2456 | 25551 | 48646 |
| C21orf33 | 2457 | 25552 | 48647 |
| C21orf33 | 2458 | 25553 | 48648 |
| C21orf33 | 2459 | 25554 | 48649 |
| C21orf58 | 2460 | 25555 | 48650 |
| C21orf58 | 2461 | 25556 | 48651 |
| C21orf59 | 2462 | 25557 | 48652 |
| C21orf59 | 2463 | 25558 | 48653 |
| C21orf59 | 2464 | 25559 | 48654 |
| C21orf59 | 2465 | 25560 | 48655 |
| C21orf62 | 2466 | 25561 | 48656 |
| C21orf91 | 2467 | 25562 | 48657 |
| C21orf91 | 2468 | 25563 | 48658 |
| C22orf15 | 2469 | 25564 | 48659 |
| C22orf23 | 2470 | 25565 | 48660 |
| C22orf24 | 2471 | 25566 | 48661 |
| C22orf24 | 2472 | 25567 | 48662 |
| C22orf31 | 2473 | 25568 | 48663 |
| C22orf34 | 2474 | 25569 | 48664 |
| C22orf39 | 2475 | 25570 | 48665 |
| C22orf39 | 2476 | 25571 | 48666 |
| C22orf42 | 2477 | 25572 | 48667 |
| C22orf46 | 2478 | 25573 | 48668 |
| C2CD2 | 2479 | 25574 | 48669 |
| C2CD2L | 2480 | 25575 | 48670 |
| C2CD3 | 2481 | 25576 | 48671 |
| C2CD3 | 2482 | 25577 | 48672 |
| C2CD4A | 2483 | 25578 | 48673 |
| C2CD4C | 2484 | 25579 | 48674 |
| C2CD4D | 2485 | 25580 | 48675 |
| C2CD5 | 2486 | 25581 | 48676 |
| C2CD6 | 2487 | 25582 | 48677 |
| C2CD6 | 2488 | 25583 | 48678 |
| C2CD6 | 2489 | 25584 | 48679 |
| C2orf15 | 2490 | 25585 | 48680 |
| C2orf16 | 2491 | 25586 | 48681 |
| C2orf27B | 2492 | 25587 | 48682 |
| C2orf40 | 2493 | 25588 | 48683 |
| C2orf42 | 2494 | 25589 | 48684 |
| C2orf48 | 2495 | 25590 | 48685 |
| C2orf49 | 2496 | 25591 | 48686 |
| C2orf50 | 2497 | 25592 | 48687 |
| C2orf54 | 2498 | 25593 | 48688 |
| C2orf66 | 2499 | 25594 | 48689 |
| C2orf68 | 2500 | 25595 | 48690 |
| C2orf69 | 2501 | 25596 | 48691 |
| C2orf70 | 2502 | 25597 | 48692 |
| C2orf71 | 2503 | 25598 | 48693 |
| C2orf72 | 2504 | 25599 | 48694 |
| C2orf73 | 2505 | 25600 | 48695 |
| C2orf74 | 2506 | 25601 | 48696 |
| C2orf76 | 2507 | 25602 | 48697 |
| C2orf78 | 2508 | 25603 | 48698 |
| C2orf80 | 2509 | 25604 | 48699 |
| C2orf81 | 2510 | 25605 | 48700 |
| C2orf82 | 2511 | 25606 | 48701 |
| C2orf83 | 2512 | 25607 | 48702 |
| C2orf83 | 2513 | 25608 | 48703 |
| C2orf88 | 2514 | 25609 | 48704 |
| C2orf91 | 2515 | 25610 | 48705 |
| C3 | 2516 | 25611 | 48706 |
| C3AR1 | 2517 | 25612 | 48707 |
| C3orf14 | 2518 | 25613 | 48708 |
| C3orf14 | 2519 | 25614 | 48709 |
| C3orf18 | 2520 | 25615 | 48710 |
| C3orf18 | 2521 | 25616 | 48711 |
| C3orf20 | 2522 | 25617 | 48712 |
| C3orf22 | 2523 | 25618 | 48713 |
| C3orf30 | 2524 | 25619 | 48714 |
| C3orf33 | 2525 | 25620 | 48715 |
| C3orf35 | 2526 | 25621 | 48716 |
| C3orf35 | 2527 | 25622 | 48717 |
| C3orf36 | 2528 | 25623 | 48718 |
| C3orf38 | 2529 | 25624 | 48719 |
| C3orf52 | 2530 | 25625 | 48720 |
| C3orf52 | 2531 | 25626 | 48721 |
| C3orf56 | 2532 | 25627 | 48722 |
| C3orf58 | 2533 | 25628 | 48723 |
| C3orf62 | 2534 | 25629 | 48724 |
| C3orf67 | 2535 | 25630 | 48725 |
| C3orf67 | 2536 | 25631 | 48726 |
| C3orf67 | 2537 | 25632 | 48727 |
| C3orf67 | 2538 | 25633 | 48728 |
| C3orf70 | 2539 | 25634 | 48729 |
| C3orf79 | 2540 | 25635 | 48730 |
| C3orf80 | 2541 | 25636 | 48731 |
| C3orf84 | 2542 | 25637 | 48732 |
| C3orf85 | 2543 | 25638 | 48733 |
| C3orf85 | 2544 | 25639 | 48734 |
| C4A | 2545 | 25640 | 48735 |
| C4BPA | 2546 | 25641 | 48736 |
| C4BPB | 2547 | 25642 | 48737 |
| C4orf17 | 2548 | 25643 | 48738 |
| C4orf19 | 2549 | 25644 | 48739 |
| C4orf22 | 2550 | 25645 | 48740 |
| C4orf3 | 2551 | 25646 | 48741 |
| C4orf33 | 2552 | 25647 | 48742 |
| C4orf36 | 2553 | 25648 | 48743 |
| C4orf45 | 2554 | 25649 | 48744 |
| C4orf46 | 2555 | 25650 | 48745 |
| C4orf47 | 2556 | 25651 | 48746 |
| C4orf48 | 2557 | 25652 | 48747 |
| C4orf51 | 2558 | 25653 | 48748 |
| C5 | 2559 | 25654 | 48749 |
| C5 | 2560 | 25655 | 48750 |
| C5AR1 | 2561 | 25656 | 48751 |
| C5AR2 | 2562 | 25657 | 48752 |
| C5orf15 | 2563 | 25658 | 48753 |
| C5orf22 | 2564 | 25659 | 48754 |
| C5orf24 | 2565 | 25660 | 48755 |
| C5orf24 | 2566 | 25661 | 48756 |
| C5orf30 | 2567 | 25662 | 48757 |
| C5orf34 | 2568 | 25663 | 48758 |
| C5orf38 | 2569 | 25664 | 48759 |
| C5orf38 | 2570 | 25665 | 48760 |
| C5orf38 | 2571 | 25666 | 48761 |
| C5orf38 | 2572 | 25667 | 48762 |
| C5orf42 | 2573 | 25668 | 48763 |
| C5orf46 | 2574 | 25669 | 48764 |
| C5orf47 | 2575 | 25670 | 48765 |
| C5orf49 | 2576 | 25671 | 48766 |
| C5orf51 | 2577 | 25672 | 48767 |
| C5orf52 | 2578 | 25673 | 48768 |
| C5orf58 | 2579 | 25674 | 48769 |
| C5orf58 | 2580 | 25675 | 48770 |
| C5orf60 | 2581 | 25676 | 48771 |
| C5orf63 | 2582 | 25677 | 48772 |
| C5orf63 | 2583 | 25678 | 48773 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| C5orf64 | 2584 | 25679 | 48774 |
| C5orf66 | 2585 | 25680 | 48775 |
| C5orf67 | 2586 | 25681 | 48776 |
| C6 | 2587 | 25682 | 48777 |
| C6orf10 | 2588 | 25683 | 48778 |
| C6orf106 | 2589 | 25684 | 48779 |
| C6orf118 | 2590 | 25685 | 48780 |
| C6orf120 | 2591 | 25686 | 48781 |
| C6orf132 | 2592 | 25687 | 48782 |
| C6orf136 | 2593 | 25688 | 48783 |
| C6orf141 | 2594 | 25689 | 48784 |
| C6orf15 | 2595 | 25690 | 48785 |
| C6orf163 | 2596 | 25691 | 48786 |
| C6orf183 | 2597 | 25692 | 48787 |
| C6orf201 | 2598 | 25693 | 48788 |
| C6orf203 | 2599 | 25694 | 48789 |
| C6orf222 | 2600 | 25695 | 48790 |
| C6orf223 | 2601 | 25696 | 48791 |
| C6orf223 | 2602 | 25697 | 48792 |
| C6orf226 | 2603 | 25698 | 48793 |
| C6orf229 | 2604 | 25699 | 48794 |
| C6orf47 | 2605 | 25700 | 48795 |
| C6orf48 | 2606 | 25701 | 48796 |
| C6orf48 | 2607 | 25702 | 48797 |
| C6orf52 | 2608 | 25703 | 48798 |
| C6orf58 | 2609 | 25704 | 48799 |
| C6orf62 | 2610 | 25705 | 48800 |
| C6orf89 | 2611 | 25706 | 48801 |
| C6orf99 | 2612 | 25707 | 48802 |
| C7 | 2613 | 25708 | 48803 |
| C7orf25 | 2614 | 25709 | 48804 |
| C7orf26 | 2615 | 25710 | 48805 |
| C7orf31 | 2616 | 25711 | 48806 |
| C7orf33 | 2617 | 25712 | 48807 |
| C7orf43 | 2618 | 25713 | 48808 |
| C7orf49 | 2619 | 25714 | 48809 |
| C7orf49 | 2620 | 25715 | 48810 |
| C7orf50 | 2621 | 25716 | 48811 |
| C7orf50 | 2622 | 25717 | 48812 |
| C7orf50 | 2623 | 25718 | 48813 |
| C7orf57 | 2624 | 25719 | 48814 |
| C7orf61 | 2625 | 25720 | 48815 |
| C7orf65 | 2626 | 25721 | 48816 |
| C7orf66 | 2627 | 25722 | 48817 |
| C7orf69 | 2628 | 25723 | 48818 |
| C7orf71 | 2629 | 25724 | 48819 |
| C7orf77 | 2630 | 25725 | 48820 |
| C8A | 2631 | 25726 | 48821 |
| C8B | 2632 | 25727 | 48822 |
| C8G | 2633 | 25728 | 48823 |
| C8orf31 | 2634 | 25729 | 48824 |
| C8orf33 | 2635 | 25730 | 48825 |
| C8orf34 | 2636 | 25731 | 48826 |
| C8orf34 | 2637 | 25732 | 48827 |
| C8orf37 | 2638 | 25733 | 48828 |
| C8orf44 | 2639 | 25734 | 48829 |
| C8orf46 | 2640 | 25735 | 48830 |
| C8orf48 | 2641 | 25736 | 48831 |
| C8orf58 | 2642 | 25737 | 48832 |
| C8orf58 | 2643 | 25738 | 48833 |
| C8orf59 | 2644 | 25739 | 48834 |
| C8orf74 | 2645 | 25740 | 48835 |
| C8orf76 | 2646 | 25741 | 48836 |
| C8orf82 | 2647 | 25742 | 48837 |
| C8orf86 | 2648 | 25743 | 48838 |
| C8orf86 | 2649 | 25744 | 48839 |
| C8orf87 | 2650 | 25745 | 48840 |
| C8orf88 | 2651 | 25746 | 48841 |
| C8orf89 | 2652 | 25747 | 48842 |
| C9 | 2653 | 25748 | 48843 |
| C9orf106 | 2654 | 25749 | 48844 |
| C9orf116 | 2655 | 25750 | 48845 |
| C9orf116 | 2656 | 25751 | 48846 |
| C9orf129 | 2657 | 25752 | 48847 |
| C9orf131 | 2658 | 25753 | 48848 |
| C9orf135 | 2659 | 25754 | 48849 |
| C9orf135 | 2660 | 25755 | 48850 |
| C9orf135 | 2661 | 25756 | 48851 |
| C9orf139 | 2662 | 25757 | 48852 |
| C9orf147 | 2663 | 25758 | 48853 |
| C9orf152 | 2664 | 25759 | 48854 |
| C9orf153 | 2665 | 25760 | 48855 |
| C9orf16 | 2666 | 25761 | 48856 |
| C9orf163 | 2667 | 25762 | 48857 |
| C9orf170 | 2668 | 25763 | 48858 |
| C9orf172 | 2669 | 25764 | 48859 |
| C9orf24 | 2670 | 25765 | 48860 |
| C9orf24 | 2671 | 25766 | 48861 |
| C9orf24 | 2672 | 25767 | 48862 |
| C9orf3 | 2673 | 25768 | 48863 |
| C9orf3 | 2674 | 25769 | 48864 |
| C9orf40 | 2675 | 25770 | 48865 |
| C9orf43 | 2676 | 25771 | 48866 |
| C9orf47 | 2677 | 25772 | 48867 |
| C9orf50 | 2678 | 25773 | 48868 |
| C9orf57 | 2679 | 25774 | 48869 |
| C9orf62 | 2680 | 25775 | 48870 |
| C9orf64 | 2681 | 25776 | 48871 |
| C9orf66 | 2682 | 25777 | 48872 |
| C9orf72 | 2683 | 25778 | 48873 |
| C9orf72 | 2684 | 25779 | 48874 |
| C9orf78 | 2685 | 25780 | 48875 |
| C9orf84 | 2686 | 25781 | 48876 |
| C9orf85 | 2687 | 25782 | 48877 |
| C9orf92 | 2688 | 25783 | 48878 |
| CA1 | 2689 | 25784 | 48879 |
| CA10 | 2690 | 25785 | 48880 |
| CA11 | 2691 | 25786 | 48881 |
| CA12 | 2692 | 25787 | 48882 |
| CA13 | 2693 | 25788 | 48883 |
| CA14 | 2694 | 25789 | 48884 |
| CA2 | 2695 | 25790 | 48885 |
| CA3 | 2696 | 25791 | 48886 |
| CA4 | 2697 | 25792 | 48887 |
| CA5A | 2698 | 25793 | 48888 |
| CA5B | 2699 | 25794 | 48889 |
| CA6 | 2700 | 25795 | 48890 |
| CA6 | 2701 | 25796 | 48891 |
| CA7 | 2702 | 25797 | 48892 |
| CA8 | 2703 | 25798 | 48893 |
| CA8 | 2704 | 25799 | 48894 |
| CA9 | 2705 | 25800 | 48895 |
| CAAP1 | 2706 | 25801 | 48896 |
| CAB39 | 2707 | 25802 | 48897 |
| CAB39L | 2708 | 25803 | 48898 |
| CABCOCO1 | 2709 | 25804 | 48899 |
| CABIN1 | 2710 | 25805 | 48900 |
| CABLES1 | 2711 | 25806 | 48901 |
| CABLES2 | 2712 | 25807 | 48902 |
| CABP1 | 2713 | 25808 | 48903 |
| CABP2 | 2714 | 25809 | 48904 |
| CABP4 | 2715 | 25810 | 48905 |
| CABP5 | 2716 | 25811 | 48906 |
| CABP7 | 2717 | 25812 | 48907 |
| CABS1 | 2718 | 25813 | 48908 |
| CABYR | 2719 | 25814 | 48909 |
| CABYR | 2720 | 25815 | 48910 |
| CACFD1 | 2721 | 25816 | 48911 |
| CACFD1 | 2722 | 25817 | 48912 |
| CACHD1 | 2723 | 25818 | 48913 |
| CACNA1A | 2724 | 25819 | 48914 |
| CACNA1A | 2725 | 25820 | 48915 |
| CACNA1B | 2726 | 25821 | 48916 |
| CACNA1B | 2727 | 25822 | 48917 |
| CACNA1C | 2728 | 25823 | 48918 |
| CACNA1D | 2729 | 25824 | 48919 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| CACNA1E | 2730 | 25825 | 48920 |
| CACNA1F | 2731 | 25826 | 48921 |
| CACNA1G | 2732 | 25827 | 48922 |
| CACNA1H | 2733 | 25828 | 48923 |
| CACNA1I | 2734 | 25829 | 48924 |
| CACNA1S | 2735 | 25830 | 48925 |
| CACNA2D1 | 2736 | 25831 | 48926 |
| CACNA2D1 | 2737 | 25832 | 48927 |
| CACNA2D2 | 2738 | 25833 | 48928 |
| CACNA2D3 | 2739 | 25834 | 48929 |
| CACNA2D4 | 2740 | 25835 | 48930 |
| CACNB1 | 2741 | 25836 | 48931 |
| CACNB1 | 2742 | 25837 | 48932 |
| CACNB2 | 2743 | 25838 | 48933 |
| CACNB3 | 2744 | 25839 | 48934 |
| CACNB4 | 2745 | 25840 | 48935 |
| CACNG1 | 2746 | 25841 | 48936 |
| CACNG2 | 2747 | 25842 | 48937 |
| CACNG3 | 2748 | 25843 | 48938 |
| CACNG4 | 2749 | 25844 | 48939 |
| CACNG5 | 2750 | 25845 | 48940 |
| CACNG6 | 2751 | 25846 | 48941 |
| CACNG7 | 2752 | 25847 | 48942 |
| CACNG8 | 2753 | 25848 | 48943 |
| CACTIN | 2754 | 25849 | 48944 |
| CACUL1 | 2755 | 25850 | 48945 |
| CACYBP | 2756 | 25851 | 48946 |
| CAD | 2757 | 25852 | 48947 |
| CADM1 | 2758 | 25853 | 48948 |
| CADM2 | 2759 | 25854 | 48949 |
| CADM3 | 2760 | 25855 | 48950 |
| CADM4 | 2761 | 25856 | 48951 |
| CADPS | 2762 | 25857 | 48952 |
| CADPS2 | 2763 | 25858 | 48953 |
| CAGE1 | 2764 | 25859 | 48954 |
| CAGE1 | 2765 | 25860 | 48955 |
| CALB1 | 2766 | 25861 | 48956 |
| CALB2 | 2767 | 25862 | 48957 |
| CALB2 | 2768 | 25863 | 48958 |
| CALCA | 2769 | 25864 | 48959 |
| CALCA | 2770 | 25865 | 48960 |
| CALCB | 2771 | 25866 | 48961 |
| CALCOCO1 | 2772 | 25867 | 48962 |
| CALCOCO2 | 2773 | 25868 | 48963 |
| CALCR | 2774 | 25869 | 48964 |
| CALCRL | 2775 | 25870 | 48965 |
| CALD1 | 2776 | 25871 | 48966 |
| CALHM1 | 2777 | 25872 | 48967 |
| CALHM2 | 2778 | 25873 | 48968 |
| CALHM3 | 2779 | 25874 | 48969 |
| CALHM4 | 2780 | 25875 | 48970 |
| CALHM5 | 2781 | 25876 | 48971 |
| CALHM6 | 2782 | 25877 | 48972 |
| CALM1 | 2783 | 25878 | 48973 |
| CALM2 | 2784 | 25879 | 48974 |
| CALM3 | 2785 | 25880 | 48975 |
| CALML3 | 2786 | 25881 | 48976 |
| CALML4 | 2787 | 25882 | 48977 |
| CALML5 | 2788 | 25883 | 48978 |
| CALML6 | 2789 | 25884 | 48979 |
| CALN1 | 2790 | 25885 | 48980 |
| CALR | 2791 | 25886 | 48981 |
| CALR3 | 2792 | 25887 | 48982 |
| CALU | 2793 | 25888 | 48983 |
| CALU | 2794 | 25889 | 48984 |
| CALY | 2795 | 25890 | 48985 |
| CAMK1 | 2796 | 25891 | 48986 |
| CAMK1D | 2797 | 25892 | 48987 |
| CAMK1D | 2798 | 25893 | 48988 |
| CAMK1G | 2799 | 25894 | 48989 |
| CAMK2A | 2800 | 25895 | 48990 |
| CAMK2B | 2801 | 25896 | 48991 |
| CAMK2D | 2802 | 25897 | 48992 |
| CAMK2D | 2803 | 25898 | 48993 |
| CAMK2D | 2804 | 25899 | 48994 |
| CAMK2D | 2805 | 25900 | 48995 |
| CAMK2G | 2806 | 25901 | 48996 |
| CAMK2G | 2807 | 25902 | 48997 |
| CAMK2N1 | 2808 | 25903 | 48998 |
| CAMK2N2 | 2809 | 25904 | 48999 |
| CAMK4 | 2810 | 25905 | 49000 |
| CAMKK1 | 2811 | 25906 | 49001 |
| CAMKK1 | 2812 | 25907 | 49002 |
| CAMKK2 | 2813 | 25908 | 49003 |
| CAMKK2 | 2814 | 25909 | 49004 |
| CAMKK2 | 2815 | 25910 | 49005 |
| CAMKK2 | 2816 | 25911 | 49006 |
| CAMKMT | 2817 | 25912 | 49007 |
| CAMKV | 2818 | 25913 | 49008 |
| CAMLG | 2819 | 25914 | 49009 |
| CAMP | 2820 | 25915 | 49010 |
| CAMSAP1 | 2821 | 25916 | 49011 |
| CAMSAP2 | 2822 | 25917 | 49012 |
| CAMSAP3 | 2823 | 25918 | 49013 |
| CAMTA1 | 2824 | 25919 | 49014 |
| CAMTA1 | 2825 | 25920 | 49015 |
| CAMTA1 | 2826 | 25921 | 49016 |
| CAMTA1 | 2827 | 25922 | 49017 |
| CAMTA1 | 2828 | 25923 | 49018 |
| CAMTA2 | 2829 | 25924 | 49019 |
| CAMTA2 | 2830 | 25925 | 49020 |
| CAND1 | 2831 | 25926 | 49021 |
| CAND2 | 2832 | 25927 | 49022 |
| CANT1 | 2833 | 25928 | 49023 |
| CANX | 2834 | 25929 | 49024 |
| CAP1 | 2835 | 25930 | 49025 |
| CAP2 | 2836 | 25931 | 49026 |
| CAPG | 2837 | 25932 | 49027 |
| CAPN1 | 2838 | 25933 | 49028 |
| CAPN10 | 2839 | 25934 | 49029 |
| CAPN11 | 2840 | 25935 | 49030 |
| CAPN12 | 2841 | 25936 | 49031 |
| CAPN13 | 2842 | 25937 | 49032 |
| CAPN14 | 2843 | 25938 | 49033 |
| CAPN15 | 2844 | 25939 | 49034 |
| CAPN2 | 2845 | 25940 | 49035 |
| CAPN3 | 2846 | 25941 | 49036 |
| CAPN5 | 2847 | 25942 | 49037 |
| CAPN6 | 2848 | 25943 | 49038 |
| CAPN7 | 2849 | 25944 | 49039 |
| CAPN8 | 2850 | 25945 | 49040 |
| CAPN9 | 2851 | 25946 | 49041 |
| CAPNS1 | 2852 | 25947 | 49042 |
| CAPNS2 | 2853 | 25948 | 49043 |
| CAPRIN1 | 2854 | 25949 | 49044 |
| CAPRIN1 | 2855 | 25950 | 49045 |
| CAPRIN2 | 2856 | 25951 | 49046 |
| CAPRIN2 | 2857 | 25952 | 49047 |
| CAPS | 2858 | 25953 | 49048 |
| CAPS2 | 2859 | 25954 | 49049 |
| CAPS2 | 2860 | 25955 | 49050 |
| CAPSL | 2861 | 25956 | 49051 |
| CAPZA1 | 2862 | 25957 | 49052 |
| CAPZA2 | 2863 | 25958 | 49053 |
| CAPZA3 | 2864 | 25959 | 49054 |
| CAPZB | 2865 | 25960 | 49055 |
| CAPZB | 2866 | 25961 | 49056 |
| CAPZB | 2867 | 25962 | 49057 |
| CAPZB | 2868 | 25963 | 49058 |
| CARD10 | 2869 | 25964 | 49059 |
| CARD11 | 2870 | 25965 | 49060 |
| CARD14 | 2871 | 25966 | 49061 |
| CARD14 | 2872 | 25967 | 49062 |
| CARD14 | 2873 | 25968 | 49063 |
| CARD16 | 2874 | 25969 | 49064 |
| CARD16 | 2875 | 25970 | 49065 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| CARD17 | 2876 | 25971 | 49066 |
| CARD18 | 2877 | 25972 | 49067 |
| CARD19 | 2878 | 25973 | 49068 |
| CARD19 | 2879 | 25974 | 49069 |
| CARD6 | 2880 | 25975 | 49070 |
| CARD8 | 2881 | 25976 | 49071 |
| CARD8 | 2882 | 25977 | 49072 |
| CARD8 | 2883 | 25978 | 49073 |
| CARD8 | 2884 | 25979 | 49074 |
| CARD9 | 2885 | 25980 | 49075 |
| CARD9 | 2886 | 25981 | 49076 |
| CARF | 2887 | 25982 | 49077 |
| CARF | 2888 | 25983 | 49078 |
| CARHSP1 | 2889 | 25984 | 49079 |
| CARHSP1 | 2890 | 25985 | 49080 |
| CARM1 | 2891 | 25986 | 49081 |
| CARMIL1 | 2892 | 25987 | 49082 |
| CARMIL2 | 2893 | 25988 | 49083 |
| CARMIL3 | 2894 | 25989 | 49084 |
| CARNMT1 | 2895 | 25990 | 49085 |
| CARNS1 | 2896 | 25991 | 49086 |
| CARS | 2897 | 25992 | 49087 |
| CARS | 2898 | 25993 | 49088 |
| CARS2 | 2899 | 25994 | 49089 |
| CARS2 | 2900 | 25995 | 49090 |
| CARTPT | 2901 | 25996 | 49091 |
| CASC1 | 2902 | 25997 | 49092 |
| CASC1 | 2903 | 25998 | 49093 |
| CASC10 | 2904 | 25999 | 49094 |
| CASC3 | 2905 | 26000 | 49095 |
| CASC4 | 2906 | 26001 | 49096 |
| CASD1 | 2907 | 26002 | 49097 |
| CASK | 2908 | 26003 | 49098 |
| CASKIN1 | 2909 | 26004 | 49099 |
| CASKIN2 | 2910 | 26005 | 49100 |
| CASP1 | 2911 | 26006 | 49101 |
| CASP10 | 2912 | 26007 | 49102 |
| CASP10 | 2913 | 26008 | 49103 |
| CASP10 | 2914 | 26009 | 49104 |
| CASP10 | 2915 | 26010 | 49105 |
| CASP12 | 2916 | 26011 | 49106 |
| CASP14 | 2917 | 26012 | 49107 |
| CASP2 | 2918 | 26013 | 49108 |
| CASP2 | 2919 | 26014 | 49109 |
| CASP3 | 2920 | 26015 | 49110 |
| CASP4 | 2921 | 26016 | 49111 |
| CASP5 | 2922 | 26017 | 49112 |
| CASP6 | 2923 | 26018 | 49113 |
| CASP7 | 2924 | 26019 | 49114 |
| CASP7 | 2925 | 26020 | 49115 |
| CASP8 | 2926 | 26021 | 49116 |
| CASP8 | 2927 | 26022 | 49117 |
| CASP8AP2 | 2928 | 26023 | 49118 |
| CASP9 | 2929 | 26024 | 49119 |
| CASQ1 | 2930 | 26025 | 49120 |
| CASQ2 | 2931 | 26026 | 49121 |
| CASR | 2932 | 26027 | 49122 |
| CASS4 | 2933 | 26028 | 49123 |
| CAST | 2934 | 26029 | 49124 |
| CASTOR1 | 2935 | 26030 | 49125 |
| CASTOR2 | 2936 | 26031 | 49126 |
| CASZ1 | 2937 | 26032 | 49127 |
| CASZ1 | 2938 | 26033 | 49128 |
| CAT | 2939 | 26034 | 49129 |
| CATIP | 2940 | 26035 | 49130 |
| CATSPER1 | 2941 | 26036 | 49131 |
| CATSPER2 | 2942 | 26037 | 49132 |
| CATSPER3 | 2943 | 26038 | 49133 |
| CATSPER4 | 2944 | 26039 | 49134 |
| CATSPERB | 2945 | 26040 | 49135 |
| CATSPERD | 2946 | 26041 | 49136 |
| CATSPERE | 2947 | 26042 | 49137 |
| CATSPERE | 2948 | 26043 | 49138 |
| CATSPERG | 2949 | 26044 | 49139 |
| CATSPERZ | 2950 | 26045 | 49140 |
| CAV1 | 2951 | 26046 | 49141 |
| CAV2 | 2952 | 26047 | 49142 |
| CAV2 | 2953 | 26048 | 49143 |
| CAV3 | 2954 | 26049 | 49144 |
| CAVIN1 | 2955 | 26050 | 49145 |
| CAVIN2 | 2956 | 26051 | 49146 |
| CAVIN3 | 2957 | 26052 | 49147 |
| CAVIN4 | 2958 | 26053 | 49148 |
| CBARP | 2959 | 26054 | 49149 |
| CBFA2T2 | 2960 | 26055 | 49150 |
| CBFA2T3 | 2961 | 26056 | 49151 |
| CBFB | 2962 | 26057 | 49152 |
| CBFB | 2963 | 26058 | 49153 |
| CBL | 2964 | 26059 | 49154 |
| CBLB | 2965 | 26060 | 49155 |
| CBLC | 2966 | 26061 | 49156 |
| CBLL1 | 2967 | 26062 | 49157 |
| CBLN1 | 2968 | 26063 | 49158 |
| CBLN2 | 2969 | 26064 | 49159 |
| CBLN3 | 2970 | 26065 | 49160 |
| CBLN4 | 2971 | 26066 | 49161 |
| CBR1 | 2972 | 26067 | 49162 |
| CBR3 | 2973 | 26068 | 49163 |
| CBR4 | 2974 | 26069 | 49164 |
| CBSL | 2975 | 26070 | 49165 |
| CBWD2 | 2976 | 26071 | 49166 |
| CBWD5 | 2977 | 26072 | 49167 |
| CBWD5 | 2978 | 26073 | 49168 |
| CBX1 | 2979 | 26074 | 49169 |
| CBX2 | 2980 | 26075 | 49170 |
| CBX2 | 2981 | 26076 | 49171 |
| CBX3 | 2982 | 26077 | 49172 |
| CBX4 | 2983 | 26078 | 49173 |
| CBX5 | 2984 | 26079 | 49174 |
| CBX6 | 2985 | 26080 | 49175 |
| CBX7 | 2986 | 26081 | 49176 |
| CBX8 | 2987 | 26082 | 49177 |
| CBY1 | 2988 | 26083 | 49178 |
| CBY3 | 2989 | 26084 | 49179 |
| CC2D1A | 2990 | 26085 | 49180 |
| CC2D1B | 2991 | 26086 | 49181 |
| CC2D1B | 2992 | 26087 | 49182 |
| CC2D2A | 2993 | 26088 | 49183 |
| CC2D2A | 2994 | 26089 | 49184 |
| CC2D2A | 2995 | 26090 | 49185 |
| CC2D2B | 2996 | 26091 | 49186 |
| CC2D2B | 2997 | 26092 | 49187 |
| CCAR1 | 2998 | 26093 | 49188 |
| CCAR2 | 2999 | 26094 | 49189 |
| CCBE1 | 3000 | 26095 | 49190 |
| CCDC102A | 3001 | 26096 | 49191 |
| CCDC102B | 3002 | 26097 | 49192 |
| CCDC103 | 3003 | 26098 | 49193 |
| CCDC103 | 3004 | 26099 | 49194 |
| CCDC103 | 3005 | 26100 | 49195 |
| CCDC105 | 3006 | 26101 | 49196 |
| CCDC106 | 3007 | 26102 | 49197 |
| CCDC107 | 3008 | 26103 | 49198 |
| CCDC107 | 3009 | 26104 | 49199 |
| CCDC107 | 3010 | 26105 | 49200 |
| CCDC110 | 3011 | 26106 | 49201 |
| CCDC112 | 3012 | 26107 | 49202 |
| CCDC113 | 3013 | 26108 | 49203 |
| CCDC114 | 3014 | 26109 | 49204 |
| CCDC115 | 3015 | 26110 | 49205 |
| CCDC116 | 3016 | 26111 | 49206 |
| CCDC116 | 3017 | 26112 | 49207 |
| CCDC117 | 3018 | 26113 | 49208 |
| CCDC12 | 3019 | 26114 | 49209 |
| CCDC120 | 3020 | 26115 | 49210 |
| CCDC120 | 3021 | 26116 | 49211 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| CCDC121 | 3022 | 26117 | 49212 |
| CCDC122 | 3023 | 26118 | 49213 |
| CCDC124 | 3024 | 26119 | 49214 |
| CCDC125 | 3025 | 26120 | 49215 |
| CCDC125 | 3026 | 26121 | 49216 |
| CCDC126 | 3027 | 26122 | 49217 |
| CCDC127 | 3028 | 26123 | 49218 |
| CCDC129 | 3029 | 26124 | 49219 |
| CCDC129 | 3030 | 26125 | 49220 |
| CCDC13 | 3031 | 26126 | 49221 |
| CCDC130 | 3032 | 26127 | 49222 |
| CCDC134 | 3033 | 26128 | 49223 |
| CCDC136 | 3034 | 26129 | 49224 |
| CCDC137 | 3035 | 26130 | 49225 |
| CCDC138 | 3036 | 26131 | 49226 |
| CCDC138 | 3037 | 26132 | 49227 |
| CCDC138 | 3038 | 26133 | 49228 |
| CCDC138 | 3039 | 26134 | 49229 |
| CCDC14 | 3040 | 26135 | 49230 |
| CCDC140 | 3041 | 26136 | 49231 |
| CCDC141 | 3042 | 26137 | 49232 |
| CCDC141 | 3043 | 26138 | 49233 |
| CCDC142 | 3044 | 26139 | 49234 |
| CCDC144A | 3045 | 26140 | 49235 |
| CCDC144NL | 3046 | 26141 | 49236 |
| CCDC146 | 3047 | 26142 | 49237 |
| CCDC148 | 3048 | 26143 | 49238 |
| CCDC148 | 3049 | 26144 | 49239 |
| CCDC149 | 3050 | 26145 | 49240 |
| CCDC15 | 3051 | 26146 | 49241 |
| CCDC150 | 3052 | 26147 | 49242 |
| CCDC151 | 3053 | 26148 | 49243 |
| CCDC152 | 3054 | 26149 | 49244 |
| CCDC153 | 3055 | 26150 | 49245 |
| CCDC154 | 3056 | 26151 | 49246 |
| CCDC155 | 3057 | 26152 | 49247 |
| CCDC157 | 3058 | 26153 | 49248 |
| CCDC157 | 3059 | 26154 | 49249 |
| CCDC158 | 3060 | 26155 | 49250 |
| CCDC159 | 3061 | 26156 | 49251 |
| CCDC160 | 3062 | 26157 | 49252 |
| CCDC166 | 3063 | 26158 | 49253 |
| CCDC167 | 3064 | 26159 | 49254 |
| CCDC168 | 3065 | 26160 | 49255 |
| CCDC169 | 3066 | 26161 | 49256 |
| CCDC169 | 3067 | 26162 | 49257 |
| CCDC17 | 3068 | 26163 | 49258 |
| CCDC170 | 3069 | 26164 | 49259 |
| CCDC171 | 3070 | 26165 | 49260 |
| CCDC172 | 3071 | 26166 | 49261 |
| CCDC173 | 3072 | 26167 | 49262 |
| CCDC174 | 3073 | 26168 | 49263 |
| CCDC175 | 3074 | 26169 | 49264 |
| CCDC177 | 3075 | 26170 | 49265 |
| CCDC178 | 3076 | 26171 | 49266 |
| CCDC179 | 3077 | 26172 | 49267 |
| CCDC18 | 3078 | 26173 | 49268 |
| CCDC18 | 3079 | 26174 | 49269 |
| CCDC180 | 3080 | 26175 | 49270 |
| CCDC180 | 3081 | 26176 | 49271 |
| CCDC181 | 3082 | 26177 | 49272 |
| CCDC182 | 3083 | 26178 | 49273 |
| CCDC183 | 3084 | 26179 | 49274 |
| CCDC184 | 3085 | 26180 | 49275 |
| CCDC185 | 3086 | 26181 | 49276 |
| CCDC186 | 3087 | 26182 | 49277 |
| CCDC186 | 3088 | 26183 | 49278 |
| CCDC187 | 3089 | 26184 | 49279 |
| CCDC188 | 3090 | 26185 | 49280 |
| CCDC189 | 3091 | 26186 | 49281 |
| CCDC189 | 3092 | 26187 | 49282 |
| CCDC190 | 3093 | 26188 | 49283 |
| CCDC191 | 3094 | 26189 | 49284 |
| CCDC192 | 3095 | 26190 | 49285 |
| CCDC196 | 3096 | 26191 | 49286 |
| CCDC197 | 3097 | 26192 | 49287 |
| CCDC198 | 3098 | 26193 | 49288 |
| CCDC198 | 3099 | 26194 | 49289 |
| CCDC22 | 3100 | 26195 | 49290 |
| CCDC24 | 3101 | 26196 | 49291 |
| CCDC24 | 3102 | 26197 | 49292 |
| CCDC25 | 3103 | 26198 | 49293 |
| CCDC25 | 3104 | 26199 | 49294 |
| CCDC27 | 3105 | 26200 | 49295 |
| CCDC28A | 3106 | 26201 | 49296 |
| CCDC28B | 3107 | 26202 | 49297 |
| CCDC28B | 3108 | 26203 | 49298 |
| CCDC3 | 3109 | 26204 | 49299 |
| CCDC30 | 3110 | 26205 | 49300 |
| CCDC32 | 3111 | 26206 | 49301 |
| CCDC32 | 3112 | 26207 | 49302 |
| CCDC33 | 3113 | 26208 | 49303 |
| CCDC33 | 3114 | 26209 | 49304 |
| CCDC34 | 3115 | 26210 | 49305 |
| CCDC34 | 3116 | 26211 | 49306 |
| CCDC36 | 3117 | 26212 | 49307 |
| CCDC38 | 3118 | 26213 | 49308 |
| CCDC39 | 3119 | 26214 | 49309 |
| CCDC40 | 3120 | 26215 | 49310 |
| CCDC40 | 3121 | 26216 | 49311 |
| CCDC40 | 3122 | 26217 | 49312 |
| CCDC42 | 3123 | 26218 | 49313 |
| CCDC43 | 3124 | 26219 | 49314 |
| CCDC43 | 3125 | 26220 | 49315 |
| CCDC47 | 3126 | 26221 | 49316 |
| CCDC50 | 3127 | 26222 | 49317 |
| CCDC51 | 3128 | 26223 | 49318 |
| CCDC54 | 3129 | 26224 | 49319 |
| CCDC57 | 3130 | 26225 | 49320 |
| CCDC57 | 3131 | 26226 | 49321 |
| CCDC58 | 3132 | 26227 | 49322 |
| CCDC59 | 3133 | 26228 | 49323 |
| CCDC6 | 3134 | 26229 | 49324 |
| CCDC60 | 3135 | 26230 | 49325 |
| CCDC61 | 3136 | 26231 | 49326 |
| CCDC62 | 3137 | 26232 | 49327 |
| CCDC63 | 3138 | 26233 | 49328 |
| CCDC65 | 3139 | 26234 | 49329 |
| CCDC66 | 3140 | 26235 | 49330 |
| CCDC68 | 3141 | 26236 | 49331 |
| CCDC69 | 3142 | 26237 | 49332 |
| CCDC7 | 3143 | 26238 | 49333 |
| CCDC7 | 3144 | 26239 | 49334 |
| CCDC70 | 3145 | 26240 | 49335 |
| CCDC71 | 3146 | 26241 | 49336 |
| CCDC71L | 3147 | 26242 | 49337 |
| CCDC73 | 3148 | 26243 | 49338 |
| CCDC74A | 3149 | 26244 | 49339 |
| CCDC74A | 3150 | 26245 | 49340 |
| CCDC74B | 3151 | 26246 | 49341 |
| CCDC77 | 3152 | 26247 | 49342 |
| CCDC78 | 3153 | 26248 | 49343 |
| CCDC8 | 3154 | 26249 | 49344 |
| CCDC80 | 3155 | 26250 | 49345 |
| CCDC81 | 3156 | 26251 | 49346 |
| CCDC82 | 3157 | 26252 | 49347 |
| CCDC82 | 3158 | 26253 | 49348 |
| CCDC83 | 3159 | 26254 | 49349 |
| CCDC84 | 3160 | 26255 | 49350 |
| CCDC85A | 3161 | 26256 | 49351 |
| CCDC85A | 3162 | 26257 | 49352 |
| CCDC85B | 3163 | 26258 | 49353 |
| CCDC85C | 3164 | 26259 | 49354 |
| CCDC86 | 3165 | 26260 | 49355 |
| CCDC87 | 3166 | 26261 | 49356 |
| CCDC88A | 3167 | 26262 | 49357 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| CCDC88B | 3168 | 26263 | 49358 |
| CCDC88C | 3169 | 26264 | 49359 |
| CCDC89 | 3170 | 26265 | 49360 |
| CCDC9 | 3171 | 26266 | 49361 |
| CCDC90B | 3172 | 26267 | 49362 |
| CCDC91 | 3173 | 26268 | 49363 |
| CCDC92 | 3174 | 26269 | 49364 |
| CCDC93 | 3175 | 26270 | 49365 |
| CCDC94 | 3176 | 26271 | 49366 |
| CCDC96 | 3177 | 26272 | 49367 |
| CCDC97 | 3178 | 26273 | 49368 |
| CCER1 | 3179 | 26274 | 49369 |
| CCER2 | 3180 | 26275 | 49370 |
| CCHCR1 | 3181 | 26276 | 49371 |
| CCIN | 3182 | 26277 | 49372 |
| CCK | 3183 | 26278 | 49373 |
| CCKAR | 3184 | 26279 | 49374 |
| CCKBR | 3185 | 26280 | 49375 |
| CCL1 | 3186 | 26281 | 49376 |
| CCL11 | 3187 | 26282 | 49377 |
| CCL13 | 3188 | 26283 | 49378 |
| CCL14 | 3189 | 26284 | 49379 |
| CCL15 | 3190 | 26285 | 49380 |
| CCL16 | 3191 | 26286 | 49381 |
| CCL17 | 3192 | 26287 | 49382 |
| CCL18 | 3193 | 26288 | 49383 |
| CCL19 | 3194 | 26289 | 49384 |
| CCL2 | 3195 | 26290 | 49385 |
| CCL20 | 3196 | 26291 | 49386 |
| CCL21 | 3197 | 26292 | 49387 |
| CCL22 | 3198 | 26293 | 49388 |
| CCL23 | 3199 | 26294 | 49389 |
| CCL24 | 3200 | 26295 | 49390 |
| CCL25 | 3201 | 26296 | 49391 |
| CCL26 | 3202 | 26297 | 49392 |
| CCL27 | 3203 | 26298 | 49393 |
| CCL28 | 3204 | 26299 | 49394 |
| CCL3L3 | 3205 | 26300 | 49395 |
| CCL4 | 3206 | 26301 | 49396 |
| CCL4L2 | 3207 | 26302 | 49397 |
| CCL4L2 | 3208 | 26303 | 49398 |
| CCL4L2 | 3209 | 26304 | 49399 |
| CCL4L2 | 3210 | 26305 | 49400 |
| CCL5 | 3211 | 26306 | 49401 |
| CCL5 | 3212 | 26307 | 49402 |
| CCL7 | 3213 | 26308 | 49403 |
| CCL8 | 3214 | 26309 | 49404 |
| COM2 | 3215 | 26310 | 49405 |
| CCM2L | 3216 | 26311 | 49406 |
| CCNA1 | 3217 | 26312 | 49407 |
| CCNA2 | 3218 | 26313 | 49408 |
| CCNB1 | 3219 | 26314 | 49409 |
| CCNB1IP1 | 3220 | 26315 | 49410 |
| CCNB2 | 3221 | 26316 | 49411 |
| CCNB3 | 3222 | 26317 | 49412 |
| CCNC | 3223 | 26318 | 49413 |
| CCND1 | 3224 | 26319 | 49414 |
| CCND2 | 3225 | 26320 | 49415 |
| CCND3 | 3226 | 26321 | 49416 |
| CCNDBP1 | 3227 | 26322 | 49417 |
| CCNE1 | 3228 | 26323 | 49418 |
| CCNE2 | 3229 | 26324 | 49419 |
| CCNF | 3230 | 26325 | 49420 |
| CCNG1 | 3231 | 26326 | 49421 |
| CCNG2 | 3232 | 26327 | 49422 |
| CCNH | 3233 | 26328 | 49423 |
| CCNI | 3234 | 26329 | 49424 |
| CCNI | 3235 | 26330 | 49425 |
| CCNI2 | 3236 | 26331 | 49426 |
| CCNJ | 3237 | 26332 | 49427 |
| CCNJL | 3238 | 26333 | 49428 |
| CCNK | 3239 | 26334 | 49429 |
| CCNL1 | 3240 | 26335 | 49430 |
| CCNL1 | 3241 | 26336 | 49431 |
| CCNL2 | 3242 | 26337 | 49432 |
| CCNL2 | 3243 | 26338 | 49433 |
| CCNO | 3244 | 26339 | 49434 |
| CCNQ | 3245 | 26340 | 49435 |
| CCNT1 | 3246 | 26341 | 49436 |
| CCNT2 | 3247 | 26342 | 49437 |
| CCNT2 | 3248 | 26343 | 49438 |
| CCNY | 3249 | 26344 | 49439 |
| CCNYL1 | 3250 | 26345 | 49440 |
| CCP110 | 3251 | 26346 | 49441 |
| CCPG1 | 3252 | 26347 | 49442 |
| CCPG1 | 3253 | 26348 | 49443 |
| CCR1 | 3254 | 26349 | 49444 |
| CCR10 | 3255 | 26350 | 49445 |
| CCR2 | 3256 | 26351 | 49446 |
| CCR2 | 3257 | 26352 | 49447 |
| CCR3 | 3258 | 26353 | 49448 |
| CCR4 | 3259 | 26354 | 49449 |
| CCR5 | 3260 | 26355 | 49450 |
| CCR6 | 3261 | 26356 | 49451 |
| CCR7 | 3262 | 26357 | 49452 |
| CCR8 | 3263 | 26358 | 49453 |
| CCR9 | 3264 | 26359 | 49454 |
| CCRL2 | 3265 | 26360 | 49455 |
| CCS | 3266 | 26361 | 49456 |
| CCSAP | 3267 | 26362 | 49457 |
| CCSER1 | 3268 | 26363 | 49458 |
| CCSER1 | 3269 | 26364 | 49459 |
| CCSER2 | 3270 | 26365 | 49460 |
| CCSER2 | 3271 | 26366 | 49461 |
| CCSER2 | 3272 | 26367 | 49462 |
| CCSER2 | 3273 | 26368 | 49463 |
| CCT2 | 3274 | 26369 | 49464 |
| CCT3 | 3275 | 26370 | 49465 |
| CCT4 | 3276 | 26371 | 49466 |
| CCT5 | 3277 | 26372 | 49467 |
| CCT6A | 3278 | 26373 | 49468 |
| CCT6B | 3279 | 26374 | 49469 |
| CCT7 | 3280 | 26375 | 49470 |
| CCT8 | 3281 | 26376 | 49471 |
| CCT8L2 | 3282 | 26377 | 49472 |
| CCZ1B | 3283 | 26378 | 49473 |
| CD101 | 3284 | 26379 | 49474 |
| CD109 | 3285 | 26380 | 49475 |
| CD14 | 3286 | 26381 | 49476 |
| CD151 | 3287 | 26382 | 49477 |
| CD160 | 3288 | 26383 | 49478 |
| CD163 | 3289 | 26384 | 49479 |
| CD163 | 3290 | 26385 | 49480 |
| CD163L1 | 3291 | 26386 | 49481 |
| CD164 | 3292 | 26387 | 49482 |
| CD164 | 3293 | 26388 | 49483 |
| CD164L2 | 3294 | 26389 | 49484 |
| CD164L2 | 3295 | 26390 | 49485 |
| CD177 | 3296 | 26391 | 49486 |
| CD180 | 3297 | 26392 | 49487 |
| CD19 | 3298 | 26393 | 49488 |
| CD1A | 3299 | 26394 | 49489 |
| CD1B | 3300 | 26395 | 49490 |
| CD1C | 3301 | 26396 | 49491 |
| CD1D | 3302 | 26397 | 49492 |
| CD1E | 3303 | 26398 | 49493 |
| CD1E | 3304 | 26399 | 49494 |
| CD2 | 3305 | 26400 | 49495 |
| CD200 | 3306 | 26401 | 49496 |
| CD200R1 | 3307 | 26402 | 49497 |
| CD200R1 | 3308 | 26403 | 49498 |
| CD200R1L | 3309 | 26404 | 49499 |
| CD207 | 3310 | 26405 | 49500 |
| CD209 | 3311 | 26406 | 49501 |
| CD22 | 3312 | 26407 | 49502 |
| CD22 | 3313 | 26408 | 49503 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| CD226 | 3314 | 26409 | 49504 |
| CD24 | 3315 | 26410 | 49505 |
| CD24 | 3316 | 26411 | 49506 |
| CD244 | 3317 | 26412 | 49507 |
| CD247 | 3318 | 26413 | 49508 |
| CD248 | 3319 | 26414 | 49509 |
| CD27 | 3320 | 26415 | 49510 |
| CD274 | 3321 | 26416 | 49511 |
| CD274 | 3322 | 26417 | 49512 |
| CD276 | 3323 | 26418 | 49513 |
| CD28 | 3324 | 26419 | 49514 |
| CD2AP | 3325 | 26420 | 49515 |
| CD2BP2 | 3326 | 26421 | 49516 |
| CD300A | 3327 | 26422 | 49517 |
| CD300C | 3328 | 26423 | 49518 |
| CD300E | 3329 | 26424 | 49519 |
| CD300H | 3330 | 26425 | 49520 |
| CD300LB | 3331 | 26426 | 49521 |
| CD300LD | 3332 | 26427 | 49522 |
| CD300LF | 3333 | 26428 | 49523 |
| CD300LF | 3334 | 26429 | 49524 |
| CD300LG | 3335 | 26430 | 49525 |
| CD300LG | 3336 | 26431 | 49526 |
| CD300LG | 3337 | 26432 | 49527 |
| CD302 | 3338 | 26433 | 49528 |
| CD320 | 3339 | 26434 | 49529 |
| CD33 | 3340 | 26435 | 49530 |
| CD33 | 3341 | 26436 | 49531 |
| CD34 | 3342 | 26437 | 49532 |
| CD34 | 3343 | 26438 | 49533 |
| CD36 | 3344 | 26439 | 49534 |
| CD37 | 3345 | 26440 | 49535 |
| CD38 | 3346 | 26441 | 49536 |
| CD3D | 3347 | 26442 | 49537 |
| CD3E | 3348 | 26443 | 49538 |
| CD3EAP | 3349 | 26444 | 49539 |
| CD3G | 3350 | 26445 | 49540 |
| CD4 | 3351 | 26446 | 49541 |
| CD40 | 3352 | 26447 | 49542 |
| CD40 | 3353 | 26448 | 49543 |
| CD40LG | 3354 | 26449 | 49544 |
| CD44 | 3355 | 26450 | 49545 |
| CD44 | 3356 | 26451 | 49546 |
| CD44 | 3357 | 26452 | 49547 |
| CD46 | 3358 | 26453 | 49548 |
| CD46 | 3359 | 26454 | 49549 |
| CD47 | 3360 | 26455 | 49550 |
| CD48 | 3361 | 26456 | 49551 |
| CD48 | 3362 | 26457 | 49552 |
| CD5 | 3363 | 26458 | 49553 |
| CD52 | 3364 | 26459 | 49554 |
| CD53 | 3365 | 26460 | 49555 |
| CD55 | 3366 | 26461 | 49556 |
| CD55 | 3367 | 26462 | 49557 |
| CD55 | 3368 | 26463 | 49558 |
| CD58 | 3369 | 26464 | 49559 |
| CD58 | 3370 | 26465 | 49560 |
| CD59 | 3371 | 26466 | 49561 |
| CD5L | 3372 | 26467 | 49562 |
| CD5L | 3373 | 26468 | 49563 |
| CD6 | 3374 | 26469 | 49564 |
| CD63 | 3375 | 26470 | 49565 |
| CD68 | 3376 | 26471 | 49566 |
| CD69 | 3377 | 26472 | 49567 |
| CD7 | 3378 | 26473 | 49568 |
| CD70 | 3379 | 26474 | 49569 |
| CD70 | 3380 | 26475 | 49570 |
| CD72 | 3381 | 26476 | 49571 |
| CD74 | 3382 | 26477 | 49572 |
| CD74 | 3383 | 26478 | 49573 |
| CD79A | 3384 | 26479 | 49574 |
| CD79B | 3385 | 26480 | 49575 |
| CD80 | 3386 | 26481 | 49576 |
| CD81 | 3387 | 26482 | 49577 |
| CD82 | 3388 | 26483 | 49578 |
| CD83 | 3389 | 26484 | 49579 |
| CD84 | 3390 | 26485 | 49580 |
| CD84 | 3391 | 26486 | 49581 |
| CD86 | 3392 | 26487 | 49582 |
| CD8A | 3393 | 26488 | 49583 |
| CD8A | 3394 | 26489 | 49584 |
| CD8A | 3395 | 26490 | 49585 |
| CD8B | 3396 | 26491 | 49586 |
| CD8B | 3397 | 26492 | 49587 |
| CD8B | 3398 | 26493 | 49588 |
| CD8B | 3399 | 26494 | 49589 |
| CD9 | 3400 | 26495 | 49590 |
| CD93 | 3401 | 26496 | 49591 |
| CD96 | 3402 | 26497 | 49592 |
| CD96 | 3403 | 26498 | 49593 |
| CD99 | 3404 | 26499 | 49594 |
| CD99 | 3405 | 26500 | 49595 |
| CD99L2 | 3406 | 26501 | 49596 |
| CDA | 3407 | 26502 | 49597 |
| CDADC1 | 3408 | 26503 | 49598 |
| CDADC1 | 3409 | 26504 | 49599 |
| CDAN1 | 3410 | 26505 | 49600 |
| CDC123 | 3411 | 26506 | 49601 |
| CDC14A | 3412 | 26507 | 49602 |
| CDC14A | 3413 | 26508 | 49603 |
| CDC14A | 3414 | 26509 | 49604 |
| CDC14A | 3415 | 26510 | 49605 |
| CDC14B | 3416 | 26511 | 49606 |
| CDC14B | 3417 | 26512 | 49607 |
| CDC14B | 3418 | 26513 | 49608 |
| CDC16 | 3419 | 26514 | 49609 |
| CDC20 | 3420 | 26515 | 49610 |
| CDC20B | 3421 | 26516 | 49611 |
| CDC23 | 3422 | 26517 | 49612 |
| CDC25A | 3423 | 26518 | 49613 |
| CDC25B | 3424 | 26519 | 49614 |
| CDC25C | 3425 | 26520 | 49615 |
| CDC26 | 3426 | 26521 | 49616 |
| CDC27 | 3427 | 26522 | 49617 |
| CDC27 | 3428 | 26523 | 49618 |
| CDC34 | 3429 | 26524 | 49619 |
| CDC37 | 3430 | 26525 | 49620 |
| CDC37L1 | 3431 | 26526 | 49621 |
| CDC40 | 3432 | 26527 | 49622 |
| CDC42 | 3433 | 26528 | 49623 |
| CDC42 | 3434 | 26529 | 49624 |
| CDC42BPA | 3435 | 26530 | 49625 |
| CDC42BPB | 3436 | 26531 | 49626 |
| CDC42BPG | 3437 | 26532 | 49627 |
| CDC42EP1 | 3438 | 26533 | 49628 |
| CDC42EP2 | 3439 | 26534 | 49629 |
| CDC42EP3 | 3440 | 26535 | 49630 |
| CDC42EP4 | 3441 | 26536 | 49631 |
| CDC42EP5 | 3442 | 26537 | 49632 |
| CDC42SE1 | 3443 | 26538 | 49633 |
| CDC42SE2 | 3444 | 26539 | 49634 |
| CDC45 | 3445 | 26540 | 49635 |
| CDC5L | 3446 | 26541 | 49636 |
| CDC6 | 3447 | 26542 | 49637 |
| CDC7 | 3448 | 26543 | 49638 |
| CDC73 | 3449 | 26544 | 49639 |
| CDCA2 | 3450 | 26545 | 49640 |
| CDCA2 | 3451 | 26546 | 49641 |
| CDCA3 | 3452 | 26547 | 49642 |
| CDCA3 | 3453 | 26548 | 49643 |
| CDCA3 | 3454 | 26549 | 49644 |
| CDCA4 | 3455 | 26550 | 49645 |
| CDCA5 | 3456 | 26551 | 49646 |
| CDCA7 | 3457 | 26552 | 49647 |
| CDCA7L | 3458 | 26553 | 49648 |
| CDCA8 | 3459 | 26554 | 49649 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| CDCP1 | 3460 | 26555 | 49650 |
| CDCP1 | 3461 | 26556 | 49651 |
| CDCP2 | 3462 | 26557 | 49652 |
| CDCP2 | 3463 | 26558 | 49653 |
| CDH1 | 3464 | 26559 | 49654 |
| CDH1 | 3465 | 26560 | 49655 |
| CDH1 | 3466 | 26561 | 49656 |
| CDH10 | 3467 | 26562 | 49657 |
| CDH10 | 3468 | 26563 | 49658 |
| CDH11 | 3469 | 26564 | 49659 |
| CDH11 | 3470 | 26565 | 49660 |
| CDH12 | 3471 | 26566 | 49661 |
| CDH13 | 3472 | 26567 | 49662 |
| CDH13 | 3473 | 26568 | 49663 |
| CDH13 | 3474 | 26569 | 49664 |
| CDH15 | 3475 | 26570 | 49665 |
| CDH16 | 3476 | 26571 | 49666 |
| CDH17 | 3477 | 26572 | 49667 |
| CDH18 | 3478 | 26573 | 49668 |
| CDH18 | 3479 | 26574 | 49669 |
| CDH19 | 3480 | 26575 | 49670 |
| CDH19 | 3481 | 26576 | 49671 |
| CDH2 | 3482 | 26577 | 49672 |
| CDH20 | 3483 | 26578 | 49673 |
| CDH22 | 3484 | 26579 | 49674 |
| CDH23 | 3485 | 26580 | 49675 |
| CDH23 | 3486 | 26581 | 49676 |
| CDH23 | 3487 | 26582 | 49677 |
| CDH23 | 3488 | 26583 | 49678 |
| CDH23 | 3489 | 26584 | 49679 |
| CDH24 | 3490 | 26585 | 49680 |
| CDH26 | 3491 | 26586 | 49681 |
| CDH3 | 3492 | 26587 | 49682 |
| CDH3 | 3493 | 26588 | 49683 |
| CDH4 | 3494 | 26589 | 49684 |
| CDH5 | 3495 | 26590 | 49685 |
| CDH6 | 3496 | 26591 | 49686 |
| CDH7 | 3497 | 26592 | 49687 |
| CDH7 | 3498 | 26593 | 49688 |
| CDH8 | 3499 | 26594 | 49689 |
| CDH9 | 3500 | 26595 | 49690 |
| CDHR1 | 3501 | 26596 | 49691 |
| CDHR1 | 3502 | 26597 | 49692 |
| CDHR2 | 3503 | 26598 | 49693 |
| CDHR3 | 3504 | 26599 | 49694 |
| CDHR4 | 3505 | 26600 | 49695 |
| CDHR5 | 3506 | 26601 | 49696 |
| CDIP1 | 3507 | 26602 | 49697 |
| CDIPT | 3508 | 26603 | 49698 |
| CDK1 | 3509 | 26604 | 49699 |
| CDK1 | 3510 | 26605 | 49700 |
| CDK10 | 3511 | 26606 | 49701 |
| CDK10 | 3512 | 26607 | 49702 |
| CDK11B | 3513 | 26608 | 49703 |
| CDK12 | 3514 | 26609 | 49704 |
| CDK13 | 3515 | 26610 | 49705 |
| CDK14 | 3516 | 26611 | 49706 |
| CDK15 | 3517 | 26612 | 49707 |
| CDK15 | 3518 | 26613 | 49708 |
| CDK16 | 3519 | 26614 | 49709 |
| CDK17 | 3520 | 26615 | 49710 |
| CDK17 | 3521 | 26616 | 49711 |
| CDK18 | 3522 | 26617 | 49712 |
| CDK19 | 3523 | 26618 | 49713 |
| CDK2 | 3524 | 26619 | 49714 |
| CDK20 | 3525 | 26620 | 49715 |
| CDK20 | 3526 | 26621 | 49716 |
| CDK2AP1 | 3527 | 26622 | 49717 |
| CDK2AP2 | 3528 | 26623 | 49718 |
| CDK2AP2 | 3529 | 26624 | 49719 |
| CDK3 | 3530 | 26625 | 49720 |
| CDK4 | 3531 | 26626 | 49721 |
| CDK5 | 3532 | 26627 | 49722 |
| CDK5R1 | 3533 | 26628 | 49723 |
| CDK5R2 | 3534 | 26629 | 49724 |
| CDK5RAP1 | 3535 | 26630 | 49725 |
| CDK5RAP2 | 3536 | 26631 | 49726 |
| CDK5RAP3 | 3537 | 26632 | 49727 |
| CDK5RAP3 | 3538 | 26633 | 49728 |
| CDK6 | 3539 | 26634 | 49729 |
| CDK7 | 3540 | 26635 | 49730 |
| CDK8 | 3541 | 26636 | 49731 |
| CDK9 | 3542 | 26637 | 49732 |
| CDKAL1 | 3543 | 26638 | 49733 |
| CDKL1 | 3544 | 26639 | 49734 |
| CDKL1 | 3545 | 26640 | 49735 |
| CDKL2 | 3546 | 26641 | 49736 |
| CDKL3 | 3547 | 26642 | 49737 |
| CDKL3 | 3548 | 26643 | 49738 |
| CDKL3 | 3549 | 26644 | 49739 |
| CDKL4 | 3550 | 26645 | 49740 |
| CDKL4 | 3551 | 26646 | 49741 |
| CDKL5 | 3552 | 26647 | 49742 |
| CDKL5 | 3553 | 26648 | 49743 |
| CDKN1A | 3554 | 26649 | 49744 |
| CDKN1B | 3555 | 26650 | 49745 |
| CDKN1C | 3556 | 26651 | 49746 |
| CDKN2A | 3557 | 26652 | 49747 |
| CDKN2A | 3558 | 26653 | 49748 |
| CDKN2A | 3559 | 26654 | 49749 |
| CDKN2A | 3560 | 26655 | 49750 |
| CDKN2AIP | 3561 | 26656 | 49751 |
| CDKN2AIPNL | 3562 | 26657 | 49752 |
| CDKN2B | 3563 | 26658 | 49753 |
| CDKN2C | 3564 | 26659 | 49754 |
| CDKN2C | 3565 | 26660 | 49755 |
| CDKN2D | 3566 | 26661 | 49756 |
| CDKN3 | 3567 | 26662 | 49757 |
| CDKN3 | 3568 | 26663 | 49758 |
| CDNF | 3569 | 26664 | 49759 |
| CDO1 | 3570 | 26665 | 49760 |
| CDON | 3571 | 26666 | 49761 |
| CDPF1 | 3572 | 26667 | 49762 |
| CDR1 | 3573 | 26668 | 49763 |
| CDR2 | 3574 | 26669 | 49764 |
| CDR2L | 3575 | 26670 | 49765 |
| CDRT1 | 3576 | 26671 | 49766 |
| CDRT1 | 3577 | 26672 | 49767 |
| CDRT15 | 3578 | 26673 | 49768 |
| CDRT15L2 | 3579 | 26674 | 49769 |
| CDRT4 | 3580 | 26675 | 49770 |
| CDS1 | 3581 | 26676 | 49771 |
| CDS2 | 3582 | 26677 | 49772 |
| CDSN | 3583 | 26678 | 49773 |
| CDT1 | 3584 | 26679 | 49774 |
| CDV3 | 3585 | 26680 | 49775 |
| CDV3 | 3586 | 26681 | 49776 |
| CDX1 | 3587 | 26682 | 49777 |
| CDX2 | 3588 | 26683 | 49778 |
| CDX4 | 3589 | 26684 | 49779 |
| CDY1 | 3590 | 26685 | 49780 |
| CDY2A | 3591 | 26686 | 49781 |
| CDYL | 3592 | 26687 | 49782 |
| CDYL2 | 3593 | 26688 | 49783 |
| CEACAM1 | 3594 | 26689 | 49784 |
| CEACAM1 | 3595 | 26690 | 49785 |
| CEACAM16 | 3596 | 26691 | 49786 |
| CEACAM18 | 3597 | 26692 | 49787 |
| CEACAM19 | 3598 | 26693 | 49788 |
| CEACAM20 | 3599 | 26694 | 49789 |
| CEACAM21 | 3600 | 26695 | 49790 |
| CEACAM21 | 3601 | 26696 | 49791 |
| CEACAM3 | 3602 | 26697 | 49792 |
| CEACAM3 | 3603 | 26698 | 49793 |
| CEACAM4 | 3604 | 26699 | 49794 |
| CEACAM5 | 3605 | 26700 | 49795 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| CEACAM6 | 3606 | 26701 | 49796 |
| CEACAM7 | 3607 | 26702 | 49797 |
| CEACAM8 | 3608 | 26703 | 49798 |
| CEBPA | 3609 | 26704 | 49799 |
| CEBPB | 3610 | 26705 | 49800 |
| CEBPD | 3611 | 26706 | 49801 |
| CEBPE | 3612 | 26707 | 49802 |
| CEBPG | 3613 | 26708 | 49803 |
| CEBPZ | 3614 | 26709 | 49804 |
| CEBPZOS | 3615 | 26710 | 49805 |
| CEBPZOS | 3616 | 26711 | 49806 |
| CECR2 | 3617 | 26712 | 49807 |
| CEL | 3618 | 26713 | 49808 |
| CELA1 | 3619 | 26714 | 49809 |
| CELA2A | 3620 | 26715 | 49810 |
| CELA2B | 3621 | 26716 | 49811 |
| CELA3A | 3622 | 26717 | 49812 |
| CELF1 | 3623 | 26718 | 49813 |
| CELF2 | 3624 | 26719 | 49814 |
| CELF3 | 3625 | 26720 | 49815 |
| CELF4 | 3626 | 26721 | 49816 |
| CELF4 | 3627 | 26722 | 49817 |
| CELF4 | 3628 | 26723 | 49818 |
| CELF4 | 3629 | 26724 | 49819 |
| CELF5 | 3630 | 26725 | 49820 |
| CELF5 | 3631 | 26726 | 49821 |
| CELF6 | 3632 | 26727 | 49822 |
| CELSR1 | 3633 | 26728 | 49823 |
| CELSR2 | 3634 | 26729 | 49824 |
| CELSR3 | 3635 | 26730 | 49825 |
| CEMIP | 3636 | 26731 | 49826 |
| CEMP1 | 3637 | 26732 | 49827 |
| CEND1 | 3638 | 26733 | 49828 |
| CENPA | 3639 | 26734 | 49829 |
| CENPB | 3640 | 26735 | 49830 |
| CENPBD1 | 3641 | 26736 | 49831 |
| CENPC | 3642 | 26737 | 49832 |
| CENPE | 3643 | 26738 | 49833 |
| CENPF | 3644 | 26739 | 49834 |
| CENPH | 3645 | 26740 | 49835 |
| CENPI | 3646 | 26741 | 49836 |
| CENPI | 3647 | 26742 | 49837 |
| CENPJ | 3648 | 26743 | 49838 |
| CENPK | 3649 | 26744 | 49839 |
| CENPK | 3650 | 26745 | 49840 |
| CENPL | 3651 | 26746 | 49841 |
| CENPM | 3652 | 26747 | 49842 |
| CENPM | 3653 | 26748 | 49843 |
| CENPM | 3654 | 26749 | 49844 |
| CENPM | 3655 | 26750 | 49845 |
| CENPM | 3656 | 26751 | 49846 |
| CENPN | 3657 | 26752 | 49847 |
| CENPN | 3658 | 26753 | 49848 |
| CENPN | 3659 | 26754 | 49849 |
| CENPO | 3660 | 26755 | 49850 |
| CENPP | 3661 | 26756 | 49851 |
| CENPP | 3662 | 26757 | 49852 |
| CENPQ | 3663 | 26758 | 49853 |
| CENPS | 3664 | 26759 | 49854 |
| CENPS-CORT | 3665 | 26760 | 49855 |
| CENPT | 3666 | 26761 | 49856 |
| CENPU | 3667 | 26762 | 49857 |
| CENPV | 3668 | 26763 | 49858 |
| CENPW | 3669 | 26764 | 49859 |
| CENPX | 3670 | 26765 | 49860 |
| CENPX | 3671 | 26766 | 49861 |
| CEP104 | 3672 | 26767 | 49862 |
| CEP112 | 3673 | 26768 | 49863 |
| CEP120 | 3674 | 26769 | 49864 |
| CEP126 | 3675 | 26770 | 49865 |
| CEP128 | 3676 | 26771 | 49866 |
| CEP131 | 3677 | 26772 | 49867 |
| CEP135 | 3678 | 26773 | 49868 |
| CEP152 | 3679 | 26774 | 49869 |
| CEP162 | 3680 | 26775 | 49870 |
| CEP164 | 3681 | 26776 | 49871 |
| CEP170 | 3682 | 26777 | 49872 |
| CEP170B | 3683 | 26778 | 49873 |
| CEP19 | 3684 | 26779 | 49874 |
| CEP192 | 3685 | 26780 | 49875 |
| CEP250 | 3686 | 26781 | 49876 |
| CEP290 | 3687 | 26782 | 49877 |
| CEP295 | 3688 | 26783 | 49878 |
| CEP295NL | 3689 | 26784 | 49879 |
| CEP350 | 3690 | 26785 | 49880 |
| CEP41 | 3691 | 26786 | 49881 |
| CEP41 | 3692 | 26787 | 49882 |
| CEP44 | 3693 | 26788 | 49883 |
| CEP44 | 3694 | 26789 | 49884 |
| CEP55 | 3695 | 26790 | 49885 |
| CEP57 | 3696 | 26791 | 49886 |
| CEP57L1 | 3697 | 26792 | 49887 |
| CEP57L1 | 3698 | 26793 | 49888 |
| CEP57L1 | 3699 | 26794 | 49889 |
| CEP63 | 3700 | 26795 | 49890 |
| CEP63 | 3701 | 26796 | 49891 |
| CEP68 | 3702 | 26797 | 49892 |
| CEP70 | 3703 | 26798 | 49893 |
| CEP70 | 3704 | 26799 | 49894 |
| CEP70 | 3705 | 26800 | 49895 |
| CEP70 | 3706 | 26801 | 49896 |
| CEP72 | 3707 | 26802 | 49897 |
| CEP76 | 3708 | 26803 | 49898 |
| CEP78 | 3709 | 26804 | 49899 |
| CEP78 | 3710 | 26805 | 49900 |
| CEP83 | 3711 | 26806 | 49901 |
| CEP83 | 3712 | 26807 | 49902 |
| CEP85 | 3713 | 26808 | 49903 |
| CEP85L | 3714 | 26809 | 49904 |
| CEP85L | 3715 | 26810 | 49905 |
| CEP89 | 3716 | 26811 | 49906 |
| CEP95 | 3717 | 26812 | 49907 |
| CEP97 | 3718 | 26813 | 49908 |
| CEPT1 | 3719 | 26814 | 49909 |
| CER1 | 3720 | 26815 | 49910 |
| CERCAM | 3721 | 26816 | 49911 |
| CERK | 3722 | 26817 | 49912 |
| CERKL | 3723 | 26818 | 49913 |
| CERS1 | 3724 | 26819 | 49914 |
| CERS1 | 3725 | 26820 | 49915 |
| CERS2 | 3726 | 26821 | 49916 |
| CERS3 | 3727 | 26822 | 49917 |
| CERS4 | 3728 | 26823 | 49918 |
| CERS5 | 3729 | 26824 | 49919 |
| CERS5 | 3730 | 26825 | 49920 |
| CERS5 | 3731 | 26826 | 49921 |
| CERS6 | 3732 | 26827 | 49922 |
| CES1 | 3733 | 26828 | 49923 |
| CES2 | 3734 | 26829 | 49924 |
| CES3 | 3735 | 26830 | 49925 |
| CES4A | 3736 | 26831 | 49926 |
| CES4A | 3737 | 26832 | 49927 |
| CES5A | 3738 | 26833 | 49928 |
| CETN1 | 3739 | 26834 | 49929 |
| CETN2 | 3740 | 26835 | 49930 |
| CETN3 | 3741 | 26836 | 49931 |
| CETP | 3742 | 26837 | 49932 |
| CFAP100 | 3743 | 26838 | 49933 |
| CFAP126 | 3744 | 26839 | 49934 |
| CFAP157 | 3745 | 26840 | 49935 |
| CFAP161 | 3746 | 26841 | 49936 |
| CFAP161 | 3747 | 26842 | 49937 |
| CFAP20 | 3748 | 26843 | 49938 |
| CFAP206 | 3749 | 26844 | 49939 |
| CFAP221 | 3750 | 26845 | 49940 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| CFAP36 | 3751 | 26846 | 49941 |
| CFAP43 | 3752 | 26847 | 49942 |
| CFAP44 | 3753 | 26848 | 49943 |
| CFAP44 | 3754 | 26849 | 49944 |
| CFAP45 | 3755 | 26850 | 49945 |
| CFAP46 | 3756 | 26851 | 49946 |
| CFAP47 | 3757 | 26852 | 49947 |
| CFAP47 | 3758 | 26853 | 49948 |
| CFAP52 | 3759 | 26854 | 49949 |
| CFAP53 | 3760 | 26855 | 49950 |
| CFAP54 | 3761 | 26856 | 49951 |
| CFAP57 | 3762 | 26857 | 49952 |
| CFAP57 | 3763 | 26858 | 49953 |
| CFAP58 | 3764 | 26859 | 49954 |
| CFAP61 | 3765 | 26860 | 49955 |
| CFAP61 | 3766 | 26861 | 49956 |
| CFAP65 | 3767 | 26862 | 49957 |
| CFAP65 | 3768 | 26863 | 49958 |
| CFAP65 | 3769 | 26864 | 49959 |
| CFAP69 | 3770 | 26865 | 49960 |
| CFAP70 | 3771 | 26866 | 49961 |
| CFAP73 | 3772 | 26867 | 49962 |
| CFAP74 | 3773 | 26868 | 49963 |
| CFAP77 | 3774 | 26869 | 49964 |
| CFAP97 | 3775 | 26870 | 49965 |
| CFAP97 | 3776 | 26871 | 49966 |
| CFAP99 | 3777 | 26872 | 49967 |
| CFB | 3778 | 26873 | 49968 |
| CFC1 | 3779 | 26874 | 49969 |
| CFD | 3780 | 26875 | 49970 |
| CFDP1 | 3781 | 26876 | 49971 |
| CFH | 3782 | 26877 | 49972 |
| CFH | 3783 | 26878 | 49973 |
| CFHR2 | 3784 | 26879 | 49974 |
| CFHR3 | 3785 | 26880 | 49975 |
| CFHR5 | 3786 | 26881 | 49976 |
| CFI | 3787 | 26882 | 49977 |
| CFL1 | 3788 | 26883 | 49978 |
| CFL2 | 3789 | 26884 | 49979 |
| CFLAR | 3790 | 26885 | 49980 |
| CFLAR | 3791 | 26886 | 49981 |
| CFLAR | 3792 | 26887 | 49982 |
| CFLAR | 3793 | 26888 | 49983 |
| CFP | 3794 | 26889 | 49984 |
| CFTR | 3795 | 26890 | 49985 |
| CGA | 3796 | 26891 | 49986 |
| CGB1 | 3797 | 26892 | 49987 |
| CGB2 | 3798 | 26893 | 49988 |
| CGGBP1 | 3799 | 26894 | 49989 |
| CGN | 3800 | 26895 | 49990 |
| CGNL1 | 3801 | 26896 | 49991 |
| CGREF1 | 3802 | 26897 | 49992 |
| CGREF1 | 3803 | 26898 | 49993 |
| CGREF1 | 3804 | 26899 | 49994 |
| CGRRF1 | 3805 | 26900 | 49995 |
| CH25H | 3806 | 26901 | 49996 |
| CHAC1 | 3807 | 26902 | 49997 |
| CHAC2 | 3808 | 26903 | 49998 |
| CHAD | 3809 | 26904 | 49999 |
| CHADL | 3810 | 26905 | 50000 |
| CHAF1A | 3811 | 26906 | 50001 |
| CHAF1B | 3812 | 26907 | 50002 |
| CHAMP1 | 3813 | 26908 | 50003 |
| CHAT | 3814 | 26909 | 50004 |
| CHCHD1 | 3815 | 26910 | 50005 |
| CHCHD10 | 3816 | 26911 | 50006 |
| CHCHD2 | 3817 | 26912 | 50007 |
| CHCHD2 | 3818 | 26913 | 50008 |
| CHCHD3 | 3819 | 26914 | 50009 |
| CHCHD3 | 3820 | 26915 | 50010 |
| CHCHD4 | 3821 | 26916 | 50011 |
| CHCHD5 | 3822 | 26917 | 50012 |
| CHCHD6 | 3823 | 26918 | 50013 |
| CHCHD7 | 3824 | 26919 | 50014 |
| CHCHD7 | 3825 | 26920 | 50015 |
| CHCHD7 | 3826 | 26921 | 50016 |
| CHCHD7 | 3827 | 26922 | 50017 |
| CHD1 | 3828 | 26923 | 50018 |
| CHD1L | 3829 | 26924 | 50019 |
| CHD2 | 3830 | 26925 | 50020 |
| CHD2 | 3831 | 26926 | 50021 |
| CHD3 | 3832 | 26927 | 50022 |
| CHD4 | 3833 | 26928 | 50023 |
| CHD5 | 3834 | 26929 | 50024 |
| CHD6 | 3835 | 26930 | 50025 |
| CHD7 | 3836 | 26931 | 50026 |
| CHD8 | 3837 | 26932 | 50027 |
| CHD9 | 3838 | 26933 | 50028 |
| CHDH | 3839 | 26934 | 50029 |
| CHEK1 | 3840 | 26935 | 50030 |
| CHEK2 | 3841 | 26936 | 50031 |
| CHERP | 3842 | 26937 | 50032 |
| CHFR | 3843 | 26938 | 50033 |
| CHGA | 3844 | 26939 | 50034 |
| CHGB | 3845 | 26940 | 50035 |
| CHI3L1 | 3846 | 26941 | 50036 |
| CHI3L2 | 3847 | 26942 | 50037 |
| CHIA | 3848 | 26943 | 50038 |
| CHIC1 | 3849 | 26944 | 50039 |
| CHIC2 | 3850 | 26945 | 50040 |
| CHID1 | 3851 | 26946 | 50041 |
| CHIT1 | 3852 | 26947 | 50042 |
| CHKA | 3853 | 26948 | 50043 |
| CHKB | 3854 | 26949 | 50044 |
| CHL1 | 3855 | 26950 | 50045 |
| CHM | 3856 | 26951 | 50046 |
| CHM | 3857 | 26952 | 50047 |
| CHML | 3858 | 26953 | 50048 |
| CHMP1A | 3859 | 26954 | 50049 |
| CHMP1A | 3860 | 26955 | 50050 |
| CHMP1B | 3861 | 26956 | 50051 |
| CHMP2A | 3862 | 26957 | 50052 |
| CHMP2B | 3863 | 26958 | 50053 |
| CHMP3 | 3864 | 26959 | 50054 |
| CHMP4A | 3865 | 26960 | 50055 |
| CHMP4B | 3866 | 26961 | 50056 |
| CHMP4C | 3867 | 26962 | 50057 |
| CHMP5 | 3868 | 26963 | 50058 |
| CHMP5 | 3869 | 26964 | 50059 |
| CHMP6 | 3870 | 26965 | 50060 |
| CHMP7 | 3871 | 26966 | 50061 |
| CHN1 | 3872 | 26967 | 50062 |
| CHN2 | 3873 | 26968 | 50063 |
| CHN2 | 3874 | 26969 | 50064 |
| CHODL | 3875 | 26970 | 50065 |
| CHODL | 3876 | 26971 | 50066 |
| CHORDC1 | 3877 | 26972 | 50067 |
| CHP1 | 3878 | 26973 | 50068 |
| CHP2 | 3879 | 26974 | 50069 |
| CHPF | 3880 | 26975 | 50070 |
| CHPF2 | 3881 | 26976 | 50071 |
| CHPT1 | 3882 | 26977 | 50072 |
| CHRAC1 | 3883 | 26978 | 50073 |
| CHRD | 3884 | 26979 | 50074 |
| CHRDL1 | 3885 | 26980 | 50075 |
| CHRDL2 | 3886 | 26981 | 50076 |
| CHRM1 | 3887 | 26982 | 50077 |
| CHRM2 | 3888 | 26983 | 50078 |
| CHRM3 | 3889 | 26984 | 50079 |
| CHRM4 | 3890 | 26985 | 50080 |
| CHRM5 | 3891 | 26986 | 50081 |
| CHRNA1 | 3892 | 26987 | 50082 |
| CHRNA10 | 3893 | 26988 | 50083 |
| CHRNA2 | 3894 | 26989 | 50084 |
| CHRNA3 | 3895 | 26990 | 50085 |
| CHRNA3 | 3896 | 26991 | 50086 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| CHRNA4 | 3897 | 26992 | 50087 |
| CHRNA5 | 3898 | 26993 | 50088 |
| CHRNA5 | 3899 | 26994 | 50089 |
| CHRNA6 | 3900 | 26995 | 50090 |
| CHRNA7 | 3901 | 26996 | 50091 |
| CHRNA9 | 3902 | 26997 | 50092 |
| CHRNB1 | 3903 | 26998 | 50093 |
| CHRNB2 | 3904 | 26999 | 50094 |
| CHRNB3 | 3905 | 27000 | 50095 |
| CHRNB4 | 3906 | 27001 | 50096 |
| CHRNB4 | 3907 | 27002 | 50097 |
| CHRND | 3908 | 27003 | 50098 |
| CHRNE | 3909 | 27004 | 50099 |
| CHRNG | 3910 | 27005 | 50100 |
| CHST1 | 3911 | 27006 | 50101 |
| CHST10 | 3912 | 27007 | 50102 |
| CHST11 | 3913 | 27008 | 50103 |
| CHST12 | 3914 | 27009 | 50104 |
| CHST13 | 3915 | 27010 | 50105 |
| CHST14 | 3916 | 27011 | 50106 |
| CHST15 | 3917 | 27012 | 50107 |
| CHST15 | 3918 | 27013 | 50108 |
| CHST2 | 3919 | 27014 | 50109 |
| CHST3 | 3920 | 27015 | 50110 |
| CHST4 | 3921 | 27016 | 50111 |
| CHST5 | 3922 | 27017 | 50112 |
| CHST6 | 3923 | 27018 | 50113 |
| CHST7 | 3924 | 27019 | 50114 |
| CHST8 | 3925 | 27020 | 50115 |
| CHST9 | 3926 | 27021 | 50116 |
| CHSY1 | 3927 | 27022 | 50117 |
| CHSY3 | 3928 | 27023 | 50118 |
| CHTF18 | 3929 | 27024 | 50119 |
| CHTF8 | 3930 | 27025 | 50120 |
| CHTOP | 3931 | 27026 | 50121 |
| CHTOP | 3932 | 27027 | 50122 |
| CHUK | 3933 | 27028 | 50123 |
| CHUK | 3934 | 27029 | 50124 |
| CHURC1 | 3935 | 27030 | 50125 |
| CHURC1 | 3936 | 27031 | 50126 |
| CHURC1-FNTB | 3937 | 27032 | 50127 |
| CIAO1 | 3938 | 27033 | 50128 |
| CIAPIN1 | 3939 | 27034 | 50129 |
| CIAPIN1 | 3940 | 27035 | 50130 |
| CIART | 3941 | 27036 | 50131 |
| CIB1 | 3942 | 27037 | 50132 |
| CIB2 | 3943 | 27038 | 50133 |
| CIB3 | 3944 | 27039 | 50134 |
| CIB4 | 3945 | 27040 | 50135 |
| CIC | 3946 | 27041 | 50136 |
| CIDEA | 3947 | 27042 | 50137 |
| CIDEB | 3948 | 27043 | 50138 |
| CIDEC | 3949 | 27044 | 50139 |
| CIITA | 3950 | 27045 | 50140 |
| CILP | 3951 | 27046 | 50141 |
| CILP2 | 3952 | 27047 | 50142 |
| CINP | 3953 | 27048 | 50143 |
| CINP | 3954 | 27049 | 50144 |
| CIP2A | 3955 | 27050 | 50145 |
| CIPC | 3956 | 27051 | 50146 |
| CIR1 | 3957 | 27052 | 50147 |
| CIRBP | 3958 | 27053 | 50148 |
| CIRBP | 3959 | 27054 | 50149 |
| CIRBP | 3960 | 27055 | 50150 |
| CISD1 | 3961 | 27056 | 50151 |
| CISD2 | 3962 | 27057 | 50152 |
| CISD3 | 3963 | 27058 | 50153 |
| CISH | 3964 | 27059 | 50154 |
| CIT | 3965 | 27060 | 50155 |
| CITED1 | 3966 | 27061 | 50156 |
| CITED2 | 3967 | 27062 | 50157 |
| CITED4 | 3968 | 27063 | 50158 |
| CIZ1 | 3969 | 27064 | 50159 |
| CKAP2 | 3970 | 27065 | 50160 |
| CKAP2 | 3971 | 27066 | 50161 |
| CKAP2L | 3972 | 27067 | 50162 |
| CKAP4 | 3973 | 27068 | 50163 |
| CKAP5 | 3974 | 27069 | 50164 |
| CKB | 3975 | 27070 | 50165 |
| CKLF | 3976 | 27071 | 50166 |
| CKLF | 3977 | 27072 | 50167 |
| CKM | 3978 | 27073 | 50168 |
| CKMT1A | 3979 | 27074 | 50169 |
| CKMT2 | 3980 | 27075 | 50170 |
| CKS1B | 3981 | 27076 | 50171 |
| CKS2 | 3982 | 27077 | 50172 |
| CLASP1 | 3983 | 27078 | 50173 |
| CLASP2 | 3984 | 27079 | 50174 |
| CLASRP | 3985 | 27080 | 50175 |
| CLBA1 | 3986 | 27081 | 50176 |
| CLC | 3987 | 27082 | 50177 |
| CLCA1 | 3988 | 27083 | 50178 |
| CLCA2 | 3989 | 27084 | 50179 |
| CLCA4 | 3990 | 27085 | 50180 |
| CLCC1 | 3991 | 27086 | 50181 |
| CLCF1 | 3992 | 27087 | 50182 |
| CLCN1 | 3993 | 27088 | 50183 |
| CLCN2 | 3994 | 27089 | 50184 |
| CLCN3 | 3995 | 27090 | 50185 |
| CLCN3 | 3996 | 27091 | 50186 |
| CLCN4 | 3997 | 27092 | 50187 |
| CLCN5 | 3998 | 27093 | 50188 |
| CLCN5 | 3999 | 27094 | 50189 |
| CLCN6 | 4000 | 27095 | 50190 |
| CLCN7 | 4001 | 27096 | 50191 |
| CLCNKA | 4002 | 27097 | 50192 |
| CLCNKB | 4003 | 27098 | 50193 |
| CLDN1 | 4004 | 27099 | 50194 |
| CLDN10 | 4005 | 27100 | 50195 |
| CLDN11 | 4006 | 27101 | 50196 |
| CLDN12 | 4007 | 27102 | 50197 |
| CLDN14 | 4008 | 27103 | 50198 |
| CLDN15 | 4009 | 27104 | 50199 |
| CLDN16 | 4010 | 27105 | 50200 |
| CLDN17 | 4011 | 27106 | 50201 |
| CLDN18 | 4012 | 27107 | 50202 |
| CLDN19 | 4013 | 27108 | 50203 |
| CLDN19 | 4014 | 27109 | 50204 |
| CLDN19 | 4015 | 27110 | 50205 |
| CLDN2 | 4016 | 27111 | 50206 |
| CLDN20 | 4017 | 27112 | 50207 |
| CLDN22 | 4018 | 27113 | 50208 |
| CLDN23 | 4019 | 27114 | 50209 |
| CLDN24 | 4020 | 27115 | 50210 |
| CLDN25 | 4021 | 27116 | 50211 |
| CLDN3 | 4022 | 27117 | 50212 |
| CLDN34 | 4023 | 27118 | 50213 |
| CLDN4 | 4024 | 27119 | 50214 |
| CLDN5 | 4025 | 27120 | 50215 |
| CLDN6 | 4026 | 27121 | 50216 |
| CLDN7 | 4027 | 27122 | 50217 |
| CLDN7 | 4028 | 27123 | 50218 |
| CLDN8 | 4029 | 27124 | 50219 |
| CLDN9 | 4030 | 27125 | 50220 |
| CLDND1 | 4031 | 27126 | 50221 |
| CLDND2 | 4032 | 27127 | 50222 |
| CLEC10A | 4033 | 27128 | 50223 |
| CLEC11A | 4034 | 27129 | 50224 |
| CLEC12A | 4035 | 27130 | 50225 |
| CLEC12A | 4036 | 27131 | 50226 |
| CLEC12B | 4037 | 27132 | 50227 |
| CLEC12B | 4038 | 27133 | 50228 |
| CLEC14A | 4039 | 27134 | 50229 |
| CLEC16A | 4040 | 27135 | 50230 |
| CLEC16A | 4041 | 27136 | 50231 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| CLEC17A | 4042 | 27137 | 50232 |
| CLEC17A | 4043 | 27138 | 50233 |
| CLEC18C | 4044 | 27139 | 50234 |
| CLEC19A | 4045 | 27140 | 50235 |
| CLEC1A | 4046 | 27141 | 50236 |
| CLEC1B | 4047 | 27142 | 50237 |
| CLEC2A | 4048 | 27143 | 50238 |
| CLEC2A | 4049 | 27144 | 50239 |
| CLEC2B | 4050 | 27145 | 50240 |
| CLEC2L | 4051 | 27146 | 50241 |
| CLEC3A | 4052 | 27147 | 50242 |
| CLEC3B | 4053 | 27148 | 50243 |
| CLEC4A | 4054 | 27149 | 50244 |
| CLEC4C | 4055 | 27150 | 50245 |
| CLEC4D | 4056 | 27151 | 50246 |
| CLEC4E | 4057 | 27152 | 50247 |
| CLEC4F | 4058 | 27153 | 50248 |
| CLEC4F | 4059 | 27154 | 50249 |
| CLEC4F | 4060 | 27155 | 50250 |
| CLEC4G | 4061 | 27156 | 50251 |
| CLEC4M | 4062 | 27157 | 50252 |
| CLEC4M | 4063 | 27158 | 50253 |
| CLEC5A | 4064 | 27159 | 50254 |
| CLEC6A | 4065 | 27160 | 50255 |
| CLEC7A | 4066 | 27161 | 50256 |
| CLEC7A | 4067 | 27162 | 50257 |
| CLEC7A | 4068 | 27163 | 50258 |
| CLEC9A | 4069 | 27164 | 50259 |
| CLECL1 | 4070 | 27165 | 50260 |
| CLGN | 4071 | 27166 | 50261 |
| CLHC1 | 4072 | 27167 | 50262 |
| CLIC1 | 4073 | 27168 | 50263 |
| CLIC2 | 4074 | 27169 | 50264 |
| CLIC3 | 4075 | 27170 | 50265 |
| CLIC4 | 4076 | 27171 | 50266 |
| CLIC5 | 4077 | 27172 | 50267 |
| CLIC5 | 4078 | 27173 | 50268 |
| CLIC6 | 4079 | 27174 | 50269 |
| CLINT1 | 4080 | 27175 | 50270 |
| CLIP1 | 4081 | 27176 | 50271 |
| CLIP2 | 4082 | 27177 | 50272 |
| CLIP3 | 4083 | 27178 | 50273 |
| CLIP4 | 4084 | 27179 | 50274 |
| CLIP4 | 4085 | 27180 | 50275 |
| CLK1 | 4086 | 27181 | 50276 |
| CLK2 | 4087 | 27182 | 50277 |
| CLK3 | 4088 | 27183 | 50278 |
| CLK4 | 4089 | 27184 | 50279 |
| CLLU1OS | 4090 | 27185 | 50280 |
| CLMN | 4091 | 27186 | 50281 |
| CLMP | 4092 | 27187 | 50282 |
| CLN3 | 4093 | 27188 | 50283 |
| CLN5 | 4094 | 27189 | 50284 |
| CLN6 | 4095 | 27190 | 50285 |
| CLN8 | 4096 | 27191 | 50286 |
| CLNK | 4097 | 27192 | 50287 |
| CLNS1A | 4098 | 27193 | 50288 |
| CLOCK | 4099 | 27194 | 50289 |
| CLP1 | 4100 | 27195 | 50290 |
| CLPB | 4101 | 27196 | 50291 |
| CLPP | 4102 | 27197 | 50292 |
| CLPS | 4103 | 27198 | 50293 |
| CLPSL1 | 4104 | 27199 | 50294 |
| CLPSL1 | 4105 | 27200 | 50295 |
| CLPSL2 | 4106 | 27201 | 50296 |
| CLPSL2 | 4107 | 27202 | 50297 |
| CLPTM1 | 4108 | 27203 | 50298 |
| CLPTM1L | 4109 | 27204 | 50299 |
| CLPX | 4110 | 27205 | 50300 |
| CLRN1 | 4111 | 27206 | 50301 |
| CLRN1 | 4112 | 27207 | 50302 |
| CLRN1 | 4113 | 27208 | 50303 |
| CLRN2 | 4114 | 27209 | 50304 |
| CLRN3 | 4115 | 27210 | 50305 |
| CLSPN | 4116 | 27211 | 50306 |
| CLSPN | 4117 | 27212 | 50307 |
| CLSTN1 | 4118 | 27213 | 50308 |
| CLSTN2 | 4119 | 27214 | 50309 |
| CLSTN3 | 4120 | 27215 | 50310 |
| CLTA | 4121 | 27216 | 50311 |
| CLTA | 4122 | 27217 | 50312 |
| CLTB | 4123 | 27218 | 50313 |
| CLTC | 4124 | 27219 | 50314 |
| CLTCL1 | 4125 | 27220 | 50315 |
| CLU | 4126 | 27221 | 50316 |
| CLUAP1 | 4127 | 27222 | 50317 |
| CLUH | 4128 | 27223 | 50318 |
| CLUL1 | 4129 | 27224 | 50319 |
| CLVS1 | 4130 | 27225 | 50320 |
| CLVS2 | 4131 | 27226 | 50321 |
| CLYBL | 4132 | 27227 | 50322 |
| CMA1 | 4133 | 27228 | 50323 |
| CMAS | 4134 | 27229 | 50324 |
| CMBL | 4135 | 27230 | 50325 |
| CMC1 | 4136 | 27231 | 50326 |
| CMC2 | 4137 | 27232 | 50327 |
| CMC4 | 4138 | 27233 | 50328 |
| CMIP | 4139 | 27234 | 50329 |
| CMKLR1 | 4140 | 27235 | 50330 |
| CMPK1 | 4141 | 27236 | 50331 |
| CMPK2 | 4142 | 27237 | 50332 |
| CMPK2 | 4143 | 27238 | 50333 |
| CMPK2 | 4144 | 27239 | 50334 |
| CMSS1 | 4145 | 27240 | 50335 |
| CMTM1 | 4146 | 27241 | 50336 |
| CMTM1 | 4147 | 27242 | 50337 |
| CMTM2 | 4148 | 27243 | 50338 |
| CMTM3 | 4149 | 27244 | 50339 |
| CMTM4 | 4150 | 27245 | 50340 |
| CMTM4 | 4151 | 27246 | 50341 |
| CMTM5 | 4152 | 27247 | 50342 |
| CMTM6 | 4153 | 27248 | 50343 |
| CMTM7 | 4154 | 27249 | 50344 |
| CMTM8 | 4155 | 27250 | 50345 |
| CMTR1 | 4156 | 27251 | 50346 |
| CMTR2 | 4157 | 27252 | 50347 |
| CMYA5 | 4158 | 27253 | 50348 |
| CNBD1 | 4159 | 27254 | 50349 |
| CNBD2 | 4160 | 27255 | 50350 |
| CNBD2 | 4161 | 27256 | 50351 |
| CNBD2 | 4162 | 27257 | 50352 |
| CNBP | 4163 | 27258 | 50353 |
| CNDP1 | 4164 | 27259 | 50354 |
| CNDP2 | 4165 | 27260 | 50355 |
| CNEP1R1 | 4166 | 27261 | 50356 |
| CNFN | 4167 | 27262 | 50357 |
| CNGA1 | 4168 | 27263 | 50358 |
| CNGA2 | 4169 | 27264 | 50359 |
| CNGA3 | 4170 | 27265 | 50360 |
| CNGA4 | 4171 | 27266 | 50361 |
| CNGB1 | 4172 | 27267 | 50362 |
| CNGB1 | 4173 | 27268 | 50363 |
| CNGB3 | 4174 | 27269 | 50364 |
| CNIH1 | 4175 | 27270 | 50365 |
| CNIH2 | 4176 | 27271 | 50366 |
| CNIH3 | 4177 | 27272 | 50367 |
| CNIH4 | 4178 | 27273 | 50368 |
| CNIH4 | 4179 | 27274 | 50369 |
| CNIH4 | 4180 | 27275 | 50370 |
| CNKSR1 | 4181 | 27276 | 50371 |
| CNKSR2 | 4182 | 27277 | 50372 |
| CNKSR2 | 4183 | 27278 | 50373 |
| CNKSR3 | 4184 | 27279 | 50374 |
| CNMD | 4185 | 27280 | 50375 |
| CNN1 | 4186 | 27281 | 50376 |
| CNN2 | 4187 | 27282 | 50377 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| CNN3 | 4188 | 27283 | 50378 |
| CNNM1 | 4189 | 27284 | 50379 |
| CNNM2 | 4190 | 27285 | 50380 |
| CNNM2 | 4191 | 27286 | 50381 |
| CNNM3 | 4192 | 27287 | 50382 |
| CNNM4 | 4193 | 27288 | 50383 |
| CNOT1 | 4194 | 27289 | 50384 |
| CNOT1 | 4195 | 27290 | 50385 |
| CNOT10 | 4196 | 27291 | 50386 |
| CNOT11 | 4197 | 27292 | 50387 |
| CNOT2 | 4198 | 27293 | 50388 |
| CNOT3 | 4199 | 27294 | 50389 |
| CNOT4 | 4200 | 27295 | 50390 |
| CNOT4 | 4201 | 27296 | 50391 |
| CNOT6 | 4202 | 27297 | 50392 |
| CNOT6L | 4203 | 27298 | 50393 |
| CNOT7 | 4204 | 27299 | 50394 |
| CNOT7 | 4205 | 27300 | 50395 |
| CNOT8 | 4206 | 27301 | 50396 |
| CNOT9 | 4207 | 27302 | 50397 |
| CNOT9 | 4208 | 27303 | 50398 |
| CNP | 4209 | 27304 | 50399 |
| CNPPD1 | 4210 | 27305 | 50400 |
| CNPY1 | 4211 | 27306 | 50401 |
| CNPY2 | 4212 | 27307 | 50402 |
| CNPY2 | 4213 | 27308 | 50403 |
| CNPY3 | 4214 | 27309 | 50404 |
| CNPY3 | 4215 | 27310 | 50405 |
| CNPY3 | 4216 | 27311 | 50406 |
| CNPY4 | 4217 | 27312 | 50407 |
| CNR1 | 4218 | 27313 | 50408 |
| CNR2 | 4219 | 27314 | 50409 |
| CNRIP1 | 4220 | 27315 | 50410 |
| CNRIP1 | 4221 | 27316 | 50411 |
| CNST | 4222 | 27317 | 50412 |
| CNST | 4223 | 27318 | 50413 |
| CNTD1 | 4224 | 27319 | 50414 |
| CNTD2 | 4225 | 27320 | 50415 |
| CNTF | 4226 | 27321 | 50416 |
| CNTFR | 4227 | 27322 | 50417 |
| CNTLN | 4228 | 27323 | 50418 |
| CNTLN | 4229 | 27324 | 50419 |
| CNTLN | 4230 | 27325 | 50420 |
| CNTN1 | 4231 | 27326 | 50421 |
| CNTN1 | 4232 | 27327 | 50422 |
| CNTN2 | 4233 | 27328 | 50423 |
| CNTN3 | 4234 | 27329 | 50424 |
| CNTN4 | 4235 | 27330 | 50425 |
| CNTN5 | 4236 | 27331 | 50426 |
| CNTN5 | 4237 | 27332 | 50427 |
| CNTN6 | 4238 | 27333 | 50428 |
| CNTNAP1 | 4239 | 27334 | 50429 |
| CNTNAP2 | 4240 | 27335 | 50430 |
| CNTNAP3 | 4241 | 27336 | 50431 |
| CNTNAP4 | 4242 | 27337 | 50432 |
| CNTNAP5 | 4243 | 27338 | 50433 |
| CNTRL | 4244 | 27339 | 50434 |
| CNTROB | 4245 | 27340 | 50435 |
| CNTROB | 4246 | 27341 | 50436 |
| COA1 | 4247 | 27342 | 50437 |
| COA1 | 4248 | 27343 | 50438 |
| COA3 | 4249 | 27344 | 50439 |
| COA4 | 4250 | 27345 | 50440 |
| COA5 | 4251 | 27346 | 50441 |
| COA6 | 4252 | 27347 | 50442 |
| COA7 | 4253 | 27348 | 50443 |
| COASY | 4254 | 27349 | 50444 |
| COBL | 4255 | 27350 | 50445 |
| COBL | 4256 | 27351 | 50446 |
| COBL | 4257 | 27352 | 50447 |
| COBLL1 | 4258 | 27353 | 50448 |
| COCH | 4259 | 27354 | 50449 |
| COG1 | 4260 | 27355 | 50450 |
| COG2 | 4261 | 27356 | 50451 |
| COG3 | 4262 | 27357 | 50452 |
| COG4 | 4263 | 27358 | 50453 |
| COG5 | 4264 | 27359 | 50454 |
| COG5 | 4265 | 27360 | 50455 |
| COG6 | 4266 | 27361 | 50456 |
| COG6 | 4267 | 27362 | 50457 |
| COG7 | 4268 | 27363 | 50458 |
| COG8 | 4269 | 27364 | 50459 |
| COIL | 4270 | 27365 | 50460 |
| COL10A1 | 4271 | 27366 | 50461 |
| COL11A1 | 4272 | 27367 | 50462 |
| COL11A2 | 4273 | 27368 | 50463 |
| COL11A2 | 4274 | 27369 | 50464 |
| COL12A1 | 4275 | 27370 | 50465 |
| COL13A1 | 4276 | 27371 | 50466 |
| COL14A1 | 4277 | 27372 | 50467 |
| COL15A1 | 4278 | 27373 | 50468 |
| COL16A1 | 4279 | 27374 | 50469 |
| COL17A1 | 4280 | 27375 | 50470 |
| COL18A1 | 4281 | 27376 | 50471 |
| COL19A1 | 4282 | 27377 | 50472 |
| COL1A1 | 4283 | 27378 | 50473 |
| COL1A2 | 4284 | 27379 | 50474 |
| COL20A1 | 4285 | 27380 | 50475 |
| COL21A1 | 4286 | 27381 | 50476 |
| COL22A1 | 4287 | 27382 | 50477 |
| COL23A1 | 4288 | 27383 | 50478 |
| COL24A1 | 4289 | 27384 | 50479 |
| COL25A1 | 4290 | 27385 | 50480 |
| COL25A1 | 4291 | 27386 | 50481 |
| COL26A1 | 4292 | 27387 | 50482 |
| COL27A1 | 4293 | 27388 | 50483 |
| COL28A1 | 4294 | 27389 | 50484 |
| COL2A1 | 4295 | 27390 | 50485 |
| COL3A1 | 4296 | 27391 | 50486 |
| COL4A1 | 4297 | 27392 | 50487 |
| COL4A1 | 4298 | 27393 | 50488 |
| COL4A2 | 4299 | 27394 | 50489 |
| COL4A2-AS2 | 4300 | 27395 | 50490 |
| COL4A3 | 4301 | 27396 | 50491 |
| COL4A3BP | 4302 | 27397 | 50492 |
| COL4A4 | 4303 | 27398 | 50493 |
| COL4A5 | 4304 | 27399 | 50494 |
| COL4A6 | 4305 | 27400 | 50495 |
| COL5A1 | 4306 | 27401 | 50496 |
| COL5A2 | 4307 | 27402 | 50497 |
| COL5A3 | 4308 | 27403 | 50498 |
| COL6A1 | 4309 | 27404 | 50499 |
| COL6A2 | 4310 | 27405 | 50500 |
| COL6A2 | 4311 | 27406 | 50501 |
| COL6A2 | 4312 | 27407 | 50502 |
| COL6A3 | 4313 | 27408 | 50503 |
| COL6A3 | 4314 | 27409 | 50504 |
| COL6A5 | 4315 | 27410 | 50505 |
| COL6A5 | 4316 | 27411 | 50506 |
| COL6A6 | 4317 | 27412 | 50507 |
| COL7A1 | 4318 | 27413 | 50508 |
| COL8A1 | 4319 | 27414 | 50509 |
| COL8A2 | 4320 | 27415 | 50510 |
| COL9A1 | 4321 | 27416 | 50511 |
| COL9A2 | 4322 | 27417 | 50512 |
| COL9A3 | 4323 | 27418 | 50513 |
| COLCA1 | 4324 | 27419 | 50514 |
| COLCA2 | 4325 | 27420 | 50515 |
| COLEC10 | 4326 | 27421 | 50516 |
| COLEC11 | 4327 | 27422 | 50517 |
| COLEC12 | 4328 | 27423 | 50518 |
| COLGALT1 | 4329 | 27424 | 50519 |
| COLGALT2 | 4330 | 27425 | 50520 |
| COLGALT2 | 4331 | 27426 | 50521 |
| COLQ | 4332 | 27427 | 50522 |
| COMMD1 | 4333 | 27428 | 50523 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| COMMD10 | 4334 | 27429 | 50524 |
| COMMD2 | 4335 | 27430 | 50525 |
| COMMD3 | 4336 | 27431 | 50526 |
| COMMD4 | 4337 | 27432 | 50527 |
| COMMD5 | 4338 | 27433 | 50528 |
| COMMD6 | 4339 | 27434 | 50529 |
| COMMD7 | 4340 | 27435 | 50530 |
| COMMD8 | 4341 | 27436 | 50531 |
| COMMD9 | 4342 | 27437 | 50532 |
| COMP | 4343 | 27438 | 50533 |
| COMT | 4344 | 27439 | 50534 |
| COMTD1 | 4345 | 27440 | 50535 |
| COPA | 4346 | 27441 | 50536 |
| COPB1 | 4347 | 27442 | 50537 |
| COPB2 | 4348 | 27443 | 50538 |
| COPE | 4349 | 27444 | 50539 |
| COPG1 | 4350 | 27445 | 50540 |
| COPG2 | 4351 | 27446 | 50541 |
| COPG2 | 4352 | 27447 | 50542 |
| COPRS | 4353 | 27448 | 50543 |
| COPS2 | 4354 | 27449 | 50544 |
| COPS3 | 4355 | 27450 | 50545 |
| COPS4 | 4356 | 27451 | 50546 |
| COPS4 | 4357 | 27452 | 50547 |
| COPS4 | 4358 | 27453 | 50548 |
| COPS5 | 4359 | 27454 | 50549 |
| COPS6 | 4360 | 27455 | 50550 |
| COPS7A | 4361 | 27456 | 50551 |
| COPS7B | 4362 | 27457 | 50552 |
| COPS7B | 4363 | 27458 | 50553 |
| COPS8 | 4364 | 27459 | 50554 |
| COPS9 | 4365 | 27460 | 50555 |
| COPS9 | 4366 | 27461 | 50556 |
| COPZ1 | 4367 | 27462 | 50557 |
| COPZ2 | 4368 | 27463 | 50558 |
| COQ10A | 4369 | 27464 | 50559 |
| COQ10B | 4370 | 27465 | 50560 |
| COQ2 | 4371 | 27466 | 50561 |
| COQ3 | 4372 | 27467 | 50562 |
| COQ4 | 4373 | 27468 | 50563 |
| COQ4 | 4374 | 27469 | 50564 |
| COQ5 | 4375 | 27470 | 50565 |
| COQ6 | 4376 | 27471 | 50566 |
| COQ7 | 4377 | 27472 | 50567 |
| COQ8A | 4378 | 27473 | 50568 |
| COQ8B | 4379 | 27474 | 50569 |
| COQ9 | 4380 | 27475 | 50570 |
| CORIN | 4381 | 27476 | 50571 |
| CORIN | 4382 | 27477 | 50572 |
| CORO1A | 4383 | 27478 | 50573 |
| CORO1B | 4384 | 27479 | 50574 |
| CORO1C | 4385 | 27480 | 50575 |
| CORO2A | 4386 | 27481 | 50576 |
| CORO2B | 4387 | 27482 | 50577 |
| CORO6 | 4388 | 27483 | 50578 |
| CORO7 | 4389 | 27484 | 50579 |
| CORT | 4390 | 27485 | 50580 |
| COTL1 | 4391 | 27486 | 50581 |
| COX10 | 4392 | 27487 | 50582 |
| COX11 | 4393 | 27488 | 50583 |
| COX11 | 4394 | 27489 | 50584 |
| COX11 | 4395 | 27490 | 50585 |
| COX11 | 4396 | 27491 | 50586 |
| COX14 | 4397 | 27492 | 50587 |
| COX14 | 4398 | 27493 | 50588 |
| COX15 | 4399 | 27494 | 50589 |
| COX15 | 4400 | 27495 | 50590 |
| COX15 | 4401 | 27496 | 50591 |
| COX15 | 4402 | 27497 | 50592 |
| COX16 | 4403 | 27498 | 50593 |
| COX17 | 4404 | 27499 | 50594 |
| COX18 | 4405 | 27500 | 50595 |
| COX19 | 4406 | 27501 | 50596 |
| COX20 | 4407 | 27502 | 50597 |
| COX20 | 4408 | 27503 | 50598 |
| COX4I1 | 4409 | 27504 | 50599 |
| COX4I1 | 4410 | 27505 | 50600 |
| COX4I1 | 4411 | 27506 | 50601 |
| COX4I1 | 4412 | 27507 | 50602 |
| COX4I2 | 4413 | 27508 | 50603 |
| COX5A | 4414 | 27509 | 50604 |
| COX5B | 4415 | 27510 | 50605 |
| COX6A1 | 4416 | 27511 | 50606 |
| COX6A2 | 4417 | 27512 | 50607 |
| COX6B1 | 4418 | 27513 | 50608 |
| COX6B2 | 4419 | 27514 | 50609 |
| COX6C | 4420 | 27515 | 50610 |
| COX7A1 | 4421 | 27516 | 50611 |
| COX7A2 | 4422 | 27517 | 50612 |
| COX7A2L | 4423 | 27518 | 50613 |
| COX7A2L | 4424 | 27519 | 50614 |
| COX7A2L | 4425 | 27520 | 50615 |
| COX7B | 4426 | 27521 | 50616 |
| COX7B2 | 4427 | 27522 | 50617 |
| COX7C | 4428 | 27523 | 50618 |
| COX8A | 4429 | 27524 | 50619 |
| COX8C | 4430 | 27525 | 50620 |
| CP | 4431 | 27526 | 50621 |
| CPA1 | 4432 | 27527 | 50622 |
| CPA2 | 4433 | 27528 | 50623 |
| CPA3 | 4434 | 27529 | 50624 |
| CPA4 | 4435 | 27530 | 50625 |
| CPA5 | 4436 | 27531 | 50626 |
| CPA5 | 4437 | 27532 | 50627 |
| CPA6 | 4438 | 27533 | 50628 |
| CPAMD8 | 4439 | 27534 | 50629 |
| CPB1 | 4440 | 27535 | 50630 |
| CPB2 | 4441 | 27536 | 50631 |
| CPD | 4442 | 27537 | 50632 |
| CPE | 4443 | 27538 | 50633 |
| CPEB1 | 4444 | 27539 | 50634 |
| CPEB2 | 4445 | 27540 | 50635 |
| CPEB3 | 4446 | 27541 | 50636 |
| CPEB4 | 4447 | 27542 | 50637 |
| CPED1 | 4448 | 27543 | 50638 |
| CPED1 | 4449 | 27544 | 50639 |
| CPLX1 | 4450 | 27545 | 50640 |
| CPLX2 | 4451 | 27546 | 50641 |
| CPLX3 | 4452 | 27547 | 50642 |
| CPLX4 | 4453 | 27548 | 50643 |
| CPM | 4454 | 27549 | 50644 |
| CPN1 | 4455 | 27550 | 50645 |
| CPN2 | 4456 | 27551 | 50646 |
| CPNE1 | 4457 | 27552 | 50647 |
| CPNE2 | 4458 | 27553 | 50648 |
| CPNE3 | 4459 | 27554 | 50649 |
| CPNE4 | 4460 | 27555 | 50650 |
| CPNE5 | 4461 | 27556 | 50651 |
| CPNE5 | 4462 | 27557 | 50652 |
| CPNE6 | 4463 | 27558 | 50653 |
| CPNE7 | 4464 | 27559 | 50654 |
| CPNE8 | 4465 | 27560 | 50655 |
| CPNE9 | 4466 | 27561 | 50656 |
| CPNE9 | 4467 | 27562 | 50657 |
| CPO | 4468 | 27563 | 50658 |
| CPOX | 4469 | 27564 | 50659 |
| CPPED1 | 4470 | 27565 | 50660 |
| CPQ | 4471 | 27566 | 50661 |
| CPS1 | 4472 | 27567 | 50662 |
| CPSF1 | 4473 | 27568 | 50663 |
| CPSF2 | 4474 | 27569 | 50664 |
| CPSF3 | 4475 | 27570 | 50665 |
| CPSF4 | 4476 | 27571 | 50666 |
| CPSF4 | 4477 | 27572 | 50667 |
| CPSF4L | 4478 | 27573 | 50668 |
| CPSF6 | 4479 | 27574 | 50669 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| CPSF7 | 4480 | 27575 | 50670 |
| CPT1A | 4481 | 27576 | 50671 |
| CPT1A | 4482 | 27577 | 50672 |
| CPT1B | 4483 | 27578 | 50673 |
| CPT1B | 4484 | 27579 | 50674 |
| CPT1C | 4485 | 27580 | 50675 |
| CPT2 | 4486 | 27581 | 50676 |
| CPTP | 4487 | 27582 | 50677 |
| CPVL | 4488 | 27583 | 50678 |
| CPXCR1 | 4489 | 27584 | 50679 |
| CPXM1 | 4490 | 27585 | 50680 |
| CPXM2 | 4491 | 27586 | 50681 |
| CPZ | 4492 | 27587 | 50682 |
| CR1 | 4493 | 27588 | 50683 |
| CR1L | 4494 | 27589 | 50684 |
| CR2 | 4495 | 27590 | 50685 |
| CRABP1 | 4496 | 27591 | 50686 |
| CRABP2 | 4497 | 27592 | 50687 |
| CRACR2A | 4498 | 27593 | 50688 |
| CRACR2A | 4499 | 27594 | 50689 |
| CRACR2B | 4500 | 27595 | 50690 |
| CRACR2B | 4501 | 27596 | 50691 |
| CRADD | 4502 | 27597 | 50692 |
| CRADD | 4503 | 27598 | 50693 |
| CRADD | 4504 | 27599 | 50694 |
| CRADD | 4505 | 27600 | 50695 |
| CRAMP1 | 4506 | 27601 | 50696 |
| CRAT | 4507 | 27602 | 50697 |
| CRB1 | 4508 | 27603 | 50698 |
| CRB2 | 4509 | 27604 | 50699 |
| CRB3 | 4510 | 27605 | 50700 |
| CRB3 | 4511 | 27606 | 50701 |
| CRBN | 4512 | 27607 | 50702 |
| CRCP | 4513 | 27608 | 50703 |
| CRCP | 4514 | 27609 | 50704 |
| CRCT1 | 4515 | 27610 | 50705 |
| CREB1 | 4516 | 27611 | 50706 |
| CREB1 | 4517 | 27612 | 50707 |
| CREB3 | 4518 | 27613 | 50708 |
| CREB3L1 | 4519 | 27614 | 50709 |
| CREB3L2 | 4520 | 27615 | 50710 |
| CREB3L2 | 4521 | 27616 | 50711 |
| CREB3L3 | 4522 | 27617 | 50712 |
| CREB3L3 | 4523 | 27618 | 50713 |
| CREB3L4 | 4524 | 27619 | 50714 |
| CREB5 | 4525 | 27620 | 50715 |
| CREBBP | 4526 | 27621 | 50716 |
| CREBL2 | 4527 | 27622 | 50717 |
| CREBRF | 4528 | 27623 | 50718 |
| CREBRF | 4529 | 27624 | 50719 |
| CREBZF | 4530 | 27625 | 50720 |
| CREG1 | 4531 | 27626 | 50721 |
| CREG2 | 4532 | 27627 | 50722 |
| CRELD1 | 4533 | 27628 | 50723 |
| CRELD1 | 4534 | 27629 | 50724 |
| CRELD2 | 4535 | 27630 | 50725 |
| CREM | 4536 | 27631 | 50726 |
| CREM | 4537 | 27632 | 50727 |
| CREM | 4538 | 27633 | 50728 |
| CREM | 4539 | 27634 | 50729 |
| CRH | 4540 | 27635 | 50730 |
| CRHBP | 4541 | 27636 | 50731 |
| CRHR1 | 4542 | 27637 | 50732 |
| CRHR2 | 4543 | 27638 | 50733 |
| CRHR2 | 4544 | 27639 | 50734 |
| CRIM1 | 4545 | 27640 | 50735 |
| CRIP1 | 4546 | 27641 | 50736 |
| CRIP2 | 4547 | 27642 | 50737 |
| CRIP3 | 4548 | 27643 | 50738 |
| CRIPAK | 4549 | 27644 | 50739 |
| CRIPT | 4550 | 27645 | 50740 |
| CRISP1 | 4551 | 27646 | 50741 |
| CRISP1 | 4552 | 27647 | 50742 |
| CRISP2 | 4553 | 27648 | 50743 |
| CRISP3 | 4554 | 27649 | 50744 |
| CRISPLD1 | 4555 | 27650 | 50745 |
| CRISPLD2 | 4556 | 27651 | 50746 |
| CRK | 4557 | 27652 | 50747 |
| CRK | 4558 | 27653 | 50748 |
| CRKL | 4559 | 27654 | 50749 |
| CRLF1 | 4560 | 27655 | 50750 |
| CRLF2 | 4561 | 27656 | 50751 |
| CRLF3 | 4562 | 27657 | 50752 |
| CRLS1 | 4563 | 27658 | 50753 |
| CRMP1 | 4564 | 27659 | 50754 |
| CRNDE | 4565 | 27660 | 50755 |
| CRNKL1 | 4566 | 27661 | 50756 |
| CRNN | 4567 | 27662 | 50757 |
| CROCC | 4568 | 27663 | 50758 |
| CROCC2 | 4569 | 27664 | 50759 |
| CROT | 4570 | 27665 | 50760 |
| CROT | 4571 | 27666 | 50761 |
| CRP | 4572 | 27667 | 50762 |
| CRTAC1 | 4573 | 27668 | 50763 |
| CRTAC1 | 4574 | 27669 | 50764 |
| CRTAM | 4575 | 27670 | 50765 |
| CRTAP | 4576 | 27671 | 50766 |
| CRTC1 | 4577 | 27672 | 50767 |
| CRTC2 | 4578 | 27673 | 50768 |
| CRTC3 | 4579 | 27674 | 50769 |
| CRX | 4580 | 27675 | 50770 |
| CRY1 | 4581 | 27676 | 50771 |
| CRY2 | 4582 | 27677 | 50772 |
| CRYAB | 4583 | 27678 | 50773 |
| CRYBA1 | 4584 | 27679 | 50774 |
| CRYBA2 | 4585 | 27680 | 50775 |
| CRYBA4 | 4586 | 27681 | 50776 |
| CRYBB1 | 4587 | 27682 | 50777 |
| CRYBB2 | 4588 | 27683 | 50778 |
| CRYBB3 | 4589 | 27684 | 50779 |
| CRYBG1 | 4590 | 27685 | 50780 |
| CRYBG2 | 4591 | 27686 | 50781 |
| CRYBG3 | 4592 | 27687 | 50782 |
| CRYGA | 4593 | 27688 | 50783 |
| CRYGB | 4594 | 27689 | 50784 |
| CRYGC | 4595 | 27690 | 50785 |
| CRYGD | 4596 | 27691 | 50786 |
| CRYGN | 4597 | 27692 | 50787 |
| CRYGN | 4598 | 27693 | 50788 |
| CRYGS | 4599 | 27694 | 50789 |
| CRYL1 | 4600 | 27695 | 50790 |
| CRYM | 4601 | 27696 | 50791 |
| CRYZ | 4602 | 27697 | 50792 |
| CRYZL1 | 4603 | 27698 | 50793 |
| CS | 4604 | 27699 | 50794 |
| CSAD | 4605 | 27700 | 50795 |
| CSAG3 | 4606 | 27701 | 50796 |
| CSDC2 | 4607 | 27702 | 50797 |
| CSDE1 | 4608 | 27703 | 50798 |
| CSE1L | 4609 | 27704 | 50799 |
| CSF1 | 4610 | 27705 | 50800 |
| CSF1R | 4611 | 27706 | 50801 |
| CSF2 | 4612 | 27707 | 50802 |
| CSF2RA | 4613 | 27708 | 50803 |
| CSF2RA | 4614 | 27709 | 50804 |
| CSF2RA | 4615 | 27710 | 50805 |
| CSF2RA | 4616 | 27711 | 50806 |
| CSF2RB | 4617 | 27712 | 50807 |
| CSF3 | 4618 | 27713 | 50808 |
| CSF3R | 4619 | 27714 | 50809 |
| CSF3R | 4620 | 27715 | 50810 |
| CSGALNACT1 | 4621 | 27716 | 50811 |
| CSGALNACT2 | 4622 | 27717 | 50812 |
| CSGALNACT2 | 4623 | 27718 | 50813 |
| CSGALNACT2 | 4624 | 27719 | 50814 |
| CSH1 | 4625 | 27720 | 50815 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| CSH2 | 4626 | 27721 | 50816 |
| CSH2 | 4627 | 27722 | 50817 |
| CSHL1 | 4628 | 27723 | 50818 |
| CSK | 4629 | 27724 | 50819 |
| CSMD1 | 4630 | 27725 | 50820 |
| CSMD2 | 4631 | 27726 | 50821 |
| CSMD3 | 4632 | 27727 | 50822 |
| CSN1S1 | 4633 | 27728 | 50823 |
| CSN2 | 4634 | 27729 | 50824 |
| CSN3 | 4635 | 27730 | 50825 |
| CSNK1A1 | 4636 | 27731 | 50826 |
| CSNK1A1 | 4637 | 27732 | 50827 |
| CSNK1A1L | 4638 | 27733 | 50828 |
| CSNK1D | 4639 | 27734 | 50829 |
| CSNK1D | 4640 | 27735 | 50830 |
| CSNK1E | 4641 | 27736 | 50831 |
| CSNK1G1 | 4642 | 27737 | 50832 |
| CSNK1G1 | 4643 | 27738 | 50833 |
| CSNK1G2 | 4644 | 27739 | 50834 |
| CSNK1G3 | 4645 | 27740 | 50835 |
| CSNK2A1 | 4646 | 27741 | 50836 |
| CSNK2A2 | 4647 | 27742 | 50837 |
| CSNK2A3 | 4648 | 27743 | 50838 |
| CSNK2B | 4649 | 27744 | 50839 |
| CSPG4 | 4650 | 27745 | 50840 |
| CSPG5 | 4651 | 27746 | 50841 |
| CSPG5 | 4652 | 27747 | 50842 |
| CSPP1 | 4653 | 27748 | 50843 |
| CSRNP1 | 4654 | 27749 | 50844 |
| CSRNP2 | 4655 | 27750 | 50845 |
| CSRNP3 | 4656 | 27751 | 50846 |
| CSRP1 | 4657 | 27752 | 50847 |
| CSRP1 | 4658 | 27753 | 50848 |
| CSRP2 | 4659 | 27754 | 50849 |
| CSRP3 | 4660 | 27755 | 50850 |
| CST1 | 4661 | 27756 | 50851 |
| CST11 | 4662 | 27757 | 50852 |
| CST2 | 4663 | 27758 | 50853 |
| CST3 | 4664 | 27759 | 50854 |
| CST4 | 4665 | 27760 | 50855 |
| CST5 | 4666 | 27761 | 50856 |
| CST6 | 4667 | 27762 | 50857 |
| CST7 | 4668 | 27763 | 50858 |
| CST8 | 4669 | 27764 | 50859 |
| CST9 | 4670 | 27765 | 50860 |
| CST9L | 4671 | 27766 | 50861 |
| CSTA | 4672 | 27767 | 50862 |
| CSTB | 4673 | 27768 | 50863 |
| CSTF1 | 4674 | 27769 | 50864 |
| CSTF2 | 4675 | 27770 | 50865 |
| CSTF2T | 4676 | 27771 | 50866 |
| CSTF3 | 4677 | 27772 | 50867 |
| CSTF3 | 4678 | 27773 | 50868 |
| CSTF3 | 4679 | 27774 | 50869 |
| CSTL1 | 4680 | 27775 | 50870 |
| CT45A3 | 4681 | 27776 | 50871 |
| CT47A1 | 4682 | 27777 | 50872 |
| CT47B1 | 4683 | 27778 | 50873 |
| CT55 | 4684 | 27779 | 50874 |
| CT55 | 4685 | 27780 | 50875 |
| CT62 | 4686 | 27781 | 50876 |
| CT83 | 4687 | 27782 | 50877 |
| CTAG1B | 4688 | 27783 | 50878 |
| CTAG2 | 4689 | 27784 | 50879 |
| CTAG2 | 4690 | 27785 | 50880 |
| CTAGE1 | 4691 | 27786 | 50881 |
| CTAGE15 | 4692 | 27787 | 50882 |
| CTAGE8 | 4693 | 27788 | 50883 |
| CTBP1 | 4694 | 27789 | 50884 |
| CTBP2 | 4695 | 27790 | 50885 |
| CTBS | 4696 | 27791 | 50886 |
| CTC1 | 4697 | 27792 | 50887 |
| CTCF | 4698 | 27793 | 50888 |
| CTCFL | 4699 | 27794 | 50889 |
| CTCFL | 4700 | 27795 | 50890 |
| CTCFL | 4701 | 27796 | 50891 |
| CTCFL | 4702 | 27797 | 50892 |
| CTCFL | 4703 | 27798 | 50893 |
| CTCFL | 4704 | 27799 | 50894 |
| CTCFL | 4705 | 27800 | 50895 |
| CTDNEP1 | 4706 | 27801 | 50896 |
| CTDP1 | 4707 | 27802 | 50897 |
| CTDP1 | 4708 | 27803 | 50898 |
| CTDP1 | 4709 | 27804 | 50899 |
| CTDSP1 | 4710 | 27805 | 50900 |
| CTDSP2 | 4711 | 27806 | 50901 |
| CTDSPL | 4712 | 27807 | 50902 |
| CTDSPL2 | 4713 | 27808 | 50903 |
| CTF1 | 4714 | 27809 | 50904 |
| CTGF | 4715 | 27810 | 50905 |
| CTH | 4716 | 27811 | 50906 |
| CTHRC1 | 4717 | 27812 | 50907 |
| CTIF | 4718 | 27813 | 50908 |
| CTLA4 | 4719 | 27814 | 50909 |
| CTNNA1 | 4720 | 27815 | 50910 |
| CTNNA1 | 4721 | 27816 | 50911 |
| CTNNA2 | 4722 | 27817 | 50912 |
| CTNNA3 | 4723 | 27818 | 50913 |
| CTNNA3 | 4724 | 27819 | 50914 |
| CTNNAL1 | 4725 | 27820 | 50915 |
| CTNNAL1 | 4726 | 27821 | 50916 |
| CTNNB1 | 4727 | 27822 | 50917 |
| CTNNBIP1 | 4728 | 27823 | 50918 |
| CTNNBL1 | 4729 | 27824 | 50919 |
| CTNND1 | 4730 | 27825 | 50920 |
| CTNND1 | 4731 | 27826 | 50921 |
| CTNND2 | 4732 | 27827 | 50922 |
| CTNS | 4733 | 27828 | 50923 |
| CTNS | 4734 | 27829 | 50924 |
| CTPS1 | 4735 | 27830 | 50925 |
| CTPS2 | 4736 | 27831 | 50926 |
| CTR9 | 4737 | 27832 | 50927 |
| CTRB1 | 4738 | 27833 | 50928 |
| CTRB1 | 4739 | 27834 | 50929 |
| CTRB2 | 4740 | 27835 | 50930 |
| CTRC | 4741 | 27836 | 50931 |
| CTRL | 4742 | 27837 | 50932 |
| CTSA | 4743 | 27838 | 50933 |
| CTSB | 4744 | 27839 | 50934 |
| CTSC | 4745 | 27840 | 50935 |
| CTSC | 4746 | 27841 | 50936 |
| CTSC | 4747 | 27842 | 50937 |
| CTSD | 4748 | 27843 | 50938 |
| CTSE | 4749 | 27844 | 50939 |
| CTSE | 4750 | 27845 | 50940 |
| CTSF | 4751 | 27846 | 50941 |
| CTSG | 4752 | 27847 | 50942 |
| CTSH | 4753 | 27848 | 50943 |
| CTSK | 4754 | 27849 | 50944 |
| CTSL | 4755 | 27850 | 50945 |
| CTSO | 4756 | 27851 | 50946 |
| CTSS | 4757 | 27852 | 50947 |
| CTSV | 4758 | 27853 | 50948 |
| CTSW | 4759 | 27854 | 50949 |
| CTSZ | 4760 | 27855 | 50950 |
| CTTN | 4761 | 27856 | 50951 |
| CTTN | 4762 | 27857 | 50952 |
| CTTNBP2 | 4763 | 27858 | 50953 |
| CTTNBP2NL | 4764 | 27859 | 50954 |
| CTU1 | 4765 | 27860 | 50955 |
| CTU2 | 4766 | 27861 | 50956 |
| CTU2 | 4767 | 27862 | 50957 |
| CTXN1 | 4768 | 27863 | 50958 |
| CTXN2 | 4769 | 27864 | 50959 |
| CTXN3 | 4770 | 27865 | 50960 |
| CTXND1 | 4771 | 27866 | 50961 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| CUBN | 4772 | 27867 | 50962 |
| CUEDC1 | 4773 | 27868 | 50963 |
| CUEDC2 | 4774 | 27869 | 50964 |
| CUL1 | 4775 | 27870 | 50965 |
| CUL2 | 4776 | 27871 | 50966 |
| CUL3 | 4777 | 27872 | 50967 |
| CUL4A | 4778 | 27873 | 50968 |
| CUL4B | 4779 | 27874 | 50969 |
| CUL5 | 4780 | 27875 | 50970 |
| CUL7 | 4781 | 27876 | 50971 |
| CUL9 | 4782 | 27877 | 50972 |
| CUTA | 4783 | 27878 | 50973 |
| CUTC | 4784 | 27879 | 50974 |
| CUX1 | 4785 | 27880 | 50975 |
| CUX1 | 4786 | 27881 | 50976 |
| CUX2 | 4787 | 27882 | 50977 |
| CUZD1 | 4788 | 27883 | 50978 |
| CWC15 | 4789 | 27884 | 50979 |
| CWC22 | 4790 | 27885 | 50980 |
| CWC25 | 4791 | 27886 | 50981 |
| CWC27 | 4792 | 27887 | 50982 |
| CWC27 | 4793 | 27888 | 50983 |
| CWC27 | 4794 | 27889 | 50984 |
| CWC27 | 4795 | 27890 | 50985 |
| CWF19L1 | 4796 | 27891 | 50986 |
| CWF19L2 | 4797 | 27892 | 50987 |
| CWH43 | 4798 | 27893 | 50988 |
| CX3CL1 | 4799 | 27894 | 50989 |
| CX3CR1 | 4800 | 27895 | 50990 |
| CXADR | 4801 | 27896 | 50991 |
| CXADR | 4802 | 27897 | 50992 |
| CXADR | 4803 | 27898 | 50993 |
| CXADR | 4804 | 27899 | 50994 |
| CXCL1 | 4805 | 27900 | 50995 |
| CXCL10 | 4806 | 27901 | 50996 |
| CXCL11 | 4807 | 27902 | 50997 |
| CXCL11 | 4808 | 27903 | 50998 |
| CXCL12 | 4809 | 27904 | 50999 |
| CXCL12 | 4810 | 27905 | 51000 |
| CXCL12 | 4811 | 27906 | 51001 |
| CXCL12 | 4812 | 27907 | 51002 |
| CXCL12 | 4813 | 27908 | 51003 |
| CXCL13 | 4814 | 27909 | 51004 |
| CXCL14 | 4815 | 27910 | 51005 |
| CXCL16 | 4816 | 27911 | 51006 |
| CXCL17 | 4817 | 27912 | 51007 |
| CXCL2 | 4818 | 27913 | 51008 |
| CXCL3 | 4819 | 27914 | 51009 |
| CXCL5 | 4820 | 27915 | 51010 |
| CXCL8 | 4821 | 27916 | 51011 |
| CXCL9 | 4822 | 27917 | 51012 |
| CXCR1 | 4823 | 27918 | 51013 |
| CXCR2 | 4824 | 27919 | 51014 |
| CXCR3 | 4825 | 27920 | 51015 |
| CXCR4 | 4826 | 27921 | 51016 |
| CXCR5 | 4827 | 27922 | 51017 |
| CXCR6 | 4828 | 27923 | 51018 |
| CXorf21 | 4829 | 27924 | 51019 |
| CXorf36 | 4830 | 27925 | 51020 |
| CXorf36 | 4831 | 27926 | 51021 |
| CXorf38 | 4832 | 27927 | 51022 |
| CXorf38 | 4833 | 27928 | 51023 |
| CXorf40A | 4834 | 27929 | 51024 |
| CXorf40A | 4835 | 27930 | 51025 |
| CXorf40A | 4836 | 27931 | 51026 |
| CXorf49 | 4837 | 27932 | 51027 |
| CXorf51A | 4838 | 27933 | 51028 |
| CXorf56 | 4839 | 27934 | 51029 |
| CXorf57 | 4840 | 27935 | 51030 |
| CXorf58 | 4841 | 27936 | 51031 |
| CXorf65 | 4842 | 27937 | 51032 |
| CXorf66 | 4843 | 27938 | 51033 |
| CXorf67 | 4844 | 27939 | 51034 |
| CXXC1 | 4845 | 27940 | 51035 |
| CXXC4 | 4846 | 27941 | 51036 |
| CXXC5 | 4847 | 27942 | 51037 |
| CYB561 | 4848 | 27943 | 51038 |
| CYB561A3 | 4849 | 27944 | 51039 |
| CYB561A3 | 4850 | 27945 | 51040 |
| CYB561D1 | 4851 | 27946 | 51041 |
| CYB561D2 | 4852 | 27947 | 51042 |
| CYB5A | 4853 | 27948 | 51043 |
| CYB5A | 4854 | 27949 | 51044 |
| CYB5B | 4855 | 27950 | 51045 |
| CYB5D1 | 4856 | 27951 | 51046 |
| CYB5D1 | 4857 | 27952 | 51047 |
| CYB5D2 | 4858 | 27953 | 51048 |
| CYB5R1 | 4859 | 27954 | 51049 |
| CYB5R2 | 4860 | 27955 | 51050 |
| CYB5R2 | 4861 | 27956 | 51051 |
| CYB5R3 | 4862 | 27957 | 51052 |
| CYB5R4 | 4863 | 27958 | 51053 |
| CYB5RL | 4864 | 27959 | 51054 |
| CYB5RL | 4865 | 27960 | 51055 |
| CYBA | 4866 | 27961 | 51056 |
| CYBB | 4867 | 27962 | 51057 |
| CYBRD1 | 4868 | 27963 | 51058 |
| CYBRD1 | 4869 | 27964 | 51059 |
| CYC1 | 4870 | 27965 | 51060 |
| CYCS | 4871 | 27966 | 51061 |
| CYFIP1 | 4872 | 27967 | 51062 |
| CYFIP2 | 4873 | 27968 | 51063 |
| CYGB | 4874 | 27969 | 51064 |
| CYHR1 | 4875 | 27970 | 51065 |
| CYHR1 | 4876 | 27971 | 51066 |
| CYLC1 | 4877 | 27972 | 51067 |
| CYLC2 | 4878 | 27973 | 51068 |
| CYLD | 4879 | 27974 | 51069 |
| CYP11A1 | 4880 | 27975 | 51070 |
| CYP11B1 | 4881 | 27976 | 51071 |
| CYP11B2 | 4882 | 27977 | 51072 |
| CYP17A1 | 4883 | 27978 | 51073 |
| CYP19A1 | 4884 | 27979 | 51074 |
| CYP1A1 | 4885 | 27980 | 51075 |
| CYP1A2 | 4886 | 27981 | 51076 |
| CYP1B1 | 4887 | 27982 | 51077 |
| CYP20A1 | 4888 | 27983 | 51078 |
| CYP21A2 | 4889 | 27984 | 51079 |
| CYP24A1 | 4890 | 27985 | 51080 |
| CYP26A1 | 4891 | 27986 | 51081 |
| CYP26B1 | 4892 | 27987 | 51082 |
| CYP26C1 | 4893 | 27988 | 51083 |
| CYP27A1 | 4894 | 27989 | 51084 |
| CYP27B1 | 4895 | 27990 | 51085 |
| CYP27C1 | 4896 | 27991 | 51086 |
| CYP2A13 | 4897 | 27992 | 51087 |
| CYP2A7 | 4898 | 27993 | 51088 |
| CYP2B6 | 4899 | 27994 | 51089 |
| CYP2C18 | 4900 | 27995 | 51090 |
| CYP2C19 | 4901 | 27996 | 51091 |
| CYP2C8 | 4902 | 27997 | 51092 |
| CYP2C9 | 4903 | 27998 | 51093 |
| CYP2D6 | 4904 | 27999 | 51094 |
| CYP2E1 | 4905 | 28000 | 51095 |
| CYP2F1 | 4906 | 28001 | 51096 |
| CYP2J2 | 4907 | 28002 | 51097 |
| CYP2R1 | 4908 | 28003 | 51098 |
| CYP2S1 | 4909 | 28004 | 51099 |
| CYP2U1 | 4910 | 28005 | 51100 |
| CYP2W1 | 4911 | 28006 | 51101 |
| CYP39A1 | 4912 | 28007 | 51102 |
| CYP3A4 | 4913 | 28008 | 51103 |
| CYP3A43 | 4914 | 28009 | 51104 |
| CYP3A43 | 4915 | 28010 | 51105 |
| CYP3A5 | 4916 | 28011 | 51106 |
| CYP3A5 | 4917 | 28012 | 51107 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| CYP3A7 | 4918 | 28013 | 51108 |
| CYP3A7-CYP3A51P | 4919 | 28014 | 51109 |
| CYP46A1 | 4920 | 28015 | 51110 |
| CYP4A11 | 4921 | 28016 | 51111 |
| CYP4A22 | 4922 | 28017 | 51112 |
| CYP4B1 | 4923 | 28018 | 51113 |
| CYP4F11 | 4924 | 28019 | 51114 |
| CYP4F12 | 4925 | 28020 | 51115 |
| CYP4F2 | 4926 | 28021 | 51116 |
| CYP4F22 | 4927 | 28022 | 51117 |
| CYP4F8 | 4928 | 28023 | 51118 |
| CYP4V2 | 4929 | 28024 | 51119 |
| CYP4X1 | 4930 | 28025 | 51120 |
| CYP4Z1 | 4931 | 28026 | 51121 |
| CYP51A1 | 4932 | 28027 | 51122 |
| CYP7A1 | 4933 | 28028 | 51123 |
| CYP7B1 | 4934 | 28029 | 51124 |
| CYP7B1 | 4935 | 28030 | 51125 |
| CYP8B1 | 4936 | 28031 | 51126 |
| CYR61 | 4937 | 28032 | 51127 |
| CYS1 | 4938 | 28033 | 51128 |
| CYSLTR1 | 4939 | 28034 | 51129 |
| CYSLTR2 | 4940 | 28035 | 51130 |
| CYSRT1 | 4941 | 28036 | 51131 |
| CYSTM1 | 4942 | 28037 | 51132 |
| CYTH1 | 4943 | 28038 | 51133 |
| CYTH2 | 4944 | 28039 | 51134 |
| CYTH3 | 4945 | 28040 | 51135 |
| CYTH4 | 4946 | 28041 | 51136 |
| CYTIP | 4947 | 28042 | 51137 |
| CYTL1 | 4948 | 28043 | 51138 |
| CYYR1 | 4949 | 28044 | 51139 |
| D2HGDH | 4950 | 28045 | 51140 |
| DAAM1 | 4951 | 28046 | 51141 |
| DAAM2 | 4952 | 28047 | 51142 |
| DAB1 | 4953 | 28048 | 51143 |
| DAB1 | 4954 | 28049 | 51144 |
| DAB2 | 4955 | 28050 | 51145 |
| DAB2IP | 4956 | 28051 | 51146 |
| DAB2IP | 4957 | 28052 | 51147 |
| DACH1 | 4958 | 28053 | 51148 |
| DACH2 | 4959 | 28054 | 51149 |
| DACH2 | 4960 | 28055 | 51150 |
| DACT1 | 4961 | 28056 | 51151 |
| DACT2 | 4962 | 28057 | 51152 |
| DACT2 | 4963 | 28058 | 51153 |
| DACT3 | 4964 | 28059 | 51154 |
| DAD1 | 4965 | 28060 | 51155 |
| DAG1 | 4966 | 28061 | 51156 |
| DAGLA | 4967 | 28062 | 51157 |
| DAGLB | 4968 | 28063 | 51158 |
| DALRD3 | 4969 | 28064 | 51159 |
| DALRD3 | 4970 | 28065 | 51160 |
| DAND5 | 4971 | 28066 | 51161 |
| DAO | 4972 | 28067 | 51162 |
| DAOA | 4973 | 28068 | 51163 |
| DAP | 4974 | 28069 | 51164 |
| DAP3 | 4975 | 28070 | 51165 |
| DAPK1 | 4976 | 28071 | 51166 |
| DAPK2 | 4977 | 28072 | 51167 |
| DAPK3 | 4978 | 28073 | 51168 |
| DAPL1 | 4979 | 28074 | 51169 |
| DAPP1 | 4980 | 28075 | 51170 |
| DAPP1 | 4981 | 28076 | 51171 |
| DARS | 4982 | 28077 | 51172 |
| DARS2 | 4983 | 28078 | 51173 |
| DAW1 | 4984 | 28079 | 51174 |
| DAXX | 4985 | 28080 | 51175 |
| DAZ1 | 4986 | 28081 | 51176 |
| DAZAP1 | 4987 | 28082 | 51177 |
| DAZAP1 | 4988 | 28083 | 51178 |
| DAZAP2 | 4989 | 28084 | 51179 |
| DAZAP2 | 4990 | 28085 | 51180 |
| DAZAP2 | 4991 | 28086 | 51181 |
| DAZL | 4992 | 28087 | 51182 |
| DBF4 | 4993 | 28088 | 51183 |
| DBF4B | 4994 | 28089 | 51184 |
| DBF4B | 4995 | 28090 | 51185 |
| DBH | 4996 | 28091 | 51186 |
| DBI | 4997 | 28092 | 51187 |
| DBI | 4998 | 28093 | 51188 |
| DBN1 | 4999 | 28094 | 51189 |
| DBNDD1 | 5000 | 28095 | 51190 |
| DBNDD1 | 5001 | 28096 | 51191 |
| DBNDD2 | 5002 | 28097 | 51192 |
| DBNDD2 | 5003 | 28098 | 51193 |
| DBNL | 5004 | 28099 | 51194 |
| DBP | 5005 | 28100 | 51195 |
| DBR1 | 5006 | 28101 | 51196 |
| DBT | 5007 | 28102 | 51197 |
| DBX1 | 5008 | 28103 | 51198 |
| DBX2 | 5009 | 28104 | 51199 |
| DCAF1 | 5010 | 28105 | 51200 |
| DCAF10 | 5011 | 28106 | 51201 |
| DCAF11 | 5012 | 28107 | 51202 |
| DCAF12 | 5013 | 28108 | 51203 |
| DCAF12L1 | 5014 | 28109 | 51204 |
| DCAF12L2 | 5015 | 28110 | 51205 |
| DCAF13 | 5016 | 28111 | 51206 |
| DCAF15 | 5017 | 28112 | 51207 |
| DCAF16 | 5018 | 28113 | 51208 |
| DCAF17 | 5019 | 28114 | 51209 |
| DCAF4 | 5020 | 28115 | 51210 |
| DCAF4 | 5021 | 28116 | 51211 |
| DCAF4L1 | 5022 | 28117 | 51212 |
| DCAF4L2 | 5023 | 28118 | 51213 |
| DCAF5 | 5024 | 28119 | 51214 |
| DCAF5 | 5025 | 28120 | 51215 |
| DCAF6 | 5026 | 28121 | 51216 |
| DCAF7 | 5027 | 28122 | 51217 |
| DCAF8 | 5028 | 28123 | 51218 |
| DCAF8L1 | 5029 | 28124 | 51219 |
| DCAF8L2 | 5030 | 28125 | 51220 |
| DCAKD | 5031 | 28126 | 51221 |
| DCANP1 | 5032 | 28127 | 51222 |
| DCBLD1 | 5033 | 28128 | 51223 |
| DCBLD2 | 5034 | 28129 | 51224 |
| DCC | 5035 | 28130 | 51225 |
| DCD | 5036 | 28131 | 51226 |
| DCD | 5037 | 28132 | 51227 |
| DCDC1 | 5038 | 28133 | 51228 |
| DCDC1 | 5039 | 28134 | 51229 |
| DCDC2 | 5040 | 28135 | 51230 |
| DCDC2B | 5041 | 28136 | 51231 |
| DCDC2C | 5042 | 28137 | 51232 |
| DCHS1 | 5043 | 28138 | 51233 |
| DCHS2 | 5044 | 28139 | 51234 |
| DCHS2 | 5045 | 28140 | 51235 |
| DCK | 5046 | 28141 | 51236 |
| DCLK1 | 5047 | 28142 | 51237 |
| DCLK1 | 5048 | 28143 | 51238 |
| DCLK1 | 5049 | 28144 | 51239 |
| DCLK2 | 5050 | 28145 | 51240 |
| DCLK3 | 5051 | 28146 | 51241 |
| DCLRE1A | 5052 | 28147 | 51242 |
| DCLRE1B | 5053 | 28148 | 51243 |
| DCLRE1C | 5054 | 28149 | 51244 |
| DCLRE1C | 5055 | 28150 | 51245 |
| DCN | 5056 | 28151 | 51246 |
| DCN | 5057 | 28152 | 51247 |
| DCP1A | 5058 | 28153 | 51248 |
| DCP1B | 5059 | 28154 | 51249 |
| DCP1B | 5060 | 28155 | 51250 |
| DCP2 | 5061 | 28156 | 51251 |
| DCPS | 5062 | 28157 | 51252 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| DCST1 | 5063 | 28158 | 51253 |
| DCST2 | 5064 | 28159 | 51254 |
| DCSTAMP | 5065 | 28160 | 51255 |
| DCSTAMP | 5066 | 28161 | 51256 |
| DCT | 5067 | 28162 | 51257 |
| DCTD | 5068 | 28163 | 51258 |
| DCTN1 | 5069 | 28164 | 51259 |
| DCTN2 | 5070 | 28165 | 51260 |
| DCTN3 | 5071 | 28166 | 51261 |
| DCTN3 | 5072 | 28167 | 51262 |
| DCTN4 | 5073 | 28168 | 51263 |
| DCTN5 | 5074 | 28169 | 51264 |
| DCTN5 | 5075 | 28170 | 51265 |
| DCTN5 | 5076 | 28171 | 51266 |
| DCTN6 | 5077 | 28172 | 51267 |
| DCTPP1 | 5078 | 28173 | 51268 |
| DCUN1D1 | 5079 | 28174 | 51269 |
| DCUN1D2 | 5080 | 28175 | 51270 |
| DCUN1D3 | 5081 | 28176 | 51271 |
| DCUN1D4 | 5082 | 28177 | 51272 |
| DCUN1D5 | 5083 | 28178 | 51273 |
| DCX | 5084 | 28179 | 51274 |
| DCXR | 5085 | 28180 | 51275 |
| DDA1 | 5086 | 28181 | 51276 |
| DDAH1 | 5087 | 28182 | 51277 |
| DDAH2 | 5088 | 28183 | 51278 |
| DDB1 | 5089 | 28184 | 51279 |
| DDB2 | 5090 | 28185 | 51280 |
| DDC | 5091 | 28186 | 51281 |
| DDC | 5092 | 28187 | 51282 |
| DDHD1 | 5093 | 28188 | 51283 |
| DDHD2 | 5094 | 28189 | 51284 |
| DDHD2 | 5095 | 28190 | 51285 |
| DDI1 | 5096 | 28191 | 51286 |
| DDI2 | 5097 | 28192 | 51287 |
| DDIAS | 5098 | 28193 | 51288 |
| DDIT3 | 5099 | 28194 | 51289 |
| DDIT4 | 5100 | 28195 | 51290 |
| DDIT4L | 5101 | 28196 | 51291 |
| DDN | 5102 | 28197 | 51292 |
| DDO | 5103 | 28198 | 51293 |
| DDOST | 5104 | 28199 | 51294 |
| DDR1 | 5105 | 28200 | 51295 |
| DDR1 | 5106 | 28201 | 51296 |
| DDR2 | 5107 | 28202 | 51297 |
| DDRGK1 | 5108 | 28203 | 51298 |
| DDT | 5109 | 28204 | 51299 |
| DDTL | 5110 | 28205 | 51300 |
| DDX1 | 5111 | 28206 | 51301 |
| DDX10 | 5112 | 28207 | 51302 |
| DDX11 | 5113 | 28208 | 51303 |
| DDX11 | 5114 | 28209 | 51304 |
| DDX17 | 5115 | 28210 | 51305 |
| DDX18 | 5116 | 28211 | 51306 |
| DDX19B | 5117 | 28212 | 51307 |
| DDX20 | 5118 | 28213 | 51308 |
| DDX21 | 5119 | 28214 | 51309 |
| DDX23 | 5120 | 28215 | 51310 |
| DDX24 | 5121 | 28216 | 51311 |
| DDX25 | 5122 | 28217 | 51312 |
| DDX27 | 5123 | 28218 | 51313 |
| DDX28 | 5124 | 28219 | 51314 |
| DDX31 | 5125 | 28220 | 51315 |
| DDX31 | 5126 | 28221 | 51316 |
| DDX31 | 5127 | 28222 | 51317 |
| DDX39A | 5128 | 28223 | 51318 |
| DDX39B | 5129 | 28224 | 51319 |
| DDX3Y | 5130 | 28225 | 51320 |
| DDX4 | 5131 | 28226 | 51321 |
| DDX41 | 5132 | 28227 | 51322 |
| DDX42 | 5133 | 28228 | 51323 |
| DDX43 | 5134 | 28229 | 51324 |
| DDX46 | 5135 | 28230 | 51325 |
| DDX47 | 5136 | 28231 | 51326 |
| DDX49 | 5137 | 28232 | 51327 |
| DDX5 | 5138 | 28233 | 51328 |
| DDX50 | 5139 | 28234 | 51329 |
| DDX51 | 5140 | 28235 | 51330 |
| DDX52 | 5141 | 28236 | 51331 |
| DDX53 | 5142 | 28237 | 51332 |
| DDX54 | 5143 | 28238 | 51333 |
| DDX55 | 5144 | 28239 | 51334 |
| DDX56 | 5145 | 28240 | 51335 |
| DDX58 | 5146 | 28241 | 51336 |
| DDX59 | 5147 | 28242 | 51337 |
| DDX59 | 5148 | 28243 | 51338 |
| DDX59 | 5149 | 28244 | 51339 |
| DDX6 | 5150 | 28245 | 51340 |
| DDX60 | 5151 | 28246 | 51341 |
| DDX60L | 5152 | 28247 | 51342 |
| DDX60L | 5153 | 28248 | 51343 |
| DEAF1 | 5154 | 28249 | 51344 |
| DEC1 | 5155 | 28250 | 51345 |
| DECR1 | 5156 | 28251 | 51346 |
| DECR2 | 5157 | 28252 | 51347 |
| DEDD | 5158 | 28253 | 51348 |
| DEDD2 | 5159 | 28254 | 51349 |
| DEF6 | 5160 | 28255 | 51350 |
| DEF8 | 5161 | 28256 | 51351 |
| DEF8 | 5162 | 28257 | 51352 |
| DEFA1 | 5163 | 28258 | 51353 |
| DEFA4 | 5164 | 28259 | 51354 |
| DEFA5 | 5165 | 28260 | 51355 |
| DEFA6 | 5166 | 28261 | 51356 |
| DEFB1 | 5167 | 28262 | 51357 |
| DEFB103B | 5168 | 28263 | 51358 |
| DEFB104A | 5169 | 28264 | 51359 |
| DEFB105A | 5170 | 28265 | 51360 |
| DEFB106A | 5171 | 28266 | 51361 |
| DEFB107A | 5172 | 28267 | 51362 |
| DEFB108B | 5173 | 28268 | 51363 |
| DEFB110 | 5174 | 28269 | 51364 |
| DEFB110 | 5175 | 28270 | 51365 |
| DEFB112 | 5176 | 28271 | 51366 |
| DEFB113 | 5177 | 28272 | 51367 |
| DEFB114 | 5178 | 28273 | 51368 |
| DEFB115 | 5179 | 28274 | 51369 |
| DEFB116 | 5180 | 28275 | 51370 |
| DEFB118 | 5181 | 28276 | 51371 |
| DEFB119 | 5182 | 28277 | 51372 |
| DEFB119 | 5183 | 28278 | 51373 |
| DEFB121 | 5184 | 28279 | 51374 |
| DEFB123 | 5185 | 28280 | 51375 |
| DEFB124 | 5186 | 28281 | 51376 |
| DEFB125 | 5187 | 28282 | 51377 |
| DEFB126 | 5188 | 28283 | 51378 |
| DEFB127 | 5189 | 28284 | 51379 |
| DEFB128 | 5190 | 28285 | 51380 |
| DEFB129 | 5191 | 28286 | 51381 |
| DEFB130B | 5192 | 28287 | 51382 |
| DEFB131A | 5193 | 28288 | 51383 |
| DEFB131B | 5194 | 28289 | 51384 |
| DEFB132 | 5195 | 28290 | 51385 |
| DEFB133 | 5196 | 28291 | 51386 |
| DEFB134 | 5197 | 28292 | 51387 |
| DEFB135 | 5198 | 28293 | 51388 |
| DEFB136 | 5199 | 28294 | 51389 |
| DEFB4A | 5200 | 28295 | 51390 |
| DEGS1 | 5201 | 28296 | 51391 |
| DEGS1 | 5202 | 28297 | 51392 |
| DEGS2 | 5203 | 28298 | 51393 |
| DEK | 5204 | 28299 | 51394 |
| DENND1A | 5205 | 28300 | 51395 |
| DENND1A | 5206 | 28301 | 51396 |
| DENND1A | 5207 | 28302 | 51397 |
| DENND1B | 5208 | 28303 | 51398 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| DENND1B | 5209 | 28304 | 51399 |
| DENND1B | 5210 | 28305 | 51400 |
| DENND1C | 5211 | 28306 | 51401 |
| DENND2A | 5212 | 28307 | 51402 |
| DENND2A | 5213 | 28308 | 51403 |
| DENND2C | 5214 | 28309 | 51404 |
| DENND2D | 5215 | 28310 | 51405 |
| DENND3 | 5216 | 28311 | 51406 |
| DENND3 | 5217 | 28312 | 51407 |
| DENND4A | 5218 | 28313 | 51408 |
| DENND4B | 5219 | 28314 | 51409 |
| DENND4C | 5220 | 28315 | 51410 |
| DENND5A | 5221 | 28316 | 51411 |
| DENND5A | 5222 | 28317 | 51412 |
| DENND5B | 5223 | 28318 | 51413 |
| DENND6A | 5224 | 28319 | 51414 |
| DENND6B | 5225 | 28320 | 51415 |
| DENR | 5226 | 28321 | 51416 |
| DEPDC1 | 5227 | 28322 | 51417 |
| DEPDC1B | 5228 | 28323 | 51418 |
| DEPDC4 | 5229 | 28324 | 51419 |
| DEPDC4 | 5230 | 28325 | 51420 |
| DEPDC4 | 5231 | 28326 | 51421 |
| DEPDC5 | 5232 | 28327 | 51422 |
| DEPDC5 | 5233 | 28328 | 51423 |
| DEPDC7 | 5234 | 28329 | 51424 |
| DEPTOR | 5235 | 28330 | 51425 |
| DERA | 5236 | 28331 | 51426 |
| DERL1 | 5237 | 28332 | 51427 |
| DERL2 | 5238 | 28333 | 51428 |
| DERL2 | 5239 | 28334 | 51429 |
| DERL3 | 5240 | 28335 | 51430 |
| DERL3 | 5241 | 28336 | 51431 |
| DERL3 | 5242 | 28337 | 51432 |
| DES | 5243 | 28338 | 51433 |
| DESI1 | 5244 | 28339 | 51434 |
| DESI2 | 5245 | 28340 | 51435 |
| DET1 | 5246 | 28341 | 51436 |
| DEUP1 | 5247 | 28342 | 51437 |
| DEXI | 5248 | 28343 | 51438 |
| DFFA | 5249 | 28344 | 51439 |
| DFFA | 5250 | 28345 | 51440 |
| DFFB | 5251 | 28346 | 51441 |
| DFNA5 | 5252 | 28347 | 51442 |
| DGAT1 | 5253 | 28348 | 51443 |
| DGAT2 | 5254 | 28349 | 51444 |
| DGAT2L6 | 5255 | 28350 | 51445 |
| DGCR2 | 5256 | 28351 | 51446 |
| DGCR6L | 5257 | 28352 | 51447 |
| DGCR8 | 5258 | 28353 | 51448 |
| DGKA | 5259 | 28354 | 51449 |
| DGKB | 5260 | 28355 | 51450 |
| DGKB | 5261 | 28356 | 51451 |
| DGKD | 5262 | 28357 | 51452 |
| DGKE | 5263 | 28358 | 51453 |
| DGKG | 5264 | 28359 | 51454 |
| DGKH | 5265 | 28360 | 51455 |
| DGKH | 5266 | 28361 | 51456 |
| DGKI | 5267 | 28362 | 51457 |
| DGKK | 5268 | 28363 | 51458 |
| DGKQ | 5269 | 28364 | 51459 |
| DGKZ | 5270 | 28365 | 51460 |
| DGLUCY | 5271 | 28366 | 51461 |
| DGLUCY | 5272 | 28367 | 51462 |
| DGUOK | 5273 | 28368 | 51463 |
| DHCR24 | 5274 | 28369 | 51464 |
| DHCR7 | 5275 | 28370 | 51465 |
| DHDDS | 5276 | 28371 | 51466 |
| DHDH | 5277 | 28372 | 51467 |
| DHFR | 5278 | 28373 | 51468 |
| DHFR | 5279 | 28374 | 51469 |
| DHFR | 5280 | 28375 | 51470 |
| DHFR2 | 5281 | 28376 | 51471 |
| DHH | 5282 | 28377 | 51472 |
| DHODH | 5283 | 28378 | 51473 |
| DHPS | 5284 | 28379 | 51474 |
| DHRS1 | 5285 | 28380 | 51475 |
| DHRS11 | 5286 | 28381 | 51476 |
| DHRS12 | 5287 | 28382 | 51477 |
| DHRS12 | 5288 | 28383 | 51478 |
| DHRS12 | 5289 | 28384 | 51479 |
| DHRS13 | 5290 | 28385 | 51480 |
| DHRS2 | 5291 | 28386 | 51481 |
| DHRS2 | 5292 | 28387 | 51482 |
| DHRS2 | 5293 | 28388 | 51483 |
| DHRS3 | 5294 | 28389 | 51484 |
| DHRS4 | 5295 | 28390 | 51485 |
| DHRS4 | 5296 | 28391 | 51486 |
| DHRS4L1 | 5297 | 28392 | 51487 |
| DHRS4L2 | 5298 | 28393 | 51488 |
| DHRS4L2 | 5299 | 28394 | 51489 |
| DHRS7 | 5300 | 28395 | 51490 |
| DHRS7B | 5301 | 28396 | 51491 |
| DHRS7C | 5302 | 28397 | 51492 |
| DHRS9 | 5303 | 28398 | 51493 |
| DHRSX | 5304 | 28399 | 51494 |
| DHTKD1 | 5305 | 28400 | 51495 |
| DHX15 | 5306 | 28401 | 51496 |
| DHX16 | 5307 | 28402 | 51497 |
| DHX29 | 5308 | 28403 | 51498 |
| DHX30 | 5309 | 28404 | 51499 |
| DHX32 | 5310 | 28405 | 51500 |
| DHX33 | 5311 | 28406 | 51501 |
| DHX34 | 5312 | 28407 | 51502 |
| DHX35 | 5313 | 28408 | 51503 |
| DHX36 | 5314 | 28409 | 51504 |
| DHX37 | 5315 | 28410 | 51505 |
| DHX38 | 5316 | 28411 | 51506 |
| DHX40 | 5317 | 28412 | 51507 |
| DHX57 | 5318 | 28413 | 51508 |
| DHX58 | 5319 | 28414 | 51509 |
| DHX8 | 5320 | 28415 | 51510 |
| DHX8 | 5321 | 28416 | 51511 |
| DHX8 | 5322 | 28417 | 51512 |
| DHX8 | 5323 | 28418 | 51513 |
| DHX9 | 5324 | 28419 | 51514 |
| DIABLO | 5325 | 28420 | 51515 |
| DIAPH1 | 5326 | 28421 | 51516 |
| DIAPH1 | 5327 | 28422 | 51517 |
| DIAPH2 | 5328 | 28423 | 51518 |
| DIAPH2 | 5329 | 28424 | 51519 |
| DIAPH3 | 5330 | 28425 | 51520 |
| DIAPH3 | 5331 | 28426 | 51521 |
| DIAPH3 | 5332 | 28427 | 51522 |
| DICER1 | 5333 | 28428 | 51523 |
| DICER1 | 5334 | 28429 | 51524 |
| DIDO1 | 5335 | 28430 | 51525 |
| DIDO1 | 5336 | 28431 | 51526 |
| DIDO1 | 5337 | 28432 | 51527 |
| DIEXF | 5338 | 28433 | 51528 |
| DIMT1 | 5339 | 28434 | 51529 |
| DIMT1 | 5340 | 28435 | 51530 |
| DIO1 | 5341 | 28436 | 51531 |
| DIO1 | 5342 | 28437 | 51532 |
| DIO1 | 5343 | 28438 | 51533 |
| DIO2 | 5344 | 28439 | 51534 |
| DIO3 | 5345 | 28440 | 51535 |
| DIP2A | 5346 | 28441 | 51536 |
| DIP2A | 5347 | 28442 | 51537 |
| DIP2A | 5348 | 28443 | 51538 |
| DIP2A | 5349 | 28444 | 51539 |
| DIP2B | 5350 | 28445 | 51540 |
| DIP2C | 5351 | 28446 | 51541 |
| DIRAS1 | 5352 | 28447 | 51542 |
| DIRAS2 | 5353 | 28448 | 51543 |
| DIRAS3 | 5354 | 28449 | 51544 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| DIRC1 | 5355 | 28450 | 51545 |
| DIRC2 | 5356 | 28451 | 51546 |
| DIS3 | 5357 | 28452 | 51547 |
| DIS3L | 5358 | 28453 | 51548 |
| DIS3L2 | 5359 | 28454 | 51549 |
| DIS3L2 | 5360 | 28455 | 51550 |
| DIS3L2 | 5361 | 28456 | 51551 |
| DISC1 | 5362 | 28457 | 51552 |
| DISC1 | 5363 | 28458 | 51553 |
| DISC1 | 5364 | 28459 | 51554 |
| DISC1 | 5365 | 28460 | 51555 |
| DISC1 | 5366 | 28461 | 51556 |
| DISC1 | 5367 | 28462 | 51557 |
| DISC1 | 5368 | 28463 | 51558 |
| DISC1 | 5369 | 28464 | 51559 |
| DISC1 | 5370 | 28465 | 51560 |
| DISC1 | 5371 | 28466 | 51561 |
| DISC1 | 5372 | 28467 | 51562 |
| DISC1 | 5373 | 28468 | 51563 |
| DISC1 | 5374 | 28469 | 51564 |
| DISC1 | 5375 | 28470 | 51565 |
| DISC1 | 5376 | 28471 | 51566 |
| DISC1 | 5377 | 28472 | 51567 |
| DISP1 | 5378 | 28473 | 51568 |
| DISP2 | 5379 | 28474 | 51569 |
| DISP3 | 5380 | 28475 | 51570 |
| DIXDC1 | 5381 | 28476 | 51571 |
| DIXDC1 | 5382 | 28477 | 51572 |
| DKC1 | 5383 | 28478 | 51573 |
| DKC1 | 5384 | 28479 | 51574 |
| DKK1 | 5385 | 28480 | 51575 |
| DKK2 | 5386 | 28481 | 51576 |
| DKK3 | 5387 | 28482 | 51577 |
| DKK4 | 5388 | 28483 | 51578 |
| DKKL1 | 5389 | 28484 | 51579 |
| DLAT | 5390 | 28485 | 51580 |
| DLC1 | 5391 | 28486 | 51581 |
| DLC1 | 5392 | 28487 | 51582 |
| DLD | 5393 | 28488 | 51583 |
| DLEC1 | 5394 | 28489 | 51584 |
| DLEC1 | 5395 | 28490 | 51585 |
| DLEU7 | 5396 | 28491 | 51586 |
| DLEU7 | 5397 | 28492 | 51587 |
| DLG1 | 5398 | 28493 | 51588 |
| DLG2 | 5399 | 28494 | 51589 |
| DLG3 | 5400 | 28495 | 51590 |
| DLG4 | 5401 | 28496 | 51591 |
| DLG5 | 5402 | 28497 | 51592 |
| DLGAP1 | 5403 | 28498 | 51593 |
| DLGAP1 | 5404 | 28499 | 51594 |
| DLGAP2 | 5405 | 28500 | 51595 |
| DLGAP3 | 5406 | 28501 | 51596 |
| DLGAP4 | 5407 | 28502 | 51597 |
| DLGAP5 | 5408 | 28503 | 51598 |
| DLGAP5 | 5409 | 28504 | 51599 |
| DLK1 | 5410 | 28505 | 51600 |
| DLK2 | 5411 | 28506 | 51601 |
| DLL1 | 5412 | 28507 | 51602 |
| DLL3 | 5413 | 28508 | 51603 |
| DLL3 | 5414 | 28509 | 51604 |
| DLL4 | 5415 | 28510 | 51605 |
| DLST | 5416 | 28511 | 51606 |
| DLST | 5417 | 28512 | 51607 |
| DLX1 | 5418 | 28513 | 51608 |
| DLX1 | 5419 | 28514 | 51609 |
| DLX2 | 5420 | 28515 | 51610 |
| DLX3 | 5421 | 28516 | 51611 |
| DLX4 | 5422 | 28517 | 51612 |
| DLX5 | 5423 | 28518 | 51613 |
| DLX6 | 5424 | 28519 | 51614 |
| DMAC1 | 5425 | 28520 | 51615 |
| DMAC1 | 5426 | 28521 | 51616 |
| DMAC2 | 5427 | 28522 | 51617 |
| DMAC2 | 5428 | 28523 | 51618 |
| DMAC2 | 5429 | 28524 | 51619 |
| DMAP1 | 5430 | 28525 | 51620 |
| DMBT1 | 5431 | 28526 | 51621 |
| DMBX1 | 5432 | 28527 | 51622 |
| DMC1 | 5433 | 28528 | 51623 |
| DMD | 5434 | 28529 | 51624 |
| DMD | 5435 | 28530 | 51625 |
| DMD | 5436 | 28531 | 51626 |
| DMGDH | 5437 | 28532 | 51627 |
| DMKN | 5438 | 28533 | 51628 |
| DMKN | 5439 | 28534 | 51629 |
| DMP1 | 5440 | 28535 | 51630 |
| DMPK | 5441 | 28536 | 51631 |
| DMPK | 5442 | 28537 | 51632 |
| DMPK | 5443 | 28538 | 51633 |
| DMRT1 | 5444 | 28539 | 51634 |
| DMRT2 | 5445 | 28540 | 51635 |
| DMRT3 | 5446 | 28541 | 51636 |
| DMRTA1 | 5447 | 28542 | 51637 |
| DMRTA2 | 5448 | 28543 | 51638 |
| DMRTB1 | 5449 | 28544 | 51639 |
| DMRTC1 | 5450 | 28545 | 51640 |
| DMRTC2 | 5451 | 28546 | 51641 |
| DMTF1 | 5452 | 28547 | 51642 |
| DMTN | 5453 | 28548 | 51643 |
| DMWD | 5454 | 28549 | 51644 |
| DMXL1 | 5455 | 28550 | 51645 |
| DMXL2 | 5456 | 28551 | 51646 |
| DNA2 | 5457 | 28552 | 51647 |
| DNAAF1 | 5458 | 28553 | 51648 |
| DNAAF2 | 5459 | 28554 | 51649 |
| DNAAF3 | 5460 | 28555 | 51650 |
| DNAAF4 | 5461 | 28556 | 51651 |
| DNAAF4 | 5462 | 28557 | 51652 |
| DNAAF5 | 5463 | 28558 | 51653 |
| DNAH1 | 5464 | 28559 | 51654 |
| DNAH10 | 5465 | 28560 | 51655 |
| DNAH11 | 5466 | 28561 | 51656 |
| DNAH12 | 5467 | 28562 | 51657 |
| DNAH12 | 5468 | 28563 | 51658 |
| DNAH14 | 5469 | 28564 | 51659 |
| DNAH14 | 5470 | 28565 | 51660 |
| DNAH14 | 5471 | 28566 | 51661 |
| DNAH14 | 5472 | 28567 | 51662 |
| DNAH17 | 5473 | 28568 | 51663 |
| DNAH2 | 5474 | 28569 | 51664 |
| DNAH2 | 5475 | 28570 | 51665 |
| DNAH3 | 5476 | 28571 | 51666 |
| DNAH5 | 5477 | 28572 | 51667 |
| DNAH6 | 5478 | 28573 | 51668 |
| DNAH7 | 5479 | 28574 | 51669 |
| DNAH8 | 5480 | 28575 | 51670 |
| DNAH9 | 5481 | 28576 | 51671 |
| DNAI1 | 5482 | 28577 | 51672 |
| DNAI2 | 5483 | 28578 | 51673 |
| DNAJA1 | 5484 | 28579 | 51674 |
| DNAJA2 | 5485 | 28580 | 51675 |
| DNAJA3 | 5486 | 28581 | 51676 |
| DNAJA3 | 5487 | 28582 | 51677 |
| DNAJA4 | 5488 | 28583 | 51678 |
| DNAJB1 | 5489 | 28584 | 51679 |
| DNAJB11 | 5490 | 28585 | 51680 |
| DNAJB12 | 5491 | 28586 | 51681 |
| DNAJB13 | 5492 | 28587 | 51682 |
| DNAJB14 | 5493 | 28588 | 51683 |
| DNAJB14 | 5494 | 28589 | 51684 |
| DNAJB2 | 5495 | 28590 | 51685 |
| DNAJB2 | 5496 | 28591 | 51686 |
| DNAJB3 | 5497 | 28592 | 51687 |
| DNAJB4 | 5498 | 28593 | 51688 |
| DNAJB5 | 5499 | 28594 | 51689 |
| DNAJB6 | 5500 | 28595 | 51690 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| DNAJB6 | 5501 | 28596 | 51691 |
| DNAJB7 | 5502 | 28597 | 51692 |
| DNAJB8 | 5503 | 28598 | 51693 |
| DNAJB9 | 5504 | 28599 | 51694 |
| DNAJC1 | 5505 | 28600 | 51695 |
| DNAJC10 | 5506 | 28601 | 51696 |
| DNAJC11 | 5507 | 28602 | 51697 |
| DNAJC12 | 5508 | 28603 | 51698 |
| DNAJC12 | 5509 | 28604 | 51699 |
| DNAJC13 | 5510 | 28605 | 51700 |
| DNAJC14 | 5511 | 28606 | 51701 |
| DNAJC15 | 5512 | 28607 | 51702 |
| DNAJC16 | 5513 | 28608 | 51703 |
| DNAJC17 | 5514 | 28609 | 51704 |
| DNAJC18 | 5515 | 28610 | 51705 |
| DNAJC19 | 5516 | 28611 | 51706 |
| DNAJC2 | 5517 | 28612 | 51707 |
| DNAJC21 | 5518 | 28613 | 51708 |
| DNAJC22 | 5519 | 28614 | 51709 |
| DNAJC24 | 5520 | 28615 | 51710 |
| DNAJC25 | 5521 | 28616 | 51711 |
| DNAJC27 | 5522 | 28617 | 51712 |
| DNAJC27 | 5523 | 28618 | 51713 |
| DNAJC28 | 5524 | 28619 | 51714 |
| DNAJC3 | 5525 | 28620 | 51715 |
| DNAJC30 | 5526 | 28621 | 51716 |
| DNAJC4 | 5527 | 28622 | 51717 |
| DNAJC4 | 5528 | 28623 | 51718 |
| DNAJC5 | 5529 | 28624 | 51719 |
| DNAJC5B | 5530 | 28625 | 51720 |
| DNAJC5G | 5531 | 28626 | 51721 |
| DNAJC6 | 5532 | 28627 | 51722 |
| DNAJC7 | 5533 | 28628 | 51723 |
| DNAJC8 | 5534 | 28629 | 51724 |
| DNAJC9 | 5535 | 28630 | 51725 |
| DNAL1 | 5536 | 28631 | 51726 |
| DNAL4 | 5537 | 28632 | 51727 |
| DNALI1 | 5538 | 28633 | 51728 |
| DNASE1 | 5539 | 28634 | 51729 |
| DNASE1L1 | 5540 | 28635 | 51730 |
| DNASE1L2 | 5541 | 28636 | 51731 |
| DNASE1L3 | 5542 | 28637 | 51732 |
| DNASE2 | 5543 | 28638 | 51733 |
| DNASE2B | 5544 | 28639 | 51734 |
| DND1 | 5545 | 28640 | 51735 |
| DNER | 5546 | 28641 | 51736 |
| DNHD1 | 5547 | 28642 | 51737 |
| DNHD1 | 5548 | 28643 | 51738 |
| DNLZ | 5549 | 28644 | 51739 |
| DNM1 | 5550 | 28645 | 51740 |
| DNM1 | 5551 | 28646 | 51741 |
| DNM1 | 5552 | 28647 | 51742 |
| DNM1L | 5553 | 28648 | 51743 |
| DNM2 | 5554 | 28649 | 51744 |
| DNM3 | 5555 | 28650 | 51745 |
| DNM3 | 5556 | 28651 | 51746 |
| DNM3 | 5557 | 28652 | 51747 |
| DNMBP | 5558 | 28653 | 51748 |
| DNMT1 | 5559 | 28654 | 51749 |
| DNMT3A | 5560 | 28655 | 51750 |
| DNMT3A | 5561 | 28656 | 51751 |
| DNMT3B | 5562 | 28657 | 51752 |
| DNMT3L | 5563 | 28658 | 51753 |
| DNPEP | 5564 | 28659 | 51754 |
| DNPH1 | 5565 | 28660 | 51755 |
| DNPH1 | 5566 | 28661 | 51756 |
| DNTT | 5567 | 28662 | 51757 |
| DNTTIP1 | 5568 | 28663 | 51758 |
| DNTTIP2 | 5569 | 28664 | 51759 |
| DOC2A | 5570 | 28665 | 51760 |
| DOC2B | 5571 | 28666 | 51761 |
| DOCK1 | 5572 | 28667 | 51762 |
| DOCK10 | 5573 | 28668 | 51763 |
| DOCK11 | 5574 | 28669 | 51764 |
| DOCK2 | 5575 | 28670 | 51765 |
| DOCK3 | 5576 | 28671 | 51766 |
| DOCK4 | 5577 | 28672 | 51767 |
| DOCK5 | 5578 | 28673 | 51768 |
| DOCK5 | 5579 | 28674 | 51769 |
| DOCK6 | 5580 | 28675 | 51770 |
| DOCK7 | 5581 | 28676 | 51771 |
| DOCK7 | 5582 | 28677 | 51772 |
| DOCK8 | 5583 | 28678 | 51773 |
| DOCK9 | 5584 | 28679 | 51774 |
| DOCK9 | 5585 | 28680 | 51775 |
| DOHH | 5586 | 28681 | 51776 |
| DOK1 | 5587 | 28682 | 51777 |
| DOK2 | 5588 | 28683 | 51778 |
| DOK3 | 5589 | 28684 | 51779 |
| DOK3 | 5590 | 28685 | 51780 |
| DOK4 | 5591 | 28686 | 51781 |
| DOK5 | 5592 | 28687 | 51782 |
| DOK5 | 5593 | 28688 | 51783 |
| DOK6 | 5594 | 28689 | 51784 |
| DOK7 | 5595 | 28690 | 51785 |
| DOK7 | 5596 | 28691 | 51786 |
| DOK7 | 5597 | 28692 | 51787 |
| DOLK | 5598 | 28693 | 51788 |
| DOLPP1 | 5599 | 28694 | 51789 |
| DONSON | 5600 | 28695 | 51790 |
| DOPEY1 | 5601 | 28696 | 51791 |
| DOPEY2 | 5602 | 28697 | 51792 |
| DOT1L | 5603 | 28698 | 51793 |
| DPAGT1 | 5604 | 28699 | 51794 |
| DPCD | 5605 | 28700 | 51795 |
| DPCD | 5606 | 28701 | 51796 |
| DPCD | 5607 | 28702 | 51797 |
| DPCD | 5608 | 28703 | 51798 |
| DPCR1 | 5609 | 28704 | 51799 |
| DPEP1 | 5610 | 28705 | 51800 |
| DPEP2 | 5611 | 28706 | 51801 |
| DPEP3 | 5612 | 28707 | 51802 |
| DPF1 | 5613 | 28708 | 51803 |
| DPF2 | 5614 | 28709 | 51804 |
| DPF3 | 5615 | 28710 | 51805 |
| DPF3 | 5616 | 28711 | 51806 |
| DPH1 | 5617 | 28712 | 51807 |
| DPH2 | 5618 | 28713 | 51808 |
| DPH3 | 5619 | 28714 | 51809 |
| DPH3 | 5620 | 28715 | 51810 |
| DPH3P1 | 5621 | 28716 | 51811 |
| DPH5 | 5622 | 28717 | 51812 |
| DPH6 | 5623 | 28718 | 51813 |
| DPH6 | 5624 | 28719 | 51814 |
| DPH7 | 5625 | 28720 | 51815 |
| DPH7 | 5626 | 28721 | 51816 |
| DPH7 | 5627 | 28722 | 51817 |
| DPM1 | 5628 | 28723 | 51818 |
| DPM2 | 5629 | 28724 | 51819 |
| DPM3 | 5630 | 28725 | 51820 |
| DPP10 | 5631 | 28726 | 51821 |
| DPP10 | 5632 | 28727 | 51822 |
| DPP3 | 5633 | 28728 | 51823 |
| DPP4 | 5634 | 28729 | 51824 |
| DPP6 | 5635 | 28730 | 51825 |
| DPP6 | 5636 | 28731 | 51826 |
| DPP7 | 5637 | 28732 | 51827 |
| DPP8 | 5638 | 28733 | 51828 |
| DPP9 | 5639 | 28734 | 51829 |
| DPP9-AS1 | 5640 | 28735 | 51830 |
| DPPA2 | 5641 | 28736 | 51831 |
| DPPA3 | 5642 | 28737 | 51832 |
| DPPA4 | 5643 | 28738 | 51833 |
| DPPA4 | 5644 | 28739 | 51834 |
| DPPA5 | 5645 | 28740 | 51835 |
| DPRX | 5646 | 28741 | 51836 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| DPT | 5647 | 28742 | 51837 |
| DPY19L1 | 5648 | 28743 | 51838 |
| DPY19L2 | 5649 | 28744 | 51839 |
| DPY19L3 | 5650 | 28745 | 51840 |
| DPY19L4 | 5651 | 28746 | 51841 |
| DPY30 | 5652 | 28747 | 51842 |
| DPY30 | 5653 | 28748 | 51843 |
| DPYD | 5654 | 28749 | 51844 |
| DPYD | 5655 | 28750 | 51845 |
| DPYS | 5656 | 28751 | 51846 |
| DPYSL2 | 5657 | 28752 | 51847 |
| DPYSL3 | 5658 | 28753 | 51848 |
| DPYSL4 | 5659 | 28754 | 51849 |
| DPYSL5 | 5660 | 28755 | 51850 |
| DQX1 | 5661 | 28756 | 51851 |
| DR1 | 5662 | 28757 | 51852 |
| DRAM1 | 5663 | 28758 | 51853 |
| DRAM2 | 5664 | 28759 | 51854 |
| DRAP1 | 5665 | 28760 | 51855 |
| DRAXIN | 5666 | 28761 | 51856 |
| DRC1 | 5667 | 28762 | 51857 |
| DRC3 | 5668 | 28763 | 51858 |
| DRC3 | 5669 | 28764 | 51859 |
| DRC7 | 5670 | 28765 | 51860 |
| DRD1 | 5671 | 28766 | 51861 |
| DRD2 | 5672 | 28767 | 51862 |
| DRD3 | 5673 | 28768 | 51863 |
| DRD4 | 5674 | 28769 | 51864 |
| DRD5 | 5675 | 28770 | 51865 |
| DRG1 | 5676 | 28771 | 51866 |
| DRG2 | 5677 | 28772 | 51867 |
| DRG2 | 5678 | 28773 | 51868 |
| DRGX | 5679 | 28774 | 51869 |
| DRICH1 | 5680 | 28775 | 51870 |
| DROSHA | 5681 | 28776 | 51871 |
| DRP2 | 5682 | 28777 | 51872 |
| DSC1 | 5683 | 28778 | 51873 |
| DSC1 | 5684 | 28779 | 51874 |
| DSC2 | 5685 | 28780 | 51875 |
| DSC3 | 5686 | 28781 | 51876 |
| DSC3 | 5687 | 28782 | 51877 |
| DSCAM | 5688 | 28783 | 51878 |
| DSCAML1 | 5689 | 28784 | 51879 |
| DSCC1 | 5690 | 28785 | 51880 |
| DSCR3 | 5691 | 28786 | 51881 |
| DSE | 5692 | 28787 | 51882 |
| DSEL | 5693 | 28788 | 51883 |
| DSG1 | 5694 | 28789 | 51884 |
| DSG2 | 5695 | 28790 | 51885 |
| DSG3 | 5696 | 28791 | 51886 |
| DSG4 | 5697 | 28792 | 51887 |
| DSN1 | 5698 | 28793 | 51888 |
| DSP | 5699 | 28794 | 51889 |
| DSPP | 5700 | 28795 | 51890 |
| DST | 5701 | 28796 | 51891 |
| DST | 5702 | 28797 | 51892 |
| DSTN | 5703 | 28798 | 51893 |
| DSTYK | 5704 | 28799 | 51894 |
| DTD1 | 5705 | 28800 | 51895 |
| DTD1 | 5706 | 28801 | 51896 |
| DTD2 | 5707 | 28802 | 51897 |
| DTHD1 | 5708 | 28803 | 51898 |
| DTL | 5709 | 28804 | 51899 |
| DTNA | 5710 | 28805 | 51900 |
| DTNA | 5711 | 28806 | 51901 |
| DTNA | 5712 | 28807 | 51902 |
| DTNA | 5713 | 28808 | 51903 |
| DTNB | 5714 | 28809 | 51904 |
| DTNB | 5715 | 28810 | 51905 |
| DTNB | 5716 | 28811 | 51906 |
| DTNB | 5717 | 28812 | 51907 |
| DTNB | 5718 | 28813 | 51908 |
| DTNB | 5719 | 28814 | 51909 |
| DTNB | 5720 | 28815 | 51910 |
| DTNB | 5721 | 28816 | 51911 |
| DTNB | 5722 | 28817 | 51912 |
| DTNBP1 | 5723 | 28818 | 51913 |
| DTNBP1 | 5724 | 28819 | 51914 |
| DTWD1 | 5725 | 28820 | 51915 |
| DTWD2 | 5726 | 28821 | 51916 |
| DTX1 | 5727 | 28822 | 51917 |
| DTX2 | 5728 | 28823 | 51918 |
| DTX3 | 5729 | 28824 | 51919 |
| DTX3L | 5730 | 28825 | 51920 |
| DTX4 | 5731 | 28826 | 51921 |
| DTYMK | 5732 | 28827 | 51922 |
| DTYMK | 5733 | 28828 | 51923 |
| DUOX1 | 5734 | 28829 | 51924 |
| DUOX2 | 5735 | 28830 | 51925 |
| DUOXA1 | 5736 | 28831 | 51926 |
| DUOXA1 | 5737 | 28832 | 51927 |
| DUOXA2 | 5738 | 28833 | 51928 |
| DUPD1 | 5739 | 28834 | 51929 |
| DUS1L | 5740 | 28835 | 51930 |
| DUS2 | 5741 | 28836 | 51931 |
| DUS3L | 5742 | 28837 | 51932 |
| DUS4L | 5743 | 28838 | 51933 |
| DUSP1 | 5744 | 28839 | 51934 |
| DUSP10 | 5745 | 28840 | 51935 |
| DUSP11 | 5746 | 28841 | 51936 |
| DUSP12 | 5747 | 28842 | 51937 |
| DUSP13 | 5748 | 28843 | 51938 |
| DUSP14 | 5749 | 28844 | 51939 |
| DUSP15 | 5750 | 28845 | 51940 |
| DUSP15 | 5751 | 28846 | 51941 |
| DUSP16 | 5752 | 28847 | 51942 |
| DUSP18 | 5753 | 28848 | 51943 |
| DUSP19 | 5754 | 28849 | 51944 |
| DUSP19 | 5755 | 28850 | 51945 |
| DUSP2 | 5756 | 28851 | 51946 |
| DUSP21 | 5757 | 28852 | 51947 |
| DUSP22 | 5758 | 28853 | 51948 |
| DUSP22 | 5759 | 28854 | 51949 |
| DUSP23 | 5760 | 28855 | 51950 |
| DUSP26 | 5761 | 28856 | 51951 |
| DUSP27 | 5762 | 28857 | 51952 |
| DUSP28 | 5763 | 28858 | 51953 |
| DUSP3 | 5764 | 28859 | 51954 |
| DUSP4 | 5765 | 28860 | 51955 |
| DUSP5 | 5766 | 28861 | 51956 |
| DUSP6 | 5767 | 28862 | 51957 |
| DUSP7 | 5768 | 28863 | 51958 |
| DUSP8 | 5769 | 28864 | 51959 |
| DUSP9 | 5770 | 28865 | 51960 |
| DUT | 5771 | 28866 | 51961 |
| DUX1 | 5772 | 28867 | 51962 |
| DUX4 | 5773 | 28868 | 51963 |
| DUXA | 5774 | 28869 | 51964 |
| DUXB | 5775 | 28870 | 51965 |
| DVL1 | 5776 | 28871 | 51966 |
| DVL2 | 5777 | 28872 | 51967 |
| DVL3 | 5778 | 28873 | 51968 |
| DWORF | 5779 | 28874 | 51969 |
| DXO | 5780 | 28875 | 51970 |
| DYDC1 | 5781 | 28876 | 51971 |
| DYDC2 | 5782 | 28877 | 51972 |
| DYM | 5783 | 28878 | 51973 |
| DYNAP | 5784 | 28879 | 51974 |
| DYNC1H1 | 5785 | 28880 | 51975 |
| DYNC1I1 | 5786 | 28881 | 51976 |
| DYNC1I1 | 5787 | 28882 | 51977 |
| DYNC1I2 | 5788 | 28883 | 51978 |
| DYNC1LI1 | 5789 | 28884 | 51979 |
| DYNC1LI2 | 5790 | 28885 | 51980 |
| DYNC2H1 | 5791 | 28886 | 51981 |
| DYNC2LI1 | 5792 | 28887 | 51982 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| DYNC2LI1 | 5793 | 28888 | 51983 |
| DYNC2LI1 | 5794 | 28889 | 51984 |
| DYNLL1 | 5795 | 28890 | 51985 |
| DYNLL2 | 5796 | 28891 | 51986 |
| DYNLRB1 | 5797 | 28892 | 51987 |
| DYNLRB1 | 5798 | 28893 | 51988 |
| DYNLRB1 | 5799 | 28894 | 51989 |
| DYNLRB2 | 5800 | 28895 | 51990 |
| DYNLT1 | 5801 | 28896 | 51991 |
| DYNLT1 | 5802 | 28897 | 51992 |
| DYNLT3 | 5803 | 28898 | 51993 |
| DYRK1A | 5804 | 28899 | 51994 |
| DYRK1A | 5805 | 28900 | 51995 |
| DYRK1A | 5806 | 28901 | 51996 |
| DYRK1B | 5807 | 28902 | 51997 |
| DYRK2 | 5808 | 28903 | 51998 |
| DYRK3 | 5809 | 28904 | 51999 |
| DYRK4 | 5810 | 28905 | 52000 |
| DYSF | 5811 | 28906 | 52001 |
| DYTN | 5812 | 28907 | 52002 |
| DZANK1 | 5813 | 28908 | 52003 |
| DZIP1 | 5814 | 28909 | 52004 |
| DZIP1L | 5815 | 28910 | 52005 |
| DZIP1L | 5816 | 28911 | 52006 |
| DZIP3 | 5817 | 28912 | 52007 |
| E2F1 | 5818 | 28913 | 52008 |
| E2F2 | 5819 | 28914 | 52009 |
| E2F3 | 5820 | 28915 | 52010 |
| E2F4 | 5821 | 28916 | 52011 |
| E2F5 | 5822 | 28917 | 52012 |
| E2F6 | 5823 | 28918 | 52013 |
| E2F7 | 5824 | 28919 | 52014 |
| E2F8 | 5825 | 28920 | 52015 |
| E4F1 | 5826 | 28921 | 52016 |
| E4F1 | 5827 | 28922 | 52017 |
| EAF1 | 5828 | 28923 | 52018 |
| EAF2 | 5829 | 28924 | 52019 |
| EAPP | 5830 | 28925 | 52020 |
| EAPP | 5831 | 28926 | 52021 |
| EARS2 | 5832 | 28927 | 52022 |
| EARS2 | 5833 | 28928 | 52023 |
| EBAG9 | 5834 | 28929 | 52024 |
| EBF1 | 5835 | 28930 | 52025 |
| EBF1 | 5836 | 28931 | 52026 |
| EBF2 | 5837 | 28932 | 52027 |
| EBF3 | 5838 | 28933 | 52028 |
| EBF4 | 5839 | 28934 | 52029 |
| EBI3 | 5840 | 28935 | 52030 |
| EBLN1 | 5841 | 28936 | 52031 |
| EBLN2 | 5842 | 28937 | 52032 |
| EBNA1BP2 | 5843 | 28938 | 52033 |
| EBP | 5844 | 28939 | 52034 |
| EBPL | 5845 | 28940 | 52035 |
| EBPL | 5846 | 28941 | 52036 |
| ECD | 5847 | 28942 | 52037 |
| ECE1 | 5848 | 28943 | 52038 |
| ECEL1 | 5849 | 28944 | 52039 |
| ECH1 | 5850 | 28945 | 52040 |
| ECHDC1 | 5851 | 28946 | 52041 |
| ECHDC1 | 5852 | 28947 | 52042 |
| ECHDC2 | 5853 | 28948 | 52043 |
| ECHDC3 | 5854 | 28949 | 52044 |
| ECHS1 | 5855 | 28950 | 52045 |
| ECI1 | 5856 | 28951 | 52046 |
| ECI2 | 5857 | 28952 | 52047 |
| ECM1 | 5858 | 28953 | 52048 |
| ECM2 | 5859 | 28954 | 52049 |
| ECM2 | 5860 | 28955 | 52050 |
| ECSCR | 5861 | 28956 | 52051 |
| ECSCR | 5862 | 28957 | 52052 |
| ECSIT | 5863 | 28958 | 52053 |
| ECSIT | 5864 | 28959 | 52054 |
| ECSIT | 5865 | 28960 | 52055 |
| ECT2 | 5866 | 28961 | 52056 |
| ECT2 | 5867 | 28962 | 52057 |
| ECT2L | 5868 | 28963 | 52058 |
| EDA | 5869 | 28964 | 52059 |
| EDA | 5870 | 28965 | 52060 |
| EDA | 5871 | 28966 | 52061 |
| EDA2R | 5872 | 28967 | 52062 |
| EDA2R | 5873 | 28968 | 52063 |
| EDAR | 5874 | 28969 | 52064 |
| EDARADD | 5875 | 28970 | 52065 |
| EDC3 | 5876 | 28971 | 52066 |
| EDC4 | 5877 | 28972 | 52067 |
| EDDM3A | 5878 | 28973 | 52068 |
| EDDM3B | 5879 | 28974 | 52069 |
| EDEM1 | 5880 | 28975 | 52070 |
| EDEM2 | 5881 | 28976 | 52071 |
| EDEM3 | 5882 | 28977 | 52072 |
| EDF1 | 5883 | 28978 | 52073 |
| EDF1 | 5884 | 28979 | 52074 |
| EDF1 | 5885 | 28980 | 52075 |
| EDIL3 | 5886 | 28981 | 52076 |
| EDN1 | 5887 | 28982 | 52077 |
| EDN2 | 5888 | 28983 | 52078 |
| EDN3 | 5889 | 28984 | 52079 |
| EDN3 | 5890 | 28985 | 52080 |
| EDNRA | 5891 | 28986 | 52081 |
| EDNRB | 5892 | 28987 | 52082 |
| EDNRB | 5893 | 28988 | 52083 |
| EDRF1 | 5894 | 28989 | 52084 |
| EEA1 | 5895 | 28990 | 52085 |
| EED | 5896 | 28991 | 52086 |
| EEF1A1 | 5897 | 28992 | 52087 |
| EEF1A2 | 5898 | 28993 | 52088 |
| EEF1AKMT1 | 5899 | 28994 | 52089 |
| EEF1AKMT2 | 5900 | 28995 | 52090 |
| EEF1AKMT2 | 5901 | 28996 | 52091 |
| EEF1AKMT3 | 5902 | 28997 | 52092 |
| EEF1AKMT3 | 5903 | 28998 | 52093 |
| EEF1AKMT4 | 5904 | 28999 | 52094 |
| EEF1AKMT4-ECE2 | 5905 | 29000 | 52095 |
| EEF1B2 | 5906 | 29001 | 52096 |
| EEF1D | 5907 | 29002 | 52097 |
| EEF1E1 | 5908 | 29003 | 52098 |
| EEF1E1 | 5909 | 29004 | 52099 |
| EEF1G | 5910 | 29005 | 52100 |
| EEF2 | 5911 | 29006 | 52101 |
| EEF2K | 5912 | 29007 | 52102 |
| EEF2KMT | 5913 | 29008 | 52103 |
| EEFSEC | 5914 | 29009 | 52104 |
| EEPD1 | 5915 | 29010 | 52105 |
| EFCAB1 | 5916 | 29011 | 52106 |
| EFCAB11 | 5917 | 29012 | 52107 |
| EFCAB11 | 5918 | 29013 | 52108 |
| EFCAB12 | 5919 | 29014 | 52109 |
| EFCAB13 | 5920 | 29015 | 52110 |
| EFCAB13 | 5921 | 29016 | 52111 |
| EFCAB14 | 5922 | 29017 | 52112 |
| EFCAB2 | 5923 | 29018 | 52113 |
| EFCAB2 | 5924 | 29019 | 52114 |
| EFCAB3 | 5925 | 29020 | 52115 |
| EFCAB5 | 5926 | 29021 | 52116 |
| EFCAB5 | 5927 | 29022 | 52117 |
| EFCAB6 | 5928 | 29023 | 52118 |
| EFCAB7 | 5929 | 29024 | 52119 |
| EFCAB8 | 5930 | 29025 | 52120 |
| EFCAB9 | 5931 | 29026 | 52121 |
| EFCC1 | 5932 | 29027 | 52122 |
| EFEMP1 | 5933 | 29028 | 52123 |
| EFEMP2 | 5934 | 29029 | 52124 |
| EFHB | 5935 | 29030 | 52125 |
| EFHC1 | 5936 | 29031 | 52126 |
| EFHC2 | 5937 | 29032 | 52127 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| EFHD1 | 5938 | 29033 | 52128 |
| EFHD2 | 5939 | 29034 | 52129 |
| EFL1 | 5940 | 29035 | 52130 |
| EFNA1 | 5941 | 29036 | 52131 |
| EFNA2 | 5942 | 29037 | 52132 |
| EFNA3 | 5943 | 29038 | 52133 |
| EFNA4 | 5944 | 29039 | 52134 |
| EFNA4 | 5945 | 29040 | 52135 |
| EFNA4 | 5946 | 29041 | 52136 |
| EFNA5 | 5947 | 29042 | 52137 |
| EFNB1 | 5948 | 29043 | 52138 |
| EFNB2 | 5949 | 29044 | 52139 |
| EFNB3 | 5950 | 29045 | 52140 |
| EFR3A | 5951 | 29046 | 52141 |
| EFR3B | 5952 | 29047 | 52142 |
| EFS | 5953 | 29048 | 52143 |
| EFTUD2 | 5954 | 29049 | 52144 |
| EGF | 5955 | 29050 | 52145 |
| EGFL6 | 5956 | 29051 | 52146 |
| EGFL7 | 5957 | 29052 | 52147 |
| EGFL8 | 5958 | 29053 | 52148 |
| EGFLAM | 5959 | 29054 | 52149 |
| EGFR | 5960 | 29055 | 52150 |
| EGFR | 5961 | 29056 | 52151 |
| EGFR | 5962 | 29057 | 52152 |
| EGFR | 5963 | 29058 | 52153 |
| EGFR | 5964 | 29059 | 52154 |
| EGLN1 | 5965 | 29060 | 52155 |
| EGLN2 | 5966 | 29061 | 52156 |
| EGLN3 | 5967 | 29062 | 52157 |
| EGR1 | 5968 | 29063 | 52158 |
| EGR2 | 5969 | 29064 | 52159 |
| EGR3 | 5970 | 29065 | 52160 |
| EGR4 | 5971 | 29066 | 52161 |
| EHBP1 | 5972 | 29067 | 52162 |
| EHBP1L1 | 5973 | 29068 | 52163 |
| EHD1 | 5974 | 29069 | 52164 |
| EHD2 | 5975 | 29070 | 52165 |
| EHD3 | 5976 | 29071 | 52166 |
| EHD4 | 5977 | 29072 | 52167 |
| EHF | 5978 | 29073 | 52168 |
| EHHADH | 5979 | 29074 | 52169 |
| EHMT1 | 5980 | 29075 | 52170 |
| EHMT1 | 5981 | 29076 | 52171 |
| EHMT1 | 5982 | 29077 | 52172 |
| EHMT2 | 5983 | 29078 | 52173 |
| EI24 | 5984 | 29079 | 52174 |
| EI24 | 5985 | 29080 | 52175 |
| EID1 | 5986 | 29081 | 52176 |
| EID2 | 5987 | 29082 | 52177 |
| EID2B | 5988 | 29083 | 52178 |
| EID3 | 5989 | 29084 | 52179 |
| EIF1 | 5990 | 29085 | 52180 |
| EIF1AD | 5991 | 29086 | 52181 |
| EIF1AX | 5992 | 29087 | 52182 |
| EIF1AY | 5993 | 29088 | 52183 |
| EIF1B | 5994 | 29089 | 52184 |
| EIF2A | 5995 | 29090 | 52185 |
| EIF2AK1 | 5996 | 29091 | 52186 |
| EIF2AK2 | 5997 | 29092 | 52187 |
| EIF2AK3 | 5998 | 29093 | 52188 |
| EIF2AK4 | 5999 | 29094 | 52189 |
| EIF2B1 | 6000 | 29095 | 52190 |
| EIF2B2 | 6001 | 29096 | 52191 |
| EIF2B3 | 6002 | 29097 | 52192 |
| EIF2B3 | 6003 | 29098 | 52193 |
| EIF2B3 | 6004 | 29099 | 52194 |
| EIF2B4 | 6005 | 29100 | 52195 |
| EIF2B5 | 6006 | 29101 | 52196 |
| EIF2D | 6007 | 29102 | 52197 |
| EIF2S1 | 6008 | 29103 | 52198 |
| EIF2S2 | 6009 | 29104 | 52199 |
| EIF2S3 | 6010 | 29105 | 52200 |
| EIF3A | 6011 | 29106 | 52201 |
| EIF3B | 6012 | 29107 | 52202 |
| EIF3C | 6013 | 29108 | 52203 |
| EIF3D | 6014 | 29109 | 52204 |
| EIF3E | 6015 | 29110 | 52205 |
| EIF3F | 6016 | 29111 | 52206 |
| EIF3G | 6017 | 29112 | 52207 |
| EIF3H | 6018 | 29113 | 52208 |
| EIF3I | 6019 | 29114 | 52209 |
| EIF3J | 6020 | 29115 | 52210 |
| EIF3K | 6021 | 29116 | 52211 |
| EIF3L | 6022 | 29117 | 52212 |
| EIF3M | 6023 | 29118 | 52213 |
| EIF4A1 | 6024 | 29119 | 52214 |
| EIF4A1 | 6025 | 29120 | 52215 |
| EIF4A2 | 6026 | 29121 | 52216 |
| EIF4A3 | 6027 | 29122 | 52217 |
| EIF4B | 6028 | 29123 | 52218 |
| EIF4E | 6029 | 29124 | 52219 |
| EIF4E1B | 6030 | 29125 | 52220 |
| EIF4E2 | 6031 | 29126 | 52221 |
| EIF4E2 | 6032 | 29127 | 52222 |
| EIF4E2 | 6033 | 29128 | 52223 |
| EIF4E3 | 6034 | 29129 | 52224 |
| EIF4EBP1 | 6035 | 29130 | 52225 |
| EIF4EBP2 | 6036 | 29131 | 52226 |
| EIF4ENIF1 | 6037 | 29132 | 52227 |
| EIF4G1 | 6038 | 29133 | 52228 |
| EIF4G2 | 6039 | 29134 | 52229 |
| EIF4G3 | 6040 | 29135 | 52230 |
| EIF4G3 | 6041 | 29136 | 52231 |
| EIF4H | 6042 | 29137 | 52232 |
| EIF5 | 6043 | 29138 | 52233 |
| EIF5A | 6044 | 29139 | 52234 |
| EIF5A2 | 6045 | 29140 | 52235 |
| EIF5B | 6046 | 29141 | 52236 |
| EIF6 | 6047 | 29142 | 52237 |
| EIPR1 | 6048 | 29143 | 52238 |
| ELAC1 | 6049 | 29144 | 52239 |
| ELAC2 | 6050 | 29145 | 52240 |
| ELANE | 6051 | 29146 | 52241 |
| ELAVL1 | 6052 | 29147 | 52242 |
| ELAVL2 | 6053 | 29148 | 52243 |
| ELAVL3 | 6054 | 29149 | 52244 |
| ELAVL4 | 6055 | 29150 | 52245 |
| ELAVL4 | 6056 | 29151 | 52246 |
| ELF1 | 6057 | 29152 | 52247 |
| ELF2 | 6058 | 29153 | 52248 |
| ELF3 | 6059 | 29154 | 52249 |
| ELF4 | 6060 | 29155 | 52250 |
| ELF5 | 6061 | 29156 | 52251 |
| ELFN1 | 6062 | 29157 | 52252 |
| ELFN2 | 6063 | 29158 | 52253 |
| ELK1 | 6064 | 29159 | 52254 |
| ELK1 | 6065 | 29160 | 52255 |
| ELK3 | 6066 | 29161 | 52256 |
| ELK4 | 6067 | 29162 | 52257 |
| ELK4 | 6068 | 29163 | 52258 |
| ELL | 6069 | 29164 | 52259 |
| ELL2 | 6070 | 29165 | 52260 |
| ELL3 | 6071 | 29166 | 52261 |
| ELMO1 | 6072 | 29167 | 52262 |
| ELMO2 | 6073 | 29168 | 52263 |
| ELMO3 | 6074 | 29169 | 52264 |
| ELMOD1 | 6075 | 29170 | 52265 |
| ELMOD2 | 6076 | 29171 | 52266 |
| ELMOD3 | 6077 | 29172 | 52267 |
| ELMSAN1 | 6078 | 29173 | 52268 |
| ELN | 6079 | 29174 | 52269 |
| ELOA | 6080 | 29175 | 52270 |
| ELOA2 | 6081 | 29176 | 52271 |
| ELOA3C | 6082 | 29177 | 52272 |
| ELOB | 6083 | 29178 | 52273 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| ELOB | 6084 | 29179 | 52274 |
| ELOC | 6085 | 29180 | 52275 |
| ELOF1 | 6086 | 29181 | 52276 |
| ELOVL1 | 6087 | 29182 | 52277 |
| ELOVL2 | 6088 | 29183 | 52278 |
| ELOVL3 | 6089 | 29184 | 52279 |
| ELOVL4 | 6090 | 29185 | 52280 |
| ELOVL5 | 6091 | 29186 | 52281 |
| ELOVL5 | 6092 | 29187 | 52282 |
| ELOVL6 | 6093 | 29188 | 52283 |
| ELOVL7 | 6094 | 29189 | 52284 |
| ELP1 | 6095 | 29190 | 52285 |
| ELP2 | 6096 | 29191 | 52286 |
| ELP3 | 6097 | 29192 | 52287 |
| ELP4 | 6098 | 29193 | 52288 |
| ELP4 | 6099 | 29194 | 52289 |
| ELP4 | 6100 | 29195 | 52290 |
| ELP5 | 6101 | 29196 | 52291 |
| ELP5 | 6102 | 29197 | 52292 |
| ELP6 | 6103 | 29198 | 52293 |
| ELSPBP1 | 6104 | 29199 | 52294 |
| EMB | 6105 | 29200 | 52295 |
| EMC1 | 6106 | 29201 | 52296 |
| EMC10 | 6107 | 29202 | 52297 |
| EMC10 | 6108 | 29203 | 52298 |
| EMC2 | 6109 | 29204 | 52299 |
| EMC2 | 6110 | 29205 | 52300 |
| EMC3 | 6111 | 29206 | 52301 |
| EMC4 | 6112 | 29207 | 52302 |
| EMC4 | 6113 | 29208 | 52303 |
| EMC6 | 6114 | 29209 | 52304 |
| EMC7 | 6115 | 29210 | 52305 |
| EMC8 | 6116 | 29211 | 52306 |
| EMC8 | 6117 | 29212 | 52307 |
| EMC9 | 6118 | 29213 | 52308 |
| EMCN | 6119 | 29214 | 52309 |
| EMD | 6120 | 29215 | 52310 |
| EME1 | 6121 | 29216 | 52311 |
| EME2 | 6122 | 29217 | 52312 |
| EMG1 | 6123 | 29218 | 52313 |
| EMID1 | 6124 | 29219 | 52314 |
| EMILIN1 | 6125 | 29220 | 52315 |
| EMILIN2 | 6126 | 29221 | 52316 |
| EMILIN3 | 6127 | 29222 | 52317 |
| EML1 | 6128 | 29223 | 52318 |
| EML2 | 6129 | 29224 | 52319 |
| EML3 | 6130 | 29225 | 52320 |
| EML3 | 6131 | 29226 | 52321 |
| EML4 | 6132 | 29227 | 52322 |
| EML5 | 6133 | 29228 | 52323 |
| EML6 | 6134 | 29229 | 52324 |
| EMP1 | 6135 | 29230 | 52325 |
| EMP2 | 6136 | 29231 | 52326 |
| EMP3 | 6137 | 29232 | 52327 |
| EMSY | 6138 | 29233 | 52328 |
| EMX1 | 6139 | 29234 | 52329 |
| EMX2 | 6140 | 29235 | 52330 |
| EMX2 | 6141 | 29236 | 52331 |
| EN1 | 6142 | 29237 | 52332 |
| EN2 | 6143 | 29238 | 52333 |
| ENAH | 6144 | 29239 | 52334 |
| ENAM | 6145 | 29240 | 52335 |
| ENC1 | 6146 | 29241 | 52336 |
| ENDOD1 | 6147 | 29242 | 52337 |
| ENDOG | 6148 | 29243 | 52338 |
| ENDOU | 6149 | 29244 | 52339 |
| ENDOV | 6150 | 29245 | 52340 |
| ENDOV | 6151 | 29246 | 52341 |
| ENDOV | 6152 | 29247 | 52342 |
| ENG | 6153 | 29248 | 52343 |
| ENG | 6154 | 29249 | 52344 |
| ENGASE | 6155 | 29250 | 52345 |
| ENHO | 6156 | 29251 | 52346 |
| ENKD1 | 6157 | 29252 | 52347 |
| ENKUR | 6158 | 29253 | 52348 |
| ENO1 | 6159 | 29254 | 52349 |
| ENO2 | 6160 | 29255 | 52350 |
| ENO3 | 6161 | 29256 | 52351 |
| ENO4 | 6162 | 29257 | 52352 |
| ENOPH1 | 6163 | 29258 | 52353 |
| ENOSF1 | 6164 | 29259 | 52354 |
| ENOX1 | 6165 | 29260 | 52355 |
| ENOX2 | 6166 | 29261 | 52356 |
| ENPEP | 6167 | 29262 | 52357 |
| ENPP1 | 6168 | 29263 | 52358 |
| ENPP2 | 6169 | 29264 | 52359 |
| ENPP3 | 6170 | 29265 | 52360 |
| ENPP4 | 6171 | 29266 | 52361 |
| ENPP5 | 6172 | 29267 | 52362 |
| ENPP6 | 6173 | 29268 | 52363 |
| ENPP7 | 6174 | 29269 | 52364 |
| ENSA | 6175 | 29270 | 52365 |
| ENSA | 6176 | 29271 | 52366 |
| ENSA | 6177 | 29272 | 52367 |
| ENTHD1 | 6178 | 29273 | 52368 |
| ENTPD1 | 6179 | 29274 | 52369 |
| ENTPD1 | 6180 | 29275 | 52370 |
| ENTPD2 | 6181 | 29276 | 52371 |
| ENTPD3 | 6182 | 29277 | 52372 |
| ENTPD3 | 6183 | 29278 | 52373 |
| ENTPD4 | 6184 | 29279 | 52374 |
| ENTPD5 | 6185 | 29280 | 52375 |
| ENTPD5 | 6186 | 29281 | 52376 |
| ENTPD5 | 6187 | 29282 | 52377 |
| ENTPD6 | 6188 | 29283 | 52378 |
| ENTPD6 | 6189 | 29284 | 52379 |
| ENTPD7 | 6190 | 29285 | 52380 |
| ENTPD8 | 6191 | 29286 | 52381 |
| ENY2 | 6192 | 29287 | 52382 |
| EOGT | 6193 | 29288 | 52383 |
| EOMES | 6194 | 29289 | 52384 |
| EP300 | 6195 | 29290 | 52385 |
| EP400 | 6196 | 29291 | 52386 |
| EPAS1 | 6197 | 29292 | 52387 |
| EPB41 | 6198 | 29293 | 52388 |
| EPB41 | 6199 | 29294 | 52389 |
| EPB41L1 | 6200 | 29295 | 52390 |
| EPB41L2 | 6201 | 29296 | 52391 |
| EPB41L3 | 6202 | 29297 | 52392 |
| EPB41L3 | 6203 | 29298 | 52393 |
| EPB41L4A | 6204 | 29299 | 52394 |
| EPB41L4A | 6205 | 29300 | 52395 |
| EPB41L4A | 6206 | 29301 | 52396 |
| EPB41L4B | 6207 | 29302 | 52397 |
| EPB41L4B | 6208 | 29303 | 52398 |
| EPB41L5 | 6209 | 29304 | 52399 |
| EPB41L5 | 6210 | 29305 | 52400 |
| EPB41L5 | 6211 | 29306 | 52401 |
| EPB42 | 6212 | 29307 | 52402 |
| EPC1 | 6213 | 29308 | 52403 |
| EPC2 | 6214 | 29309 | 52404 |
| EPCAM | 6215 | 29310 | 52405 |
| EPDR1 | 6216 | 29311 | 52406 |
| EPDR1 | 6217 | 29312 | 52407 |
| EPG5 | 6218 | 29313 | 52408 |
| EPGN | 6219 | 29314 | 52409 |
| EPHA1 | 6220 | 29315 | 52410 |
| EPHA10 | 6221 | 29316 | 52411 |
| EPHA10 | 6222 | 29317 | 52412 |
| EPHA2 | 6223 | 29318 | 52413 |
| EPHA3 | 6224 | 29319 | 52414 |
| EPHA3 | 6225 | 29320 | 52415 |
| EPHA4 | 6226 | 29321 | 52416 |
| EPHA5 | 6227 | 29322 | 52417 |
| EPHA5 | 6228 | 29323 | 52418 |
| EPHA6 | 6229 | 29324 | 52419 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| EPHA6 | 6230 | 29325 | 52420 |
| EPHA6 | 6231 | 29326 | 52421 |
| EPHA7 | 6232 | 29327 | 52422 |
| EPHA7 | 6233 | 29328 | 52423 |
| EPHA8 | 6234 | 29329 | 52424 |
| EPHA8 | 6235 | 29330 | 52425 |
| EPHB1 | 6236 | 29331 | 52426 |
| EPHB2 | 6237 | 29332 | 52427 |
| EPHB2 | 6238 | 29333 | 52428 |
| EPHB3 | 6239 | 29334 | 52429 |
| EPHB4 | 6240 | 29335 | 52430 |
| EPHB6 | 6241 | 29336 | 52431 |
| EPHX1 | 6242 | 29337 | 52432 |
| EPHX2 | 6243 | 29338 | 52433 |
| EPHX3 | 6244 | 29339 | 52434 |
| EPHX4 | 6245 | 29340 | 52435 |
| EPM2A | 6246 | 29341 | 52436 |
| EPM2A | 6247 | 29342 | 52437 |
| EPM2AIP1 | 6248 | 29343 | 52438 |
| EPN1 | 6249 | 29344 | 52439 |
| EPN2 | 6250 | 29345 | 52440 |
| EPN3 | 6251 | 29346 | 52441 |
| EPO | 6252 | 29347 | 52442 |
| EPOP | 6253 | 29348 | 52443 |
| EPOR | 6254 | 29349 | 52444 |
| EPPIN | 6255 | 29350 | 52445 |
| EPPIN | 6256 | 29351 | 52446 |
| EPPIN-WFDC6 | 6257 | 29352 | 52447 |
| EPPK1 | 6258 | 29353 | 52448 |
| EPRS | 6259 | 29354 | 52449 |
| EPS15 | 6260 | 29355 | 52450 |
| EPS15L1 | 6261 | 29356 | 52451 |
| EPS15L1 | 6262 | 29357 | 52452 |
| EPS15L1 | 6263 | 29358 | 52453 |
| EPS15L1 | 6264 | 29359 | 52454 |
| EPS8 | 6265 | 29360 | 52455 |
| EPS8L1 | 6266 | 29361 | 52456 |
| EPS8L2 | 6267 | 29362 | 52457 |
| EPS8L3 | 6268 | 29363 | 52458 |
| EPSTI1 | 6269 | 29364 | 52459 |
| EPSTI1 | 6270 | 29365 | 52460 |
| EPX | 6271 | 29366 | 52461 |
| EPYC | 6272 | 29367 | 52462 |
| EQTN | 6273 | 29368 | 52463 |
| ERAL1 | 6274 | 29369 | 52464 |
| ERAP1 | 6275 | 29370 | 52465 |
| ERAP1 | 6276 | 29371 | 52466 |
| ERAP2 | 6277 | 29372 | 52467 |
| ERAP2 | 6278 | 29373 | 52468 |
| ERAS | 6279 | 29374 | 52469 |
| ERBB2 | 6280 | 29375 | 52470 |
| ERBB2 | 6281 | 29376 | 52471 |
| ERBB2 | 6282 | 29377 | 52472 |
| ERBB3 | 6283 | 29378 | 52473 |
| ERBB3 | 6284 | 29379 | 52474 |
| ERBB4 | 6285 | 29380 | 52475 |
| ERBIN | 6286 | 29381 | 52476 |
| ERC1 | 6287 | 29382 | 52477 |
| ERC1 | 6288 | 29383 | 52478 |
| ERC2 | 6289 | 29384 | 52479 |
| ERCC1 | 6290 | 29385 | 52480 |
| ERCC1 | 6291 | 29386 | 52481 |
| ERCC2 | 6292 | 29387 | 52482 |
| ERCC2 | 6293 | 29388 | 52483 |
| ERCC3 | 6294 | 29389 | 52484 |
| ERCC4 | 6295 | 29390 | 52485 |
| ERCC5 | 6296 | 29391 | 52486 |
| ERCC6 | 6297 | 29392 | 52487 |
| ERCC6L | 6298 | 29393 | 52488 |
| ERCC6L2 | 6299 | 29394 | 52489 |
| ERCC6L2 | 6300 | 29395 | 52490 |
| ERCC8 | 6301 | 29396 | 52491 |
| ERCC8 | 6302 | 29397 | 52492 |
| EREG | 6303 | 29398 | 52493 |
| ERF | 6304 | 29399 | 52494 |
| ERFE | 6305 | 29400 | 52495 |
| ERG | 6306 | 29401 | 52496 |
| ERG | 6307 | 29402 | 52497 |
| ERG | 6308 | 29403 | 52498 |
| ERG28 | 6309 | 29404 | 52499 |
| ERGIC1 | 6310 | 29405 | 52500 |
| ERGIC2 | 6311 | 29406 | 52501 |
| ERGIC3 | 6312 | 29407 | 52502 |
| ERH | 6313 | 29408 | 52503 |
| ERI1 | 6314 | 29409 | 52504 |
| ERI2 | 6315 | 29410 | 52505 |
| ERI2 | 6316 | 29411 | 52506 |
| ERI3 | 6317 | 29412 | 52507 |
| ERI3 | 6318 | 29413 | 52508 |
| ERICH1 | 6319 | 29414 | 52509 |
| ERICH1 | 6320 | 29415 | 52510 |
| ERICH2 | 6321 | 29416 | 52511 |
| ERICH2 | 6322 | 29417 | 52512 |
| ERICH3 | 6323 | 29418 | 52513 |
| ERICH4 | 6324 | 29419 | 52514 |
| ERICH5 | 6325 | 29420 | 52515 |
| ERICH6 | 6326 | 29421 | 52516 |
| ERICH6B | 6327 | 29422 | 52517 |
| ERLEC1 | 6328 | 29423 | 52518 |
| ERLIN1 | 6329 | 29424 | 52519 |
| ERLIN2 | 6330 | 29425 | 52520 |
| ERLIN2 | 6331 | 29426 | 52521 |
| ERMAP | 6332 | 29427 | 52522 |
| ERMARD | 6333 | 29428 | 52523 |
| ERMN | 6334 | 29429 | 52524 |
| ERMP1 | 6335 | 29430 | 52525 |
| ERN1 | 6336 | 29431 | 52526 |
| ERN2 | 6337 | 29432 | 52527 |
| ERO1A | 6338 | 29433 | 52528 |
| ERO1B | 6339 | 29434 | 52529 |
| ERP27 | 6340 | 29435 | 52530 |
| ERP29 | 6341 | 29436 | 52531 |
| ERP44 | 6342 | 29437 | 52532 |
| ERRFI1 | 6343 | 29438 | 52533 |
| ERV3-1 | 6344 | 29439 | 52534 |
| ERVFRD-1 | 6345 | 29440 | 52535 |
| ERVH48-1 | 6346 | 29441 | 52536 |
| ERVMER34-1 | 6347 | 29442 | 52537 |
| ERW-1 | 6348 | 29443 | 52538 |
| ERW-2 | 6349 | 29444 | 52539 |
| ERVW-1 | 6350 | 29445 | 52540 |
| ESAM | 6351 | 29446 | 52541 |
| ESCO1 | 6352 | 29447 | 52542 |
| ESCO2 | 6353 | 29448 | 52543 |
| ESD | 6354 | 29449 | 52544 |
| ESF1 | 6355 | 29450 | 52545 |
| ESM1 | 6356 | 29451 | 52546 |
| ESPL1 | 6357 | 29452 | 52547 |
| ESPN | 6358 | 29453 | 52548 |
| ESPNL | 6359 | 29454 | 52549 |
| ESR1 | 6360 | 29455 | 52550 |
| ESR1 | 6361 | 29456 | 52551 |
| ESR2 | 6362 | 29457 | 52552 |
| ESR2 | 6363 | 29458 | 52553 |
| ESR2 | 6364 | 29459 | 52554 |
| ESR2 | 6365 | 29460 | 52555 |
| ESRP1 | 6366 | 29461 | 52556 |
| ESRP1 | 6367 | 29462 | 52557 |
| ESRP1 | 6368 | 29463 | 52558 |
| ESRP2 | 6369 | 29464 | 52559 |
| ESRRA | 6370 | 29465 | 52560 |
| ESRRB | 6371 | 29466 | 52561 |
| ESRRG | 6372 | 29467 | 52562 |
| ESS2 | 6373 | 29468 | 52563 |
| ESX1 | 6374 | 29469 | 52564 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| ESYT1 | 6375 | 29470 | 52565 |
| ESYT2 | 6376 | 29471 | 52566 |
| ESYT3 | 6377 | 29472 | 52567 |
| ESYT3 | 6378 | 29473 | 52568 |
| ETAA1 | 6379 | 29474 | 52569 |
| ETF1 | 6380 | 29475 | 52570 |
| ETFA | 6381 | 29476 | 52571 |
| ETFB | 6382 | 29477 | 52572 |
| ETFBKMT | 6383 | 29478 | 52573 |
| ETFDH | 6384 | 29479 | 52574 |
| ETFRF1 | 6385 | 29480 | 52575 |
| ETHE1 | 6386 | 29481 | 52576 |
| ETNK1 | 6387 | 29482 | 52577 |
| ETNK1 | 6388 | 29483 | 52578 |
| ETNK2 | 6389 | 29484 | 52579 |
| ETNK2 | 6390 | 29485 | 52580 |
| ETNPPL | 6391 | 29486 | 52581 |
| ETS1 | 6392 | 29487 | 52582 |
| ETS2 | 6393 | 29488 | 52583 |
| ETV1 | 6394 | 29489 | 52584 |
| ETV2 | 6395 | 29490 | 52585 |
| ETV3 | 6396 | 29491 | 52586 |
| ETV3 | 6397 | 29492 | 52587 |
| ETV3L | 6398 | 29493 | 52588 |
| ETV4 | 6399 | 29494 | 52589 |
| ETV5 | 6400 | 29495 | 52590 |
| ETV6 | 6401 | 29496 | 52591 |
| ETV7 | 6402 | 29497 | 52592 |
| ETV7 | 6403 | 29498 | 52593 |
| EVA1A | 6404 | 29499 | 52594 |
| EVA1B | 6405 | 29500 | 52595 |
| EVA1C | 6406 | 29501 | 52596 |
| EVC | 6407 | 29502 | 52597 |
| EVC | 6408 | 29503 | 52598 |
| EVC2 | 6409 | 29504 | 52599 |
| EVI2A | 6410 | 29505 | 52600 |
| EVI2B | 6411 | 29506 | 52601 |
| EVI5 | 6412 | 29507 | 52602 |
| EVI5 | 6413 | 29508 | 52603 |
| EVI5L | 6414 | 29509 | 52604 |
| EVL | 6415 | 29510 | 52605 |
| EVPL | 6416 | 29511 | 52606 |
| EVPLL | 6417 | 29512 | 52607 |
| EVX1 | 6418 | 29513 | 52608 |
| EVX2 | 6419 | 29514 | 52609 |
| EWSR1 | 6420 | 29515 | 52610 |
| EWSR1 | 6421 | 29516 | 52611 |
| EXD1 | 6422 | 29517 | 52612 |
| EXD2 | 6423 | 29518 | 52613 |
| EXD3 | 6424 | 29519 | 52614 |
| EXD3 | 6425 | 29520 | 52615 |
| EXO1 | 6426 | 29521 | 52616 |
| EXO1 | 6427 | 29522 | 52617 |
| EXO5 | 6428 | 29523 | 52618 |
| EXOC1 | 6429 | 29524 | 52619 |
| EXOC1L | 6430 | 29525 | 52620 |
| EXOC2 | 6431 | 29526 | 52621 |
| EXOC3 | 6432 | 29527 | 52622 |
| EXOC3L1 | 6433 | 29528 | 52623 |
| EXOC3L2 | 6434 | 29529 | 52624 |
| EXOC3L4 | 6435 | 29530 | 52625 |
| EXOC4 | 6436 | 29531 | 52626 |
| EXOC4 | 6437 | 29532 | 52627 |
| EXOC5 | 6438 | 29533 | 52628 |
| EXOC6 | 6439 | 29534 | 52629 |
| EXOC6B | 6440 | 29535 | 52630 |
| EXOC6B | 6441 | 29536 | 52631 |
| EXOC7 | 6442 | 29537 | 52632 |
| EXOC7 | 6443 | 29538 | 52633 |
| EXOC8 | 6444 | 29539 | 52634 |
| EXOG | 6445 | 29540 | 52635 |
| EXOSC1 | 6446 | 29541 | 52636 |
| EXOSC1 | 6447 | 29542 | 52637 |
| EXOSC10 | 6448 | 29543 | 52638 |
| EXOSC2 | 6449 | 29544 | 52639 |
| EXOSC3 | 6450 | 29545 | 52640 |
| EXOSC3 | 6451 | 29546 | 52641 |
| EXOSC4 | 6452 | 29547 | 52642 |
| EXOSC5 | 6453 | 29548 | 52643 |
| EXOSC6 | 6454 | 29549 | 52644 |
| EXOSC7 | 6455 | 29550 | 52645 |
| EXOSC8 | 6456 | 29551 | 52646 |
| EXOSC9 | 6457 | 29552 | 52647 |
| EXPH5 | 6458 | 29553 | 52648 |
| EXT1 | 6459 | 29554 | 52649 |
| EXT2 | 6460 | 29555 | 52650 |
| EXTL1 | 6461 | 29556 | 52651 |
| EXTL2 | 6462 | 29557 | 52652 |
| EXTL3 | 6463 | 29558 | 52653 |
| EYA1 | 6464 | 29559 | 52654 |
| EYA2 | 6465 | 29560 | 52655 |
| EYA3 | 6466 | 29561 | 52656 |
| EYA3 | 6467 | 29562 | 52657 |
| EYA4 | 6468 | 29563 | 52658 |
| EYS | 6469 | 29564 | 52659 |
| EYS | 6470 | 29565 | 52660 |
| EYS | 6471 | 29566 | 52661 |
| EZH1 | 6472 | 29567 | 52662 |
| EZH2 | 6473 | 29568 | 52663 |
| EZR | 6474 | 29569 | 52664 |
| F10 | 6475 | 29570 | 52665 |
| F10 | 6476 | 29571 | 52666 |
| F11 | 6477 | 29572 | 52667 |
| F11R | 6478 | 29573 | 52668 |
| F12 | 6479 | 29574 | 52669 |
| F13A1 | 6480 | 29575 | 52670 |
| F13B | 6481 | 29576 | 52671 |
| F2 | 6482 | 29577 | 52672 |
| F2R | 6483 | 29578 | 52673 |
| F2RL1 | 6484 | 29579 | 52674 |
| F2RL2 | 6485 | 29580 | 52675 |
| F2RL3 | 6486 | 29581 | 52676 |
| F3 | 6487 | 29582 | 52677 |
| F3 | 6488 | 29583 | 52678 |
| F5 | 6489 | 29584 | 52679 |
| F7 | 6490 | 29585 | 52680 |
| F8 | 6491 | 29586 | 52681 |
| F8A3 | 6492 | 29587 | 52682 |
| F9 | 6493 | 29588 | 52683 |
| FA2H | 6494 | 29589 | 52684 |
| FAAH | 6495 | 29590 | 52685 |
| FAAH2 | 6496 | 29591 | 52686 |
| FAAP100 | 6497 | 29592 | 52687 |
| FAAP20 | 6498 | 29593 | 52688 |
| FAAP20 | 6499 | 29594 | 52689 |
| FAAP20 | 6500 | 29595 | 52690 |
| FAAP20 | 6501 | 29596 | 52691 |
| FAAP20 | 6502 | 29597 | 52692 |
| FAAP20 | 6503 | 29598 | 52693 |
| FAAP20 | 6504 | 29599 | 52694 |
| FAAP24 | 6505 | 29600 | 52695 |
| FABP1 | 6506 | 29601 | 52696 |
| FABP12 | 6507 | 29602 | 52697 |
| FABP2 | 6508 | 29603 | 52698 |
| FABP3 | 6509 | 29604 | 52699 |
| FABP4 | 6510 | 29605 | 52700 |
| FABP5 | 6511 | 29606 | 52701 |
| FABP6 | 6512 | 29607 | 52702 |
| FABP7 | 6513 | 29608 | 52703 |
| FABP7 | 6514 | 29609 | 52704 |
| FABP9 | 6515 | 29610 | 52705 |
| FADD | 6516 | 29611 | 52706 |
| FADS1 | 6517 | 29612 | 52707 |
| FADS2 | 6518 | 29613 | 52708 |
| FADS3 | 6519 | 29614 | 52709 |
| FADS6 | 6520 | 29615 | 52710 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| FAF1 | 6521 | 29616 | 52711 |
| FAF2 | 6522 | 29617 | 52712 |
| FAH | 6523 | 29618 | 52713 |
| FAHD1 | 6524 | 29619 | 52714 |
| FAHD1 | 6525 | 29620 | 52715 |
| FAHD1 | 6526 | 29621 | 52716 |
| FAHD2B | 6527 | 29622 | 52717 |
| FAHD2B | 6528 | 29623 | 52718 |
| FAIM | 6529 | 29624 | 52719 |
| FAIM2 | 6530 | 29625 | 52720 |
| FAM102A | 6531 | 29626 | 52721 |
| FAM102B | 6532 | 29627 | 52722 |
| FAM103A1 | 6533 | 29628 | 52723 |
| FAM104A | 6534 | 29629 | 52724 |
| FAM104A | 6535 | 29630 | 52725 |
| FAM104B | 6536 | 29631 | 52726 |
| FAM104B | 6537 | 29632 | 52727 |
| FAM104B | 6538 | 29633 | 52728 |
| FAM105A | 6539 | 29634 | 52729 |
| FAM106CP | 6540 | 29635 | 52730 |
| FAM107A | 6541 | 29636 | 52731 |
| FAM107B | 6542 | 29637 | 52732 |
| FAM107B | 6543 | 29638 | 52733 |
| FAM109A | 6544 | 29639 | 52734 |
| FAM109B | 6545 | 29640 | 52735 |
| FAM110A | 6546 | 29641 | 52736 |
| FAM110B | 6547 | 29642 | 52737 |
| FAM110C | 6548 | 29643 | 52738 |
| FAM110D | 6549 | 29644 | 52739 |
| FAM111A | 6550 | 29645 | 52740 |
| FAM111B | 6551 | 29646 | 52741 |
| FAM114A1 | 6552 | 29647 | 52742 |
| FAM114A1 | 6553 | 29648 | 52743 |
| FAM114A1 | 6554 | 29649 | 52744 |
| FAM114A2 | 6555 | 29650 | 52745 |
| FAM117A | 6556 | 29651 | 52746 |
| FAM117B | 6557 | 29652 | 52747 |
| FAM118A | 6558 | 29653 | 52748 |
| FAM118B | 6559 | 29654 | 52749 |
| FAM120A | 6560 | 29655 | 52750 |
| FAM120A | 6561 | 29656 | 52751 |
| FAM120A | 6562 | 29657 | 52752 |
| FAM120AOS | 6563 | 29658 | 52753 |
| FAM120B | 6564 | 29659 | 52754 |
| FAM120C | 6565 | 29660 | 52755 |
| FAM120C | 6566 | 29661 | 52756 |
| FAM120C | 6567 | 29662 | 52757 |
| FAM122A | 6568 | 29663 | 52758 |
| FAM122B | 6569 | 29664 | 52759 |
| FAM122B | 6570 | 29665 | 52760 |
| FAM122C | 6571 | 29666 | 52761 |
| FAM122C | 6572 | 29667 | 52762 |
| FAM122C | 6573 | 29668 | 52763 |
| FAM122C | 6574 | 29669 | 52764 |
| FAM122C | 6575 | 29670 | 52765 |
| FAM122C | 6576 | 29671 | 52766 |
| FAM124A | 6577 | 29672 | 52767 |
| FAM124A | 6578 | 29673 | 52768 |
| FAM124B | 6579 | 29674 | 52769 |
| FAM124B | 6580 | 29675 | 52770 |
| FAM126A | 6581 | 29676 | 52771 |
| FAM126B | 6582 | 29677 | 52772 |
| FAM129A | 6583 | 29678 | 52773 |
| FAM129B | 6584 | 29679 | 52774 |
| FAM129C | 6585 | 29680 | 52775 |
| FAM129C | 6586 | 29681 | 52776 |
| FAM131A | 6587 | 29682 | 52777 |
| FAM131B | 6588 | 29683 | 52778 |
| FAM131C | 6589 | 29684 | 52779 |
| FAM133A | 6590 | 29685 | 52780 |
| FAM133B | 6591 | 29686 | 52781 |
| FAM135A | 6592 | 29687 | 52782 |
| FAM135B | 6593 | 29688 | 52783 |
| FAM136A | 6594 | 29689 | 52784 |
| FAM13A | 6595 | 29690 | 52785 |
| FAM13B | 6596 | 29691 | 52786 |
| FAM13C | 6597 | 29692 | 52787 |
| FAM13C | 6598 | 29693 | 52788 |
| FAM149A | 6599 | 29694 | 52789 |
| FAM149B1 | 6600 | 29695 | 52790 |
| FAM151A | 6601 | 29696 | 52791 |
| FAM151B | 6602 | 29697 | 52792 |
| FAM153B | 6603 | 29698 | 52793 |
| FAM155A | 6604 | 29699 | 52794 |
| FAM155B | 6605 | 29700 | 52795 |
| FAM156B | 6606 | 29701 | 52796 |
| FAM159A | 6607 | 29702 | 52797 |
| FAM159B | 6608 | 29703 | 52798 |
| FAM160A1 | 6609 | 29704 | 52799 |
| FAM160A2 | 6610 | 29705 | 52800 |
| FAM160B1 | 6611 | 29706 | 52801 |
| FAM160B1 | 6612 | 29707 | 52802 |
| FAM160B2 | 6613 | 29708 | 52803 |
| FAM161A | 6614 | 29709 | 52804 |
| FAM161B | 6615 | 29710 | 52805 |
| FAM162A | 6616 | 29711 | 52806 |
| FAM162B | 6617 | 29712 | 52807 |
| FAM163A | 6618 | 29713 | 52808 |
| FAM163A | 6619 | 29714 | 52809 |
| FAM163B | 6620 | 29715 | 52810 |
| FAM166A | 6621 | 29716 | 52811 |
| FAM166B | 6622 | 29717 | 52812 |
| FAM166B | 6623 | 29718 | 52813 |
| FAM166B | 6624 | 29719 | 52814 |
| FAM167A | 6625 | 29720 | 52815 |
| FAM167B | 6626 | 29721 | 52816 |
| FAM168A | 6627 | 29722 | 52817 |
| FAM168B | 6628 | 29723 | 52818 |
| FAM169A | 6629 | 29724 | 52819 |
| FAM169B | 6630 | 29725 | 52820 |
| FAM170A | 6631 | 29726 | 52821 |
| FAM170B | 6632 | 29727 | 52822 |
| FAM171A1 | 6633 | 29728 | 52823 |
| FAM171A2 | 6634 | 29729 | 52824 |
| FAM171B | 6635 | 29730 | 52825 |
| FAM172A | 6636 | 29731 | 52826 |
| FAM173A | 6637 | 29732 | 52827 |
| FAM173B | 6638 | 29733 | 52828 |
| FAM173B | 6639 | 29734 | 52829 |
| FAM174A | 6640 | 29735 | 52830 |
| FAM174B | 6641 | 29736 | 52831 |
| FAM177A1 | 6642 | 29737 | 52832 |
| FAM177B | 6643 | 29738 | 52833 |
| FAM178B | 6644 | 29739 | 52834 |
| FAM180A | 6645 | 29740 | 52835 |
| FAM180B | 6646 | 29741 | 52836 |
| FAM181A | 6647 | 29742 | 52837 |
| FAM181B | 6648 | 29743 | 52838 |
| FAM183A | 6649 | 29744 | 52839 |
| FAM184A | 6650 | 29745 | 52840 |
| FAM184B | 6651 | 29746 | 52841 |
| FAM185A | 6652 | 29747 | 52842 |
| FAM186A | 6653 | 29748 | 52843 |
| FAM186B | 6654 | 29749 | 52844 |
| FAM187A | 6655 | 29750 | 52845 |
| FAM187B | 6656 | 29751 | 52846 |
| FAM189A1 | 6657 | 29752 | 52847 |
| FAM189A2 | 6658 | 29753 | 52848 |
| FAM189B | 6659 | 29754 | 52849 |
| FAM192A | 6660 | 29755 | 52850 |
| FAM193A | 6661 | 29756 | 52851 |
| FAM193A | 6662 | 29757 | 52852 |
| FAM193B | 6663 | 29758 | 52853 |
| FAM196A | 6664 | 29759 | 52854 |
| FAM196B | 6665 | 29760 | 52855 |
| FAM198A | 6666 | 29761 | 52856 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| FAM198B | 6667 | 29762 | 52857 |
| FAM199X | 6668 | 29763 | 52858 |
| FAM19A1 | 6669 | 29764 | 52859 |
| FAM19A2 | 6670 | 29765 | 52860 |
| FAM19A3 | 6671 | 29766 | 52861 |
| FAM19A3 | 6672 | 29767 | 52862 |
| FAM19A4 | 6673 | 29768 | 52863 |
| FAM19A5 | 6674 | 29769 | 52864 |
| FAM200A | 6675 | 29770 | 52865 |
| FAM200B | 6676 | 29771 | 52866 |
| FAM204A | 6677 | 29772 | 52867 |
| FAM205A | 6678 | 29773 | 52868 |
| FAM205C | 6679 | 29774 | 52869 |
| FAM206A | 6680 | 29775 | 52870 |
| FAM207A | 6681 | 29776 | 52871 |
| FAM208A | 6682 | 29777 | 52872 |
| FAM208A | 6683 | 29778 | 52873 |
| FAM208B | 6684 | 29779 | 52874 |
| FAM209B | 6685 | 29780 | 52875 |
| FAM20A | 6686 | 29781 | 52876 |
| FAM20B | 6687 | 29782 | 52877 |
| FAM20C | 6688 | 29783 | 52878 |
| FAM210A | 6689 | 29784 | 52879 |
| FAM210B | 6690 | 29785 | 52880 |
| FAM212A | 6691 | 29786 | 52881 |
| FAM212B | 6692 | 29787 | 52882 |
| FAM213A | 6693 | 29788 | 52883 |
| FAM213B | 6694 | 29789 | 52884 |
| FAM213B | 6695 | 29790 | 52885 |
| FAM214A | 6696 | 29791 | 52886 |
| FAM214B | 6697 | 29792 | 52887 |
| FAM216A | 6698 | 29793 | 52888 |
| FAM216B | 6699 | 29794 | 52889 |
| FAM217A | 6700 | 29795 | 52890 |
| FAM217B | 6701 | 29796 | 52891 |
| FAM218A | 6702 | 29797 | 52892 |
| FAM219A | 6703 | 29798 | 52893 |
| FAM219B | 6704 | 29799 | 52894 |
| FAM220A | 6705 | 29800 | 52895 |
| FAM221A | 6706 | 29801 | 52896 |
| FAM221B | 6707 | 29802 | 52897 |
| FAM222A | 6708 | 29803 | 52898 |
| FAM222B | 6709 | 29804 | 52899 |
| FAM227A | 6710 | 29805 | 52900 |
| FAM227B | 6711 | 29806 | 52901 |
| FAM227B | 6712 | 29807 | 52902 |
| FAM228A | 6713 | 29808 | 52903 |
| FAM228B | 6714 | 29809 | 52904 |
| FAM229A | 6715 | 29810 | 52905 |
| FAM229B | 6716 | 29811 | 52906 |
| FAM231B | 6717 | 29812 | 52907 |
| FAM231C | 6718 | 29813 | 52908 |
| FAM234A | 6719 | 29814 | 52909 |
| FAM234B | 6720 | 29815 | 52910 |
| FAM236D | 6721 | 29816 | 52911 |
| FAM237A | 6722 | 29817 | 52912 |
| FAM240A | 6723 | 29818 | 52913 |
| FAM241A | 6724 | 29819 | 52914 |
| FAM241B | 6725 | 29820 | 52915 |
| FAM24A | 6726 | 29821 | 52916 |
| FAM24B | 6727 | 29822 | 52917 |
| FAM25A | 6728 | 29823 | 52918 |
| FAM25C | 6729 | 29824 | 52919 |
| FAM25E | 6730 | 29825 | 52920 |
| FAM32A | 6731 | 29826 | 52921 |
| FAM35A | 6732 | 29827 | 52922 |
| FAM3A | 6733 | 29828 | 52923 |
| FAM3B | 6734 | 29829 | 52924 |
| FAM3C | 6735 | 29830 | 52925 |
| FAM3D | 6736 | 29831 | 52926 |
| FAM43A | 6737 | 29832 | 52927 |
| FAM43B | 6738 | 29833 | 52928 |
| FAM45A | 6739 | 29834 | 52929 |
| FAM46A | 6740 | 29835 | 52930 |
| FAM46B | 6741 | 29836 | 52931 |
| FAM46C | 6742 | 29837 | 52932 |
| FAM46D | 6743 | 29838 | 52933 |
| FAM47A | 6744 | 29839 | 52934 |
| FAM47B | 6745 | 29840 | 52935 |
| FAM47C | 6746 | 29841 | 52936 |
| FAM47E | 6747 | 29842 | 52937 |
| FAM47E-STBD1 | 6748 | 29843 | 52938 |
| FAM49A | 6749 | 29844 | 52939 |
| FAM49B | 6750 | 29845 | 52940 |
| FAM50A | 6751 | 29846 | 52941 |
| FAM50B | 6752 | 29847 | 52942 |
| FAM53A | 6753 | 29848 | 52943 |
| FAM53A | 6754 | 29849 | 52944 |
| FAM53B | 6755 | 29850 | 52945 |
| FAM53C | 6756 | 29851 | 52946 |
| FAM57A | 6757 | 29852 | 52947 |
| FAM57B | 6758 | 29853 | 52948 |
| FAM69A | 6759 | 29854 | 52949 |
| FAM69A | 6760 | 29855 | 52950 |
| FAM69B | 6761 | 29856 | 52951 |
| FAM69C | 6762 | 29857 | 52952 |
| FAM71A | 6763 | 29858 | 52953 |
| FAM71B | 6764 | 29859 | 52954 |
| FAM71C | 6765 | 29860 | 52955 |
| FAM71D | 6766 | 29861 | 52956 |
| FAM71E1 | 6767 | 29862 | 52957 |
| FAM71E2 | 6768 | 29863 | 52958 |
| FAM71F1 | 6769 | 29864 | 52959 |
| FAM71F2 | 6770 | 29865 | 52960 |
| FAM72C | 6771 | 29866 | 52961 |
| FAM72C | 6772 | 29867 | 52962 |
| FAM72C | 6773 | 29868 | 52963 |
| FAM76A | 6774 | 29869 | 52964 |
| FAM76B | 6775 | 29870 | 52965 |
| FAM78A | 6776 | 29871 | 52966 |
| FAM78B | 6777 | 29872 | 52967 |
| FAM78B | 6778 | 29873 | 52968 |
| FAM81A | 6779 | 29874 | 52969 |
| FAM81B | 6780 | 29875 | 52970 |
| FAM83A | 6781 | 29876 | 52971 |
| FAM83A | 6782 | 29877 | 52972 |
| FAM83A | 6783 | 29878 | 52973 |
| FAM83A | 6784 | 29879 | 52974 |
| FAM83B | 6785 | 29880 | 52975 |
| FAM83C | 6786 | 29881 | 52976 |
| FAM83D | 6787 | 29882 | 52977 |
| FAM83E | 6788 | 29883 | 52978 |
| FAM83F | 6789 | 29884 | 52979 |
| FAM83G | 6790 | 29885 | 52980 |
| FAM83H | 6791 | 29886 | 52981 |
| FAM84A | 6792 | 29887 | 52982 |
| FAM84B | 6793 | 29888 | 52983 |
| FAM86B2 | 6794 | 29889 | 52984 |
| FAM86C1 | 6795 | 29890 | 52985 |
| FAM89A | 6796 | 29891 | 52986 |
| FAM89B | 6797 | 29892 | 52987 |
| FAM8A1 | 6798 | 29893 | 52988 |
| FAM90A1 | 6799 | 29894 | 52989 |
| FAM91A1 | 6800 | 29895 | 52990 |
| FAM91A1 | 6801 | 29896 | 52991 |
| FAM92A | 6802 | 29897 | 52992 |
| FAM92B | 6803 | 29898 | 52993 |
| FAM96A | 6804 | 29899 | 52994 |
| FAM96A | 6805 | 29900 | 52995 |
| FAM96B | 6806 | 29901 | 52996 |
| FAM98A | 6807 | 29902 | 52997 |
| FAM98B | 6808 | 29903 | 52998 |
| FAM98C | 6809 | 29904 | 52999 |
| FAM9A | 6810 | 29905 | 53000 |
| FAM9B | 6811 | 29906 | 53001 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| FAM9C | 6812 | 29907 | 53002 |
| FAN1 | 6813 | 29908 | 53003 |
| FAN1 | 6814 | 29909 | 53004 |
| FANCA | 6815 | 29910 | 53005 |
| FANCA | 6816 | 29911 | 53006 |
| FANCA | 6817 | 29912 | 53007 |
| FANCB | 6818 | 29913 | 53008 |
| FANCC | 6819 | 29914 | 53009 |
| FANCC | 6820 | 29915 | 53010 |
| FANCD2 | 6821 | 29916 | 53011 |
| FANCD2 | 6822 | 29917 | 53012 |
| FANCD2OS | 6823 | 29918 | 53013 |
| FANCE | 6824 | 29919 | 53014 |
| FANCF | 6825 | 29920 | 53015 |
| FANCG | 6826 | 29921 | 53016 |
| FANCI | 6827 | 29922 | 53017 |
| FANCL | 6828 | 29923 | 53018 |
| FANCM | 6829 | 29924 | 53019 |
| FANCM | 6830 | 29925 | 53020 |
| FANK1 | 6831 | 29926 | 53021 |
| FAP | 6832 | 29927 | 53022 |
| FAR1 | 6833 | 29928 | 53023 |
| FAR2 | 6834 | 29929 | 53024 |
| FARP1 | 6835 | 29930 | 53025 |
| FARP1 | 6836 | 29931 | 53026 |
| FARP2 | 6837 | 29932 | 53027 |
| FARP2 | 6838 | 29933 | 53028 |
| FARP2 | 6839 | 29934 | 53029 |
| FARS2 | 6840 | 29935 | 53030 |
| FARSA | 6841 | 29936 | 53031 |
| FARSB | 6842 | 29937 | 53032 |
| FAS | 6843 | 29938 | 53033 |
| FAS | 6844 | 29939 | 53034 |
| FAS | 6845 | 29940 | 53035 |
| FASLG | 6846 | 29941 | 53036 |
| FASLG | 6847 | 29942 | 53037 |
| FASN | 6848 | 29943 | 53038 |
| FASTK | 6849 | 29944 | 53039 |
| FASTKD1 | 6850 | 29945 | 53040 |
| FASTKD2 | 6851 | 29946 | 53041 |
| FASTKD3 | 6852 | 29947 | 53042 |
| FASTKD5 | 6853 | 29948 | 53043 |
| FAT1 | 6854 | 29949 | 53044 |
| FAT2 | 6855 | 29950 | 53045 |
| FAT3 | 6856 | 29951 | 53046 |
| FAT4 | 6857 | 29952 | 53047 |
| FATE1 | 6858 | 29953 | 53048 |
| FAU | 6859 | 29954 | 53049 |
| FAXC | 6860 | 29955 | 53050 |
| FAXDC2 | 6861 | 29956 | 53051 |
| FBF1 | 6862 | 29957 | 53052 |
| FBL | 6863 | 29958 | 53053 |
| FBLIM1 | 6864 | 29959 | 53054 |
| FBLIM1 | 6865 | 29960 | 53055 |
| FBLN1 | 6866 | 29961 | 53056 |
| FBLN1 | 6867 | 29962 | 53057 |
| FBLN1 | 6868 | 29963 | 53058 |
| FBLN1 | 6869 | 29964 | 53059 |
| FBLN2 | 6870 | 29965 | 53060 |
| FBLN5 | 6871 | 29966 | 53061 |
| FBLN7 | 6872 | 29967 | 53062 |
| FBN1 | 6873 | 29968 | 53063 |
| FBN2 | 6874 | 29969 | 53064 |
| FBN3 | 6875 | 29970 | 53065 |
| FBP1 | 6876 | 29971 | 53066 |
| FBP2 | 6877 | 29972 | 53067 |
| FBRS | 6878 | 29973 | 53068 |
| FBRSL1 | 6879 | 29974 | 53069 |
| FBXL12 | 6880 | 29975 | 53070 |
| FBXL13 | 6881 | 29976 | 53071 |
| FBXL14 | 6882 | 29977 | 53072 |
| FBXL15 | 6883 | 29978 | 53073 |
| FBXL16 | 6884 | 29979 | 53074 |
| FBXL17 | 6885 | 29980 | 53075 |
| FBXL18 | 6886 | 29981 | 53076 |
| FBXL18 | 6887 | 29982 | 53077 |
| FBXL19 | 6888 | 29983 | 53078 |
| FBXL2 | 6889 | 29984 | 53079 |
| FBXL20 | 6890 | 29985 | 53080 |
| FBXL21 | 6891 | 29986 | 53081 |
| FBXL22 | 6892 | 29987 | 53082 |
| FBXL3 | 6893 | 29988 | 53083 |
| FBXL4 | 6894 | 29989 | 53084 |
| FBXL5 | 6895 | 29990 | 53085 |
| FBXL6 | 6896 | 29991 | 53086 |
| FBXL7 | 6897 | 29992 | 53087 |
| FBXL8 | 6898 | 29993 | 53088 |
| FBXO10 | 6899 | 29994 | 53089 |
| FBXO11 | 6900 | 29995 | 53090 |
| FBXO15 | 6901 | 29996 | 53091 |
| FBXO16 | 6902 | 29997 | 53092 |
| FBXO17 | 6903 | 29998 | 53093 |
| FBXO18 | 6904 | 29999 | 53094 |
| FBXO2 | 6905 | 30000 | 53095 |
| FBXO20 | 6906 | 30001 | 53096 |
| FBXO22 | 6907 | 30002 | 53097 |
| FBXO22 | 6908 | 30003 | 53098 |
| FBXO24 | 6909 | 30004 | 53099 |
| FBXO25 | 6910 | 30005 | 53100 |
| FBXO27 | 6911 | 30006 | 53101 |
| FBXO28 | 6912 | 30007 | 53102 |
| FBXO28 | 6913 | 30008 | 53103 |
| FBXO3 | 6914 | 30009 | 53104 |
| FBXO3 | 6915 | 30010 | 53105 |
| FBXO30 | 6916 | 30011 | 53106 |
| FBXO31 | 6917 | 30012 | 53107 |
| FBXO32 | 6918 | 30013 | 53108 |
| FBXO33 | 6919 | 30014 | 53109 |
| FBXO34 | 6920 | 30015 | 53110 |
| FBXO36 | 6921 | 30016 | 53111 |
| FBXO38 | 6922 | 30017 | 53112 |
| FBXO39 | 6923 | 30018 | 53113 |
| FBXO4 | 6924 | 30019 | 53114 |
| FBXO4 | 6925 | 30020 | 53115 |
| FBXO4 | 6926 | 30021 | 53116 |
| FBXO40 | 6927 | 30022 | 53117 |
| FBXO41 | 6928 | 30023 | 53118 |
| FBXO42 | 6929 | 30024 | 53119 |
| FBXO43 | 6930 | 30025 | 53120 |
| FBXO44 | 6931 | 30026 | 53121 |
| FBXO44 | 6932 | 30027 | 53122 |
| FBXO45 | 6933 | 30028 | 53123 |
| FBXO46 | 6934 | 30029 | 53124 |
| FBXO47 | 6935 | 30030 | 53125 |
| FBXO48 | 6936 | 30031 | 53126 |
| FBXO5 | 6937 | 30032 | 53127 |
| FBXO6 | 6938 | 30033 | 53128 |
| FBXO7 | 6939 | 30034 | 53129 |
| FBXO8 | 6940 | 30035 | 53130 |
| FBXO9 | 6941 | 30036 | 53131 |
| FBXW10 | 6942 | 30037 | 53132 |
| FBXW11 | 6943 | 30038 | 53133 |
| FBXW12 | 6944 | 30039 | 53134 |
| FBXW2 | 6945 | 30040 | 53135 |
| FBXW4 | 6946 | 30041 | 53136 |
| FBXW5 | 6947 | 30042 | 53137 |
| FBXW7 | 6948 | 30043 | 53138 |
| FBXW7 | 6949 | 30044 | 53139 |
| FBXW8 | 6950 | 30045 | 53140 |
| FBXW9 | 6951 | 30046 | 53141 |
| FCAMR | 6952 | 30047 | 53142 |
| FCAMR | 6953 | 30048 | 53143 |
| FCAR | 6954 | 30049 | 53144 |
| FCAR | 6955 | 30050 | 53145 |
| FCER1A | 6956 | 30051 | 53146 |
| FCER1G | 6957 | 30052 | 53147 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| FCER2 | 6958 | 30053 | 53148 |
| FCF1 | 6959 | 30054 | 53149 |
| FCGBP | 6960 | 30055 | 53150 |
| FCGR1A | 6961 | 30056 | 53151 |
| FCGR1B | 6962 | 30057 | 53152 |
| FCGR1B | 6963 | 30058 | 53153 |
| FCGR2A | 6964 | 30059 | 53154 |
| FCGR2B | 6965 | 30060 | 53155 |
| FCGR3A | 6966 | 30061 | 53156 |
| FCGR3B | 6967 | 30062 | 53157 |
| FCGRT | 6968 | 30063 | 53158 |
| FCHO1 | 6969 | 30064 | 53159 |
| FCHO2 | 6970 | 30065 | 53160 |
| FCHSD1 | 6971 | 30066 | 53161 |
| FCHSD2 | 6972 | 30067 | 53162 |
| FCMR | 6973 | 30068 | 53163 |
| FCMR | 6974 | 30069 | 53164 |
| FCN1 | 6975 | 30070 | 53165 |
| FCN2 | 6976 | 30071 | 53166 |
| FCN3 | 6977 | 30072 | 53167 |
| FCRL1 | 6978 | 30073 | 53168 |
| FCRL1 | 6979 | 30074 | 53169 |
| FCRL2 | 6980 | 30075 | 53170 |
| FCRL3 | 6981 | 30076 | 53171 |
| FCRL3 | 6982 | 30077 | 53172 |
| FCRL4 | 6983 | 30078 | 53173 |
| FCRL5 | 6984 | 30079 | 53174 |
| FCRL5 | 6985 | 30080 | 53175 |
| FCRL6 | 6986 | 30081 | 53176 |
| FCRL6 | 6987 | 30082 | 53177 |
| FCRLA | 6988 | 30083 | 53178 |
| FCRLB | 6989 | 30084 | 53179 |
| FCRLB | 6990 | 30085 | 53180 |
| FCRLB | 6991 | 30086 | 53181 |
| FDCSP | 6992 | 30087 | 53182 |
| FDFT1 | 6993 | 30088 | 53183 |
| FDPS | 6994 | 30089 | 53184 |
| FDX1 | 6995 | 30090 | 53185 |
| FDX1L | 6996 | 30091 | 53186 |
| FDXACB1 | 6997 | 30092 | 53187 |
| FDXR | 6998 | 30093 | 53188 |
| FECH | 6999 | 30094 | 53189 |
| FEM1A | 7000 | 30095 | 53190 |
| FEM1B | 7001 | 30096 | 53191 |
| FEM1C | 7002 | 30097 | 53192 |
| FEN1 | 7003 | 30098 | 53193 |
| FER | 7004 | 30099 | 53194 |
| FER | 7005 | 30100 | 53195 |
| FER1L5 | 7006 | 30101 | 53196 |
| FER1L6 | 7007 | 30102 | 53197 |
| FERD3L | 7008 | 30103 | 53198 |
| FERMT1 | 7009 | 30104 | 53199 |
| FERMT2 | 7010 | 30105 | 53200 |
| FERMT2 | 7011 | 30106 | 53201 |
| FERMT3 | 7012 | 30107 | 53202 |
| FES | 7013 | 30108 | 53203 |
| FETUB | 7014 | 30109 | 53204 |
| FEV | 7015 | 30110 | 53205 |
| FEZ1 | 7016 | 30111 | 53206 |
| FEZ1 | 7017 | 30112 | 53207 |
| FEZ2 | 7018 | 30113 | 53208 |
| FEZF1 | 7019 | 30114 | 53209 |
| FEZF2 | 7020 | 30115 | 53210 |
| FFAR1 | 7021 | 30116 | 53211 |
| FFAR2 | 7022 | 30117 | 53212 |
| FFAR3 | 7023 | 30118 | 53213 |
| FFAR4 | 7024 | 30119 | 53214 |
| FGA | 7025 | 30120 | 53215 |
| FGA | 7026 | 30121 | 53216 |
| FGB | 7027 | 30122 | 53217 |
| FGD1 | 7028 | 30123 | 53218 |
| FGD2 | 7029 | 30124 | 53219 |
| FGD3 | 7030 | 30125 | 53220 |
| FGD4 | 7031 | 30126 | 53221 |
| FGD4 | 7032 | 30127 | 53222 |
| FGD5 | 7033 | 30128 | 53223 |
| FGD6 | 7034 | 30129 | 53224 |
| FGF1 | 7035 | 30130 | 53225 |
| FGF10 | 7036 | 30131 | 53226 |
| FGF11 | 7037 | 30132 | 53227 |
| FGF12 | 7038 | 30133 | 53228 |
| FGF13 | 7039 | 30134 | 53229 |
| FGF14 | 7040 | 30135 | 53230 |
| FGF14 | 7041 | 30136 | 53231 |
| FGF16 | 7042 | 30137 | 53232 |
| FGF17 | 7043 | 30138 | 53233 |
| FGF18 | 7044 | 30139 | 53234 |
| FGF19 | 7045 | 30140 | 53235 |
| FGF2 | 7046 | 30141 | 53236 |
| FGF20 | 7047 | 30142 | 53237 |
| FGF21 | 7048 | 30143 | 53238 |
| FGF22 | 7049 | 30144 | 53239 |
| FGF22 | 7050 | 30145 | 53240 |
| FGF23 | 7051 | 30146 | 53241 |
| FGF3 | 7052 | 30147 | 53242 |
| FGF4 | 7053 | 30148 | 53243 |
| FGF5 | 7054 | 30149 | 53244 |
| FGF5 | 7055 | 30150 | 53245 |
| FGF6 | 7056 | 30151 | 53246 |
| FGF7 | 7057 | 30152 | 53247 |
| FGF8 | 7058 | 30153 | 53248 |
| FGF9 | 7059 | 30154 | 53249 |
| FGFBP1 | 7060 | 30155 | 53250 |
| FGFBP2 | 7061 | 30156 | 53251 |
| FGFBP3 | 7062 | 30157 | 53252 |
| FGFR1 | 7063 | 30158 | 53253 |
| FGFR1 | 7064 | 30159 | 53254 |
| FGFR1OP | 7065 | 30160 | 53255 |
| FGFR1OP | 7066 | 30161 | 53256 |
| FGFR1OP2 | 7067 | 30162 | 53257 |
| FGFR1OP2 | 7068 | 30163 | 53258 |
| FGFR2 | 7069 | 30164 | 53259 |
| FGFR2 | 7070 | 30165 | 53260 |
| FGFR2 | 7071 | 30166 | 53261 |
| FGFR3 | 7072 | 30167 | 53262 |
| FGFR4 | 7073 | 30168 | 53263 |
| FGFRL1 | 7074 | 30169 | 53264 |
| FGG | 7075 | 30170 | 53265 |
| FGG | 7076 | 30171 | 53266 |
| FGGY | 7077 | 30172 | 53267 |
| FGGY | 7078 | 30173 | 53268 |
| FGL1 | 7079 | 30174 | 53269 |
| FGL2 | 7080 | 30175 | 53270 |
| FGR | 7081 | 30176 | 53271 |
| FH | 7082 | 30177 | 53272 |
| FHAD1 | 7083 | 30178 | 53273 |
| FHDC1 | 7084 | 30179 | 53274 |
| FHIT | 7085 | 30180 | 53275 |
| FHIT | 7086 | 30181 | 53276 |
| FHL1 | 7087 | 30182 | 53277 |
| FHL1 | 7088 | 30183 | 53278 |
| FHL2 | 7089 | 30184 | 53279 |
| FHL2 | 7090 | 30185 | 53280 |
| FHL3 | 7091 | 30186 | 53281 |
| FHL5 | 7092 | 30187 | 53282 |
| FHOD1 | 7093 | 30188 | 53283 |
| FHOD3 | 7094 | 30189 | 53284 |
| FIBCD1 | 7095 | 30190 | 53285 |
| FIBIN | 7096 | 30191 | 53286 |
| FIBP | 7097 | 30192 | 53287 |
| FICD | 7098 | 30193 | 53288 |
| FIG4 | 7099 | 30194 | 53289 |
| FIGLA | 7100 | 30195 | 53290 |
| FIGN | 7101 | 30196 | 53291 |
| FIGNL1 | 7102 | 30197 | 53292 |
| FIGNL2 | 7103 | 30198 | 53293 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| FILIP1 | 7104 | 30199 | 53294 |
| FILIP1 | 7105 | 30200 | 53295 |
| FILIP1L | 7106 | 30201 | 53296 |
| FILIP1L | 7107 | 30202 | 53297 |
| FIP1L1 | 7108 | 30203 | 53298 |
| FIS1 | 7109 | 30204 | 53299 |
| FITM1 | 7110 | 30205 | 53300 |
| FITM2 | 7111 | 30206 | 53301 |
| FIZ1 | 7112 | 30207 | 53302 |
| FJX1 | 7113 | 30208 | 53303 |
| FKBP10 | 7114 | 30209 | 53304 |
| FKBP11 | 7115 | 30210 | 53305 |
| FKBP11 | 7116 | 30211 | 53306 |
| FKBP14 | 7117 | 30212 | 53307 |
| FKBP15 | 7118 | 30213 | 53308 |
| FKBP1A | 7119 | 30214 | 53309 |
| FKBP1A | 7120 | 30215 | 53310 |
| FKBP1B | 7121 | 30216 | 53311 |
| FKBP1B | 7122 | 30217 | 53312 |
| FKBP2 | 7123 | 30218 | 53313 |
| FKBP3 | 7124 | 30219 | 53314 |
| FKBP4 | 7125 | 30220 | 53315 |
| FKBP5 | 7126 | 30221 | 53316 |
| FKBP5 | 7127 | 30222 | 53317 |
| FKBP6 | 7128 | 30223 | 53318 |
| FKBP7 | 7129 | 30224 | 53319 |
| FKBP8 | 7130 | 30225 | 53320 |
| FKBP9 | 7131 | 30226 | 53321 |
| FKBPL | 7132 | 30227 | 53322 |
| FKRP | 7133 | 30228 | 53323 |
| FKTN | 7134 | 30229 | 53324 |
| FKTN | 7135 | 30230 | 53325 |
| FKTN | 7136 | 30231 | 53326 |
| FLAD1 | 7137 | 30232 | 53327 |
| FLAD1 | 7138 | 30233 | 53328 |
| FLAD1 | 7139 | 30234 | 53329 |
| FLCN | 7140 | 30235 | 53330 |
| FLCN | 7141 | 30236 | 53331 |
| FLG | 7142 | 30237 | 53332 |
| FLG2 | 7143 | 30238 | 53333 |
| FLI1 | 7144 | 30239 | 53334 |
| FLII | 7145 | 30240 | 53335 |
| FLJ44635 | 7146 | 30241 | 53336 |
| FLJ45513 | 7147 | 30242 | 53337 |
| FLNA | 7148 | 30243 | 53338 |
| FLNB | 7149 | 30244 | 53339 |
| FLNC | 7150 | 30245 | 53340 |
| FLOT1 | 7151 | 30246 | 53341 |
| FLOT2 | 7152 | 30247 | 53342 |
| FLRT1 | 7153 | 30248 | 53343 |
| FLRT2 | 7154 | 30249 | 53344 |
| FLRT3 | 7155 | 30250 | 53345 |
| FLT1 | 7156 | 30251 | 53346 |
| FLT1 | 7157 | 30252 | 53347 |
| FLT1 | 7158 | 30253 | 53348 |
| FLT1 | 7159 | 30254 | 53349 |
| FLT3 | 7160 | 30255 | 53350 |
| FLT3LG | 7161 | 30256 | 53351 |
| FLT3LG | 7162 | 30257 | 53352 |
| FLT4 | 7163 | 30258 | 53353 |
| FLT4 | 7164 | 30259 | 53354 |
| FLVCR1 | 7165 | 30260 | 53355 |
| FLVCR2 | 7166 | 30261 | 53356 |
| FLYWCH1 | 7167 | 30262 | 53357 |
| FLYWCH1 | 7168 | 30263 | 53358 |
| FLYWCH2 | 7169 | 30264 | 53359 |
| FMC1 | 7170 | 30265 | 53360 |
| FMN1 | 7171 | 30266 | 53361 |
| FMN1 | 7172 | 30267 | 53362 |
| FMN2 | 7173 | 30268 | 53363 |
| FMNL1 | 7174 | 30269 | 53364 |
| FMNL2 | 7175 | 30270 | 53365 |
| FMNL3 | 7176 | 30271 | 53366 |
| FMO1 | 7177 | 30272 | 53367 |
| FMO2 | 7178 | 30273 | 53368 |
| FMO3 | 7179 | 30274 | 53369 |
| FMO4 | 7180 | 30275 | 53370 |
| FMO5 | 7181 | 30276 | 53371 |
| FMO5 | 7182 | 30277 | 53372 |
| FMO5 | 7183 | 30278 | 53373 |
| FMOD | 7184 | 30279 | 53374 |
| FMR1 | 7185 | 30280 | 53375 |
| FMR1NB | 7186 | 30281 | 53376 |
| FN1 | 7187 | 30282 | 53377 |
| FN1 | 7188 | 30283 | 53378 |
| FN3K | 7189 | 30284 | 53379 |
| FN3KRP | 7190 | 30285 | 53380 |
| FNBP1 | 7191 | 30286 | 53381 |
| FNBP1L | 7192 | 30287 | 53382 |
| FNBP4 | 7193 | 30288 | 53383 |
| FNDC1 | 7194 | 30289 | 53384 |
| FNDC10 | 7195 | 30290 | 53385 |
| FNDC11 | 7196 | 30291 | 53386 |
| FNDC3A | 7197 | 30292 | 53387 |
| FNDC3B | 7198 | 30293 | 53388 |
| FNDC4 | 7199 | 30294 | 53389 |
| FNDC5 | 7200 | 30295 | 53390 |
| FNDC5 | 7201 | 30296 | 53391 |
| FNDC5 | 7202 | 30297 | 53392 |
| FNDC7 | 7203 | 30298 | 53393 |
| FNDC8 | 7204 | 30299 | 53394 |
| FNDC9 | 7205 | 30300 | 53395 |
| FNIP1 | 7206 | 30301 | 53396 |
| FNIP1 | 7207 | 30302 | 53397 |
| FNIP2 | 7208 | 30303 | 53398 |
| FNTA | 7209 | 30304 | 53399 |
| FOCAD | 7210 | 30305 | 53400 |
| FOLH1 | 7211 | 30306 | 53401 |
| FOLR1 | 7212 | 30307 | 53402 |
| FOLR2 | 7213 | 30308 | 53403 |
| FOLR3 | 7214 | 30309 | 53404 |
| FOLR3 | 7215 | 30310 | 53405 |
| FOPNL | 7216 | 30311 | 53406 |
| FOPNL | 7217 | 30312 | 53407 |
| FOS | 7218 | 30313 | 53408 |
| FOSB | 7219 | 30314 | 53409 |
| FOSL1 | 7220 | 30315 | 53410 |
| FOSL1 | 7221 | 30316 | 53411 |
| FOSL2 | 7222 | 30317 | 53412 |
| FOXA1 | 7223 | 30318 | 53413 |
| FOXA2 | 7224 | 30319 | 53414 |
| FOXA3 | 7225 | 30320 | 53415 |
| FOXB1 | 7226 | 30321 | 53416 |
| FOXB2 | 7227 | 30322 | 53417 |
| FOXC1 | 7228 | 30323 | 53418 |
| FOXC2 | 7229 | 30324 | 53419 |
| FOXD1 | 7230 | 30325 | 53420 |
| FOXD2 | 7231 | 30326 | 53421 |
| FOXD3 | 7232 | 30327 | 53422 |
| FOXD4 | 7233 | 30328 | 53423 |
| FOXD4L1 | 7234 | 30329 | 53424 |
| FOXD4L4 | 7235 | 30330 | 53425 |
| FOXD4L5 | 7236 | 30331 | 53426 |
| FOXD4L6 | 7237 | 30332 | 53427 |
| FOXE1 | 7238 | 30333 | 53428 |
| FOXE3 | 7239 | 30334 | 53429 |
| FOXF1 | 7240 | 30335 | 53430 |
| FOXF2 | 7241 | 30336 | 53431 |
| FOXG1 | 7242 | 30337 | 53432 |
| FOXH1 | 7243 | 30338 | 53433 |
| FOXI1 | 7244 | 30339 | 53434 |
| FOXI2 | 7245 | 30340 | 53435 |
| FOXI3 | 7246 | 30341 | 53436 |
| FOXJ1 | 7247 | 30342 | 53437 |
| FOXJ2 | 7248 | 30343 | 53438 |
| FOXJ3 | 7249 | 30344 | 53439 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| FOXK1 | 7250 | 30345 | 53440 |
| FOXK2 | 7251 | 30346 | 53441 |
| FOXL1 | 7252 | 30347 | 53442 |
| FOXL2 | 7253 | 30348 | 53443 |
| FOXL2NB | 7254 | 30349 | 53444 |
| FOXM1 | 7255 | 30350 | 53445 |
| FOXN1 | 7255 | 30351 | 53446 |
| FOXN2 | 7257 | 30352 | 53447 |
| FOXN3 | 7258 | 30353 | 53448 |
| FOXN4 | 7259 | 30354 | 53449 |
| FOXO1 | 7260 | 30355 | 53450 |
| FOXO3 | 7261 | 30356 | 53451 |
| FOXO4 | 7262 | 30357 | 53452 |
| FOXO6 | 7263 | 30358 | 53453 |
| FOXP1 | 7264 | 30359 | 53454 |
| FOXP1 | 7265 | 30360 | 53455 |
| FOXP2 | 7266 | 30361 | 53456 |
| FOXP2 | 7267 | 30362 | 53457 |
| FOXP3 | 7268 | 30363 | 53458 |
| FOXP4 | 7269 | 30364 | 53459 |
| FOXQ1 | 7270 | 30365 | 53460 |
| FOXR1 | 7271 | 30366 | 53461 |
| FOXR2 | 7272 | 30367 | 53462 |
| FOXRED1 | 7273 | 30368 | 53463 |
| FOXRED2 | 7274 | 30369 | 53464 |
| FOXS1 | 7275 | 30370 | 53465 |
| FPGS | 7276 | 30371 | 53456 |
| FPGT | 7277 | 30372 | 53467 |
| FPGT-TNNI3K | 7278 | 30373 | 53468 |
| FPR1 | 7279 | 30374 | 53469 |
| FPR2 | 7280 | 30375 | 53470 |
| FPR3 | 7281 | 30376 | 53471 |
| FRA10AC1 | 7282 | 30377 | 53472 |
| FRAS1 | 7283 | 30378 | 53473 |
| FRAS1 | 7284 | 30379 | 53474 |
| FRAT1 | 7285 | 30380 | 53475 |
| FRAT2 | 7286 | 30381 | 53476 |
| FREM1 | 7287 | 30382 | 53477 |
| FREM2 | 7288 | 30383 | 53478 |
| FREM3 | 7289 | 30384 | 53479 |
| FRG1 | 7290 | 30385 | 53480 |
| FRG2B | 7291 | 30386 | 53481 |
| FRG2C | 7292 | 30387 | 53482 |
| FRK | 7293 | 30388 | 53483 |
| FRMD1 | 7294 | 30389 | 53484 |
| FRMD3 | 7295 | 30390 | 53485 |
| FRMD3 | 7296 | 30391 | 53486 |
| FRMD4A | 7297 | 30392 | 53487 |
| FRMD4B | 7298 | 30393 | 53488 |
| FRMD5 | 7299 | 30394 | 53489 |
| FRMD5 | 7300 | 30395 | 53490 |
| FRMD5 | 7301 | 30396 | 53491 |
| FRMD6 | 7302 | 30397 | 53492 |
| FRMD7 | 7303 | 30398 | 53493 |
| FRMD8 | 7304 | 30399 | 53494 |
| FRMPD1 | 7305 | 30400 | 53495 |
| FRMPD2 | 7306 | 30401 | 53496 |
| FRMPD3 | 7307 | 30402 | 53497 |
| FRMPD4 | 7308 | 30403 | 53498 |
| FRRS1 | 7309 | 30404 | 53499 |
| FRRS1L | 7310 | 30405 | 53500 |
| FRS2 | 7311 | 30406 | 53501 |
| FRS3 | 7312 | 30407 | 53502 |
| FRY | 7313 | 30408 | 53503 |
| FRYL | 7314 | 30409 | 53504 |
| FRZB | 7315 | 30410 | 53505 |
| FSBP | 7316 | 30411 | 53506 |
| FSCB | 7317 | 30412 | 53507 |
| FSCN1 | 7318 | 30413 | 53508 |
| FSCN2 | 7319 | 30414 | 53509 |
| FSCN3 | 7320 | 30415 | 53510 |
| FSD1 | 7321 | 30416 | 53511 |
| FSD1 | 7322 | 30417 | 53512 |
| FSD1L | 7323 | 30418 | 53513 |
| FSD1L | 7324 | 30419 | 53514 |
| FSD2 | 7325 | 30420 | 53515 |
| FSHB | 7326 | 30421 | 53516 |
| FSHR | 7327 | 30422 | 53517 |
| FSIP1 | 7328 | 30423 | 53518 |
| FSIP2 | 7329 | 30424 | 53519 |
| FST | 7330 | 30425 | 53520 |
| FST | 7331 | 30426 | 53521 |
| FSTL1 | 7332 | 30427 | 53522 |
| FSTL3 | 7333 | 30428 | 53523 |
| FSTL4 | 7334 | 30429 | 53524 |
| FSTL5 | 7335 | 30430 | 53525 |
| FTCD | 7336 | 30431 | 53526 |
| FTCD | 7337 | 30432 | 53527 |
| FTCD | 7338 | 30433 | 53528 |
| FTCD-AS1 | 7339 | 30434 | 53529 |
| FTCDNL1 | 7340 | 30435 | 53530 |
| FTCDNL1 | 7341 | 30436 | 53531 |
| FTCDNL1 | 7342 | 30437 | 53532 |
| FTH1 | 7343 | 30438 | 53533 |
| FTH1P18 | 7344 | 30439 | 53534 |
| FTHL17 | 7345 | 30440 | 53535 |
| FTL | 7346 | 30441 | 53536 |
| FTMT | 7347 | 30442 | 53537 |
| FTO | 7348 | 30443 | 53538 |
| FTSJ1 | 7349 | 30444 | 53539 |
| FTSJ3 | 7350 | 30445 | 53540 |
| FUBP1 | 7351 | 30446 | 53541 |
| FUBP3 | 7352 | 30447 | 53542 |
| FUCA1 | 7353 | 30448 | 53543 |
| FUCA2 | 7354 | 30449 | 53544 |
| FUK | 7355 | 30450 | 53545 |
| FUNDC1 | 7356 | 30451 | 53546 |
| FUNDC2 | 7357 | 30452 | 53547 |
| FUOM | 7358 | 30453 | 53548 |
| FUOM | 7359 | 30454 | 53549 |
| FURIN | 7360 | 30455 | 53550 |
| FUS | 7361 | 30456 | 53551 |
| FUT1 | 7362 | 30457 | 53552 |
| FUT10 | 7363 | 30458 | 53553 |
| FUT11 | 7364 | 30459 | 53554 |
| FUT11 | 7365 | 30460 | 53555 |
| FUT2 | 7366 | 30461 | 53556 |
| FUT3 | 7367 | 30462 | 53557 |
| FUT4 | 7368 | 30463 | 53558 |
| FUT7 | 7369 | 30464 | 53559 |
| FUT8 | 7370 | 30465 | 53560 |
| FUT9 | 7371 | 30466 | 53561 |
| FUZ | 7372 | 30467 | 53562 |
| FXN | 7373 | 30468 | 53563 |
| FXN | 7374 | 30469 | 53564 |
| FXN | 7375 | 30470 | 53565 |
| FXR1 | 7376 | 30471 | 53566 |
| FXR1 | 7377 | 30472 | 53567 |
| FXR2 | 7378 | 30473 | 53568 |
| FXYD1 | 7379 | 30474 | 53569 |
| FXYD2 | 7380 | 30475 | 53570 |
| FXYD3 | 7381 | 30476 | 53571 |
| FXYD3 | 7382 | 30477 | 53572 |
| FXYD3 | 7383 | 30478 | 53573 |
| FXYD4 | 7384 | 30479 | 53574 |
| FXYD5 | 7385 | 30480 | 53575 |
| FXYD5 | 7386 | 30481 | 53576 |
| FXYD6 | 7387 | 30482 | 53577 |
| FXYD6 | 7388 | 30483 | 53578 |
| FXYD6-FXYD2 | 7389 | 30484 | 53579 |
| FXYD7 | 7390 | 30485 | 53580 |
| FYB1 | 7391 | 30486 | 53581 |
| FYB2 | 7392 | 30487 | 53582 |
| FYCO1 | 7393 | 30488 | 53583 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| FYN | 7394 | 30489 | 53584 |
| FYTTD1 | 7395 | 30490 | 53585 |
| FZD1 | 7396 | 30491 | 53586 |
| FZD10 | 7397 | 30492 | 53587 |
| FZD2 | 7398 | 30493 | 53588 |
| FZD3 | 7399 | 30494 | 53589 |
| FZD4 | 7400 | 30495 | 53590 |
| FZD5 | 7401 | 30496 | 53591 |
| FZD6 | 7402 | 30497 | 53592 |
| FZD7 | 7403 | 30498 | 53593 |
| FZD8 | 7404 | 30499 | 53594 |
| FZD9 | 7405 | 30500 | 53595 |
| FZR1 | 7406 | 30501 | 53596 |
| G0S2 | 7407 | 30502 | 53597 |
| G2E3 | 7408 | 30503 | 53598 |
| G3BP1 | 7409 | 30504 | 53599 |
| G3BP2 | 7410 | 30505 | 53600 |
| G6PC | 7411 | 30506 | 53601 |
| G6PC | 7412 | 30507 | 53602 |
| G6PC2 | 7413 | 30508 | 53603 |
| G6PC3 | 7414 | 30509 | 53604 |
| G6PC3 | 7415 | 30510 | 53605 |
| G6PD | 7416 | 30511 | 53606 |
| GAA | 7417 | 30512 | 53607 |
| GAB1 | 7418 | 30513 | 53608 |
| GAB2 | 7419 | 30514 | 53609 |
| GAB3 | 7420 | 30515 | 53610 |
| GAB4 | 7421 | 30516 | 53611 |
| GABARAP | 7422 | 30517 | 53612 |
| GABARAPL1 | 7423 | 30518 | 53613 |
| GABARAPL2 | 7424 | 30519 | 53614 |
| GABBR1 | 7425 | 30520 | 53615 |
| GABBR2 | 7426 | 30521 | 53616 |
| GABPA | 7427 | 30522 | 53617 |
| GABPB1 | 7428 | 30523 | 53618 |
| GABPB1 | 7429 | 30524 | 53619 |
| GABPB2 | 7430 | 30525 | 53620 |
| GABPB2 | 7431 | 30526 | 53621 |
| GABRA1 | 7432 | 30527 | 53622 |
| GABRA2 | 7433 | 30528 | 53623 |
| GABRA3 | 7434 | 30529 | 53624 |
| GABRA4 | 7435 | 30530 | 53625 |
| GABRA5 | 7436 | 30531 | 53626 |
| GABRA6 | 7437 | 30532 | 53627 |
| GABRB1 | 7438 | 30533 | 53628 |
| GABRB2 | 7439 | 30534 | 53629 |
| GABRB3 | 7440 | 30535 | 53630 |
| GABRD | 7441 | 30536 | 53631 |
| GABRE | 7442 | 30537 | 53632 |
| GABRG1 | 7443 | 30538 | 53633 |
| GABRG2 | 7444 | 30539 | 53634 |
| GABRG3 | 7445 | 30540 | 53635 |
| GABRG3 | 7446 | 30541 | 53636 |
| GABRP | 7447 | 30542 | 53637 |
| GABRP | 7448 | 30543 | 53638 |
| GABRQ | 7449 | 30544 | 53639 |
| GABRR1 | 7450 | 30545 | 53640 |
| GABRR2 | 7451 | 30546 | 53641 |
| GABRR3 | 7452 | 30547 | 53642 |
| GAD1 | 7453 | 30548 | 53643 |
| GAD1 | 7454 | 30549 | 53644 |
| GAD2 | 7455 | 30550 | 53645 |
| GADD45A | 7456 | 30551 | 53646 |
| GADD45A | 7457 | 30552 | 53647 |
| GADD45B | 7458 | 30553 | 53648 |
| GADD45G | 7459 | 30554 | 53649 |
| GADD45GIP1 | 7460 | 30555 | 53650 |
| GADL1 | 7461 | 30556 | 53651 |
| GAGE10 | 7462 | 30557 | 53652 |
| GAGE12E | 7463 | 30558 | 53653 |
| GAGE12G | 7464 | 30559 | 53654 |
| GAGE2E | 7465 | 30560 | 53655 |
| GAK | 7466 | 30561 | 53656 |
| GAL | 7467 | 30562 | 53657 |
| GAL3ST1 | 7468 | 30563 | 53658 |
| GAL3ST2 | 7469 | 30564 | 53659 |
| GAL3ST3 | 7470 | 30565 | 53660 |
| GAL3ST4 | 7471 | 30566 | 53661 |
| GALC | 7472 | 30567 | 53662 |
| GALE | 7473 | 30568 | 53663 |
| GALK1 | 7474 | 30569 | 53664 |
| GALK2 | 7475 | 30570 | 53665 |
| GALK2 | 7476 | 30571 | 53666 |
| GALM | 7477 | 30572 | 53667 |
| GALNS | 7478 | 30573 | 53668 |
| GALNT1 | 7479 | 30574 | 53669 |
| GALNT10 | 7480 | 30575 | 53670 |
| GALNT11 | 7481 | 30576 | 53671 |
| GALNT12 | 7482 | 30577 | 53672 |
| GALNT13 | 7483 | 30578 | 53673 |
| GALNT13 | 7484 | 30579 | 53674 |
| GALNT14 | 7485 | 30580 | 53675 |
| GALNT14 | 7486 | 30581 | 53676 |
| GALNT15 | 7487 | 30582 | 53677 |
| GALNT15 | 7488 | 30583 | 53678 |
| GALNT16 | 7489 | 30584 | 53679 |
| GALNT17 | 7490 | 30585 | 53680 |
| GALNT18 | 7491 | 30586 | 53681 |
| GALNT2 | 7492 | 30587 | 53682 |
| GALNT3 | 7493 | 30588 | 53683 |
| GALNT4 | 7494 | 30589 | 53684 |
| GALNT5 | 7495 | 30590 | 53685 |
| GALNT6 | 7496 | 30591 | 53686 |
| GALNT6 | 7497 | 30592 | 53687 |
| GALNT7 | 7498 | 30593 | 53688 |
| GALNT8 | 7499 | 30594 | 53689 |
| GALNT9 | 7500 | 30595 | 53690 |
| GALNTL5 | 7501 | 30596 | 53691 |
| GALNTL6 | 7502 | 30597 | 53692 |
| GALP | 7503 | 30598 | 53693 |
| GALR1 | 7504 | 30599 | 53694 |
| GALR2 | 7505 | 30600 | 53695 |
| GALR3 | 7506 | 30601 | 53696 |
| GALT | 7507 | 30602 | 53697 |
| GAMT | 7508 | 30603 | 53698 |
| GAMT | 7509 | 30604 | 53699 |
| GAN | 7510 | 30605 | 53700 |
| GANAB | 7511 | 30606 | 53701 |
| GANC | 7512 | 30607 | 53702 |
| GANC | 7513 | 30608 | 53703 |
| GANC | 7514 | 30609 | 53704 |
| GAP43 | 7515 | 30610 | 53705 |
| GAPDH | 7516 | 30611 | 53706 |
| GAPDHS | 7517 | 30612 | 53707 |
| GAPT | 7518 | 30613 | 53708 |
| GAPVD1 | 7519 | 30614 | 53709 |
| GAPVD1 | 7520 | 30615 | 53710 |
| GAR1 | 7521 | 30616 | 53711 |
| GAREM1 | 7522 | 30617 | 53712 |
| GAREM2 | 7523 | 30618 | 53713 |
| GARNL3 | 7524 | 30619 | 53714 |
| GARS | 7525 | 30620 | 53715 |
| GART | 7526 | 30621 | 53716 |
| GART | 7527 | 30622 | 53717 |
| GAS1 | 7528 | 30623 | 53718 |
| GAS2 | 7529 | 30624 | 53719 |
| GAS2 | 7530 | 30625 | 53720 |
| GAS2L1 | 7531 | 30626 | 53721 |
| GAS2L2 | 7532 | 30627 | 53722 |
| GAS2L3 | 7533 | 30628 | 53723 |
| GAS6 | 7534 | 30629 | 53724 |
| GAS7 | 7535 | 30630 | 53725 |
| GAS8 | 7536 | 30631 | 53726 |
| GAST | 7537 | 30632 | 53727 |
| GATA1 | 7538 | 30633 | 53728 |
| GATA2 | 7539 | 30634 | 53729 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| GATA3 | 7540 | 30635 | 53730 |
| GATA4 | 7541 | 30636 | 53731 |
| GATA5 | 7542 | 30637 | 53732 |
| GATA6 | 7543 | 30638 | 53733 |
| GATAD1 | 7544 | 30639 | 53734 |
| GATAD2A | 7545 | 30640 | 53735 |
| GATAD2B | 7546 | 30641 | 53736 |
| GATB | 7547 | 30642 | 53737 |
| GATC | 7548 | 30643 | 53738 |
| GATD1 | 7549 | 30644 | 53739 |
| GATD1 | 7550 | 30645 | 53740 |
| GATM | 7551 | 30646 | 53741 |
| GATS | 7552 | 30647 | 53742 |
| GBA | 7553 | 30648 | 53743 |
| GBA2 | 7554 | 30649 | 53744 |
| GBA2 | 7555 | 30650 | 53745 |
| GBA3 | 7556 | 30651 | 53746 |
| GBE1 | 7557 | 30652 | 53747 |
| GBF1 | 7558 | 30653 | 53748 |
| GBGT1 | 7559 | 30654 | 53749 |
| GBGT1 | 7560 | 30655 | 53750 |
| GBP1 | 7561 | 30656 | 53751 |
| GBP2 | 7562 | 30657 | 53752 |
| GBP3 | 7563 | 30658 | 53753 |
| GBP3 | 7564 | 30659 | 53754 |
| GBP4 | 7565 | 30660 | 53755 |
| GBP5 | 7566 | 30661 | 53756 |
| GBP6 | 7567 | 30662 | 53757 |
| GBP7 | 7568 | 30663 | 53758 |
| GBX1 | 7569 | 30664 | 53759 |
| GBX2 | 7570 | 30665 | 53760 |
| GBX2 | 7571 | 30666 | 53761 |
| GC | 7572 | 30667 | 53762 |
| GCA | 7573 | 30668 | 53763 |
| GCAT | 7574 | 30669 | 53764 |
| GCC1 | 7575 | 30670 | 53765 |
| GCC2 | 7576 | 30671 | 53766 |
| GCDH | 7577 | 30672 | 53767 |
| GCDH | 7578 | 30673 | 53768 |
| GCFC2 | 7579 | 30674 | 53769 |
| GCFC2 | 7580 | 30675 | 53770 |
| GCG | 7581 | 30676 | 53771 |
| GCGR | 7582 | 30677 | 53772 |
| GCH1 | 7583 | 30678 | 53773 |
| GCH1 | 7584 | 30679 | 53774 |
| GCH1 | 7585 | 30680 | 53775 |
| GCHFR | 7586 | 30681 | 53776 |
| GCK | 7587 | 30682 | 53777 |
| GCKR | 7588 | 30683 | 53778 |
| GCLC | 7589 | 30684 | 53779 |
| GCLM | 7590 | 30685 | 53780 |
| GCM1 | 7591 | 30686 | 53781 |
| GCM2 | 7592 | 30687 | 53782 |
| GCN1 | 7593 | 30688 | 53783 |
| GCNA | 7594 | 30689 | 53784 |
| GCNT1 | 7595 | 30690 | 53785 |
| GCNT2 | 7596 | 30691 | 53786 |
| GCNT3 | 7597 | 30692 | 53787 |
| GCNT4 | 7598 | 30693 | 53788 |
| GCNT7 | 7599 | 30694 | 53789 |
| GCOM1 | 7600 | 30695 | 53790 |
| GCSAM | 7601 | 30696 | 53791 |
| GCSAML | 7602 | 30697 | 53792 |
| GCSAML | 7603 | 30698 | 53793 |
| GCSH | 7604 | 30699 | 53794 |
| GDA | 7605 | 30700 | 53795 |
| GDA | 7606 | 30701 | 53796 |
| GDA | 7607 | 30702 | 53797 |
| GDAP1 | 7608 | 30703 | 53798 |
| GDAP1L1 | 7609 | 30704 | 53799 |
| GDAP2 | 7610 | 30705 | 53800 |
| GDAP2 | 7611 | 30706 | 53801 |
| GDE1 | 7612 | 30707 | 53802 |
| GDF10 | 7613 | 30708 | 53803 |
| GDF11 | 7614 | 30709 | 53804 |
| GDF15 | 7615 | 30710 | 53805 |
| GDF2 | 7616 | 30711 | 53806 |
| GDF3 | 7617 | 30712 | 53807 |
| GDF5 | 7618 | 30713 | 53808 |
| GDF5OS | 7619 | 30714 | 53809 |
| GDF6 | 7620 | 30715 | 53810 |
| GDF7 | 7621 | 30716 | 53811 |
| GDF9 | 7622 | 30717 | 53812 |
| GDI1 | 7623 | 30718 | 53813 |
| GDI2 | 7624 | 30719 | 53814 |
| GDNF | 7625 | 30720 | 53815 |
| GDPD1 | 7626 | 30721 | 53816 |
| GDPD1 | 7627 | 30722 | 53817 |
| GDPD1 | 7628 | 30723 | 53818 |
| GDPD2 | 7629 | 30724 | 53819 |
| GDPD3 | 7630 | 30725 | 53820 |
| GDPD4 | 7631 | 30726 | 53821 |
| GDPD5 | 7632 | 30727 | 53822 |
| GDPGP1 | 7633 | 30728 | 53823 |
| GEM | 7634 | 30729 | 53824 |
| GEMIN2 | 7635 | 30730 | 53825 |
| GEMIN2 | 7636 | 30731 | 53826 |
| GEMIN4 | 7637 | 30732 | 53827 |
| GEMIN5 | 7638 | 30733 | 53828 |
| GEMIN6 | 7639 | 30734 | 53829 |
| GEMIN7 | 7640 | 30735 | 53830 |
| GEMIN8 | 7641 | 30736 | 53831 |
| GEN1 | 7642 | 30737 | 53832 |
| GET4 | 7643 | 30738 | 53833 |
| GFAP | 7644 | 30739 | 53834 |
| GFAP | 7645 | 30740 | 53835 |
| GFAP | 7646 | 30741 | 53836 |
| GFER | 7647 | 30742 | 53837 |
| GFI1 | 7648 | 30743 | 53838 |
| GFI1B | 7649 | 30744 | 53839 |
| GFM1 | 7650 | 30745 | 53840 |
| GFM1 | 7651 | 30746 | 53841 |
| GFM2 | 7652 | 30747 | 53842 |
| GFM2 | 7653 | 30748 | 53843 |
| GFOD1 | 7654 | 30749 | 53844 |
| GFOD1 | 7655 | 30750 | 53845 |
| GFOD2 | 7656 | 30751 | 53846 |
| GFOD2 | 7657 | 30752 | 53847 |
| GFPT1 | 7658 | 30753 | 53848 |
| GFPT2 | 7659 | 30754 | 53849 |
| GFRA1 | 7660 | 30755 | 53850 |
| GFRA2 | 7661 | 30756 | 53851 |
| GFRA3 | 7662 | 30757 | 53852 |
| GFRA4 | 7663 | 30758 | 53853 |
| GFRAL | 7664 | 30759 | 53854 |
| GFY | 7665 | 30760 | 53855 |
| GGA1 | 7666 | 30761 | 53856 |
| GGA2 | 7667 | 30762 | 53857 |
| GGA3 | 7668 | 30763 | 53858 |
| GGA3 | 7669 | 30764 | 53859 |
| GGACT | 7670 | 30765 | 53860 |
| GGCT | 7671 | 30766 | 53861 |
| GGCT | 7672 | 30767 | 53862 |
| GGCX | 7673 | 30768 | 53863 |
| GGCX | 7674 | 30769 | 53864 |
| GGH | 7675 | 30770 | 53865 |
| GGN | 7676 | 30771 | 53866 |
| GGNBP2 | 7677 | 30772 | 53867 |
| GGPS1 | 7678 | 30773 | 53868 |
| GGT1 | 7679 | 30774 | 53869 |
| GGT5 | 7680 | 30775 | 53870 |
| GGT5 | 7681 | 30776 | 53871 |
| GGT6 | 7682 | 30777 | 53872 |
| GGT6 | 7683 | 30778 | 53873 |
| GGT7 | 7684 | 30779 | 53874 |
| GGT7 | 7685 | 30780 | 53875 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| GGTLC1 | 7686 | 30781 | 53876 |
| GH2 | 7687 | 30782 | 53877 |
| GH2 | 7688 | 30783 | 53878 |
| GH2 | 7689 | 30784 | 53879 |
| GHDC | 7690 | 30785 | 53880 |
| GHDC | 7691 | 30786 | 53881 |
| GHITM | 7692 | 30787 | 53882 |
| GHR | 7693 | 30788 | 53883 |
| GHR | 7694 | 30789 | 53884 |
| GHRH | 7695 | 30790 | 53885 |
| GHRHR | 7696 | 30791 | 53886 |
| GHRL | 7697 | 30792 | 53887 |
| GHSR | 7698 | 30793 | 53888 |
| GHSR | 7699 | 30794 | 53889 |
| GID4 | 7700 | 30795 | 53890 |
| GID8 | 7701 | 30796 | 53891 |
| GIF | 7702 | 30797 | 53892 |
| GIGYF1 | 7703 | 30798 | 53893 |
| GIGYF2 | 7704 | 30799 | 53894 |
| GIMAP1 | 7705 | 30800 | 53895 |
| GIMAP1-GIMAP5 | 7706 | 30801 | 53896 |
| GIMAP2 | 7707 | 30802 | 53897 |
| GIMAP4 | 7708 | 30803 | 53898 |
| GIMAP6 | 7709 | 30804 | 53899 |
| GIMAP7 | 7710 | 30805 | 53900 |
| GIMAP8 | 7711 | 30806 | 53901 |
| GIMD1 | 7712 | 30807 | 53902 |
| GIN1 | 7713 | 30808 | 53903 |
| GINM1 | 7714 | 30809 | 53904 |
| GINS1 | 7715 | 30810 | 53905 |
| GINS2 | 7716 | 30811 | 53906 |
| GINS3 | 7717 | 30812 | 53907 |
| GINS4 | 7718 | 30813 | 53908 |
| GIP | 7719 | 30814 | 53909 |
| GIPC1 | 7720 | 30815 | 53910 |
| GIPC2 | 7721 | 30816 | 53911 |
| GIPC3 | 7722 | 30817 | 53912 |
| GIPR | 7723 | 30818 | 53913 |
| GIT1 | 7724 | 30819 | 53914 |
| GIT2 | 7725 | 30820 | 53915 |
| GIT2 | 7726 | 30821 | 53916 |
| GIT2 | 7727 | 30822 | 53917 |
| GJA1 | 7728 | 30823 | 53918 |
| GJA10 | 7729 | 30824 | 53919 |
| GJA3 | 7730 | 30825 | 53920 |
| GJA4 | 7731 | 30826 | 53921 |
| GJA5 | 7732 | 30827 | 53922 |
| GJA8 | 7733 | 30828 | 53923 |
| GJA9 | 7734 | 30829 | 53924 |
| GJB1 | 7735 | 30830 | 53925 |
| GJB2 | 7736 | 30831 | 53926 |
| GJB3 | 7737 | 30832 | 53927 |
| GJB4 | 7738 | 30833 | 53928 |
| GJB5 | 7739 | 30834 | 53929 |
| GJB6 | 7740 | 30835 | 53930 |
| GJB7 | 7741 | 30836 | 53931 |
| GJC1 | 7742 | 30837 | 53932 |
| GJC2 | 7743 | 30838 | 53933 |
| GJC3 | 7744 | 30839 | 53934 |
| GJD2 | 7745 | 30840 | 53935 |
| GJD3 | 7746 | 30841 | 53936 |
| GJD4 | 7747 | 30842 | 53937 |
| GK | 7748 | 30843 | 53938 |
| GK | 7749 | 30844 | 53939 |
| GK2 | 7750 | 30845 | 53940 |
| GK5 | 7751 | 30846 | 53941 |
| GKAP1 | 7752 | 30847 | 53942 |
| GKN1 | 7753 | 30848 | 53943 |
| GKN2 | 7754 | 30849 | 53944 |
| GLA | 7755 | 30850 | 53945 |
| GLB1 | 7756 | 30851 | 53946 |
| GLB1L | 7757 | 30852 | 53947 |
| GLB1L2 | 7758 | 30853 | 53948 |
| GLB1L3 | 7759 | 30854 | 53949 |
| GLCCI1 | 7760 | 30855 | 53950 |
| GLCE | 7761 | 30856 | 53951 |
| GLCE | 7762 | 30857 | 53952 |
| GLDC | 7763 | 30858 | 53953 |
| GLDN | 7764 | 30859 | 53954 |
| GLE1 | 7765 | 30860 | 53955 |
| GLE1 | 7766 | 30861 | 53956 |
| GLG1 | 7767 | 30862 | 53957 |
| GLG1 | 7768 | 30863 | 53958 |
| GLI1 | 7769 | 30864 | 53959 |
| GLI2 | 7770 | 30865 | 53960 |
| GLI3 | 7771 | 30866 | 53961 |
| GLI4 | 7772 | 30867 | 53962 |
| GLIPR1 | 7773 | 30868 | 53963 |
| GLIPR1L1 | 7774 | 30869 | 53964 |
| GLIPR1L2 | 7775 | 30870 | 53965 |
| GLIPR1L2 | 7776 | 30871 | 53966 |
| GLIPR2 | 7777 | 30872 | 53967 |
| GLIPR2 | 7778 | 30873 | 53968 |
| GLIS1 | 7779 | 30874 | 53969 |
| GLIS2 | 7780 | 30875 | 53970 |
| GLIS3 | 7781 | 30876 | 53971 |
| GLMN | 7782 | 30877 | 53972 |
| GLMP | 7783 | 30878 | 53973 |
| GLMP | 7784 | 30879 | 53974 |
| GLO1 | 7785 | 30880 | 53975 |
| GLOD4 | 7786 | 30881 | 53976 |
| GLOD5 | 7787 | 30882 | 53977 |
| GLP1R | 7788 | 30883 | 53978 |
| GLP2R | 7789 | 30884 | 53979 |
| GLRA1 | 7790 | 30885 | 53980 |
| GLRA2 | 7791 | 30886 | 53981 |
| GLRA3 | 7792 | 30887 | 53982 |
| GLRA4 | 7793 | 30888 | 53983 |
| GLRA4 | 7794 | 30889 | 53984 |
| GLRB | 7795 | 30890 | 53985 |
| GLRB | 7796 | 30891 | 53986 |
| GLRX | 7797 | 30892 | 53987 |
| GLRX2 | 7798 | 30893 | 53988 |
| GLRX3 | 7799 | 30894 | 53989 |
| GLRX5 | 7800 | 30895 | 53990 |
| GLS | 7801 | 30896 | 53991 |
| GLS | 7802 | 30897 | 53992 |
| GLS2 | 7803 | 30898 | 53993 |
| GLS2 | 7804 | 30899 | 53994 |
| GLT1D1 | 7805 | 30900 | 53995 |
| GLT6D1 | 7806 | 30901 | 53996 |
| GLT8D1 | 7807 | 30902 | 53997 |
| GLT8D2 | 7808 | 30903 | 53998 |
| GLTP | 7809 | 30904 | 53999 |
| GLTPD2 | 7810 | 30905 | 54000 |
| GLUD1 | 7811 | 30906 | 54001 |
| GLUL | 7812 | 30907 | 54002 |
| GLYAT | 7813 | 30908 | 54003 |
| GLYAT | 7814 | 30909 | 54004 |
| GLYATL1 | 7815 | 30910 | 54005 |
| GLYATL2 | 7816 | 30911 | 54006 |
| GLYATL3 | 7817 | 30912 | 54007 |
| GLYCTK | 7818 | 30913 | 54008 |
| GLYCTK | 7819 | 30914 | 54009 |
| GLYR1 | 7820 | 30915 | 54010 |
| GM2A | 7821 | 30916 | 54011 |
| GM2A | 7822 | 30917 | 54012 |
| GMCL1 | 7823 | 30918 | 54013 |
| GMDS | 7824 | 30919 | 54014 |
| GMEB1 | 7825 | 30920 | 54015 |
| GMEB2 | 7826 | 30921 | 54016 |
| GMFB | 7827 | 30922 | 54017 |
| GMFG | 7828 | 30923 | 54018 |
| GMIP | 7829 | 30924 | 54019 |
| GML | 7830 | 30925 | 54020 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| GMNC | 7831 | 30926 | 54021 |
| GMNN | 7832 | 30927 | 54022 |
| GMPPA | 7833 | 30928 | 54023 |
| GMPPB | 7834 | 30929 | 54024 |
| GMPR | 7835 | 30930 | 54025 |
| GMPR2 | 7836 | 30931 | 54026 |
| GMPS | 7837 | 30932 | 54027 |
| GNA11 | 7838 | 30933 | 54028 |
| GNA12 | 7839 | 30934 | 54029 |
| GNA13 | 7840 | 30935 | 54030 |
| GNA14 | 7841 | 30936 | 54031 |
| GNA15 | 7842 | 30937 | 54032 |
| GNAI1 | 7843 | 30938 | 54033 |
| GNAI2 | 7844 | 30939 | 54034 |
| GNAI3 | 7845 | 30940 | 54035 |
| GNAL | 7846 | 30941 | 54036 |
| GNAO1 | 7847 | 30942 | 54037 |
| GNAO1 | 7848 | 30943 | 54038 |
| GNAQ | 7849 | 30944 | 54039 |
| GNAS | 7850 | 30945 | 54040 |
| GNAS | 7851 | 30946 | 54041 |
| GNAS | 7852 | 30947 | 54042 |
| GNAT1 | 7853 | 30948 | 54043 |
| GNAT2 | 7854 | 30949 | 54044 |
| GNAT3 | 7855 | 30950 | 54045 |
| GNAZ | 7856 | 30951 | 54046 |
| GNB1 | 7857 | 30952 | 54047 |
| GNB1L | 7858 | 30953 | 54048 |
| GNB2 | 7859 | 30954 | 54049 |
| GNB3 | 7860 | 30955 | 54050 |
| GNB4 | 7861 | 30956 | 54051 |
| GNB5 | 7862 | 30957 | 54052 |
| GNE | 7863 | 30958 | 54053 |
| GNG10 | 7864 | 30959 | 54054 |
| GNG11 | 7865 | 30960 | 54055 |
| GNG12 | 7866 | 30961 | 54056 |
| GNG13 | 7867 | 30962 | 54057 |
| GNG14 | 7868 | 30963 | 54058 |
| GNG2 | 7869 | 30964 | 54059 |
| GNG3 | 7870 | 30965 | 54060 |
| GNG4 | 7871 | 30966 | 54061 |
| GNG5 | 7872 | 30967 | 54062 |
| GNG7 | 7873 | 30968 | 54063 |
| GNG8 | 7874 | 30969 | 54064 |
| GNGT1 | 7875 | 30970 | 54065 |
| GNGT2 | 7876 | 30971 | 54066 |
| GNL1 | 7877 | 30972 | 54067 |
| GNL2 | 7878 | 30973 | 54068 |
| GNL3 | 7879 | 30974 | 54069 |
| GNL3L | 7880 | 30975 | 54070 |
| GNLY | 7881 | 30976 | 54071 |
| GNMT | 7882 | 30977 | 54072 |
| GNPAT | 7883 | 30978 | 54073 |
| GNPDA1 | 7884 | 30979 | 54074 |
| GNPDA2 | 7885 | 30980 | 54075 |
| GNPNAT1 | 7886 | 30981 | 54076 |
| GNPTAB | 7887 | 30982 | 54077 |
| GNPTG | 7888 | 30983 | 54078 |
| GNRH1 | 7889 | 30984 | 54079 |
| GNRH2 | 7890 | 30985 | 54080 |
| GNRHR | 7891 | 30986 | 54081 |
| GNRHR | 7892 | 30987 | 54082 |
| GNS | 7893 | 30988 | 54083 |
| GOLGA1 | 7894 | 30989 | 54084 |
| GOLGA2 | 7895 | 30990 | 54085 |
| GOLGA3 | 7896 | 30991 | 54086 |
| GOLGA3 | 7897 | 30992 | 54087 |
| GOLGA4 | 7898 | 30993 | 54088 |
| GOLGA4 | 7899 | 30994 | 54089 |
| GOLGA5 | 7900 | 30995 | 54090 |
| GOLGA6C | 7901 | 30996 | 54091 |
| GOLGA6L2 | 7902 | 30997 | 54092 |
| GOLGA6L22 | 7903 | 30998 | 54093 |
| GOLGA6L6 | 7904 | 30999 | 54094 |
| GOLGA6L9 | 7905 | 31000 | 54095 |
| GOLGA7 | 7906 | 31001 | 54096 |
| GOLGA7 | 7907 | 31002 | 54097 |
| GOLGA7B | 7908 | 31003 | 54098 |
| GOLGA8A | 7909 | 31004 | 54099 |
| GOLGA8G | 7910 | 31005 | 54100 |
| GOLGA8H | 7911 | 31006 | 54101 |
| GOLGA8J | 7912 | 31007 | 54102 |
| GOLGA8O | 7913 | 31008 | 54103 |
| GOLGB1 | 7914 | 31009 | 54104 |
| GOLIM4 | 7915 | 31010 | 54105 |
| GOLM1 | 7916 | 31011 | 54106 |
| GOLPH3 | 7917 | 31012 | 54107 |
| GOLPH3L | 7918 | 31013 | 54108 |
| GOLT1A | 7919 | 31014 | 54109 |
| GOLT1B | 7920 | 31015 | 54110 |
| GON4L | 7921 | 31016 | 54111 |
| GON4L | 7922 | 31017 | 54112 |
| GON7 | 7923 | 31018 | 54113 |
| GOPC | 7924 | 31019 | 54114 |
| GORAB | 7925 | 31020 | 54115 |
| GORAB | 7926 | 31021 | 54116 |
| GORASP1 | 7927 | 31022 | 54117 |
| GORASP2 | 7928 | 31023 | 54118 |
| GOSR1 | 7929 | 31024 | 54119 |
| GOSR2 | 7930 | 31025 | 54120 |
| GOSR2 | 7931 | 31026 | 54121 |
| GOSR2 | 7932 | 31027 | 54122 |
| GOSR2 | 7933 | 31028 | 54123 |
| GOT1 | 7934 | 31029 | 54124 |
| GOT1L1 | 7935 | 31030 | 54125 |
| GOT2 | 7936 | 31031 | 54126 |
| GP1BA | 7937 | 31032 | 54127 |
| GP1BB | 7938 | 31033 | 54128 |
| GP2 | 7939 | 31034 | 54129 |
| GP5 | 7940 | 31035 | 54130 |
| GP6 | 7941 | 31036 | 54131 |
| GP9 | 7942 | 31037 | 54132 |
| GPA33 | 7943 | 31038 | 54133 |
| GPAA1 | 7944 | 31039 | 54134 |
| GPALPP1 | 7945 | 31040 | 54135 |
| GPAM | 7946 | 31041 | 54136 |
| GPANK1 | 7947 | 31042 | 54137 |
| GPAT2 | 7948 | 31043 | 54138 |
| GPAT2 | 7949 | 31044 | 54139 |
| GPAT3 | 7950 | 31045 | 54140 |
| GPAT4 | 7951 | 31046 | 54141 |
| GPATCH1 | 7952 | 31047 | 54142 |
| GPATCH11 | 7953 | 31048 | 54143 |
| GPATCH2 | 7954 | 31049 | 54144 |
| GPATCH2 | 7955 | 31050 | 54145 |
| GPATCH2L | 7956 | 31051 | 54146 |
| GPATCH2L | 7957 | 31052 | 54147 |
| GPATCH2L | 7958 | 31053 | 54148 |
| GPATCH2L | 7959 | 31054 | 54149 |
| GPATCH2L | 7960 | 31055 | 54150 |
| GPATCH2L | 7961 | 31056 | 54151 |
| GPATCH2L | 7962 | 31057 | 54152 |
| GPATCH3 | 7963 | 31058 | 54153 |
| GPATCH4 | 7964 | 31059 | 54154 |
| GPATCH8 | 7965 | 31060 | 54155 |
| GPBAR1 | 7966 | 31061 | 54156 |
| GPBP1 | 7967 | 31062 | 54157 |
| GPBP1L1 | 7968 | 31063 | 54158 |
| GPC1 | 7969 | 31064 | 54159 |
| GPC2 | 7970 | 31065 | 54160 |
| GPC3 | 7971 | 31066 | 54161 |
| GPC4 | 7972 | 31067 | 54162 |
| GPC5 | 7973 | 31068 | 54163 |
| GPC6 | 7974 | 31069 | 54164 |
| GPCPD1 | 7975 | 31070 | 54165 |
| GPD1 | 7976 | 31071 | 54166 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| GPD1L | 7977 | 31072 | 54167 |
| GPD2 | 7978 | 31073 | 54168 |
| GPER1 | 7979 | 31074 | 54169 |
| GPHA2 | 7980 | 31075 | 54170 |
| GPHB5 | 7981 | 31076 | 54171 |
| GPHN | 7982 | 31077 | 54172 |
| GPI | 7983 | 31078 | 54173 |
| GPIHBP1 | 7984 | 31079 | 54174 |
| GPIHBP1 | 7985 | 31080 | 54175 |
| GPKOW | 7986 | 31081 | 54176 |
| GPLD1 | 7987 | 31082 | 54177 |
| GPM6A | 7988 | 31083 | 54178 |
| GPM6B | 7989 | 31084 | 54179 |
| GPM6B | 7990 | 31085 | 54180 |
| GPN1 | 7991 | 31086 | 54181 |
| GPN2 | 7992 | 31087 | 54182 |
| GPN3 | 7993 | 31088 | 54183 |
| GPNMB | 7994 | 31089 | 54184 |
| GPR1 | 7995 | 31090 | 54185 |
| GPR101 | 7996 | 31091 | 54186 |
| GPR107 | 7997 | 31092 | 54187 |
| GPR107 | 7998 | 31093 | 54188 |
| GPR108 | 7999 | 31094 | 54189 |
| GPR119 | 8000 | 31095 | 54190 |
| GPR12 | 8001 | 31096 | 54191 |
| GPR132 | 8002 | 31097 | 54192 |
| GPR135 | 8003 | 31098 | 54193 |
| GPR137 | 8004 | 31099 | 54194 |
| GPR137 | 8005 | 31100 | 54195 |
| GPR137 | 8006 | 31101 | 54196 |
| GPR137B | 8007 | 31102 | 54197 |
| GPR137C | 8008 | 31103 | 54198 |
| GPR139 | 8009 | 31104 | 54199 |
| GPR141 | 8010 | 31105 | 54200 |
| GPR142 | 8011 | 31106 | 54201 |
| GPR143 | 8012 | 31107 | 54202 |
| GPR146 | 8013 | 31108 | 54203 |
| GPR148 | 8014 | 31109 | 54204 |
| GPR149 | 8015 | 31110 | 54205 |
| GPR15 | 8016 | 31111 | 54206 |
| GPR150 | 8017 | 31112 | 54207 |
| GPR151 | 8018 | 31113 | 54208 |
| GPR152 | 8019 | 31114 | 54209 |
| GPR153 | 8020 | 31115 | 54210 |
| GPR155 | 8021 | 31116 | 54211 |
| GPR156 | 8022 | 31117 | 54212 |
| GPR157 | 8023 | 31118 | 54213 |
| GPR158 | 8024 | 31119 | 54214 |
| GPR160 | 8025 | 31120 | 54215 |
| GPR161 | 8026 | 31121 | 54216 |
| GPR162 | 8027 | 31122 | 54217 |
| GPR17 | 8028 | 31123 | 54218 |
| GPR171 | 8029 | 31124 | 54219 |
| GPR173 | 8030 | 31125 | 54220 |
| GPR174 | 8031 | 31126 | 54221 |
| GPR176 | 8032 | 31127 | 54222 |
| GPR179 | 8033 | 31128 | 54223 |
| GPR18 | 8034 | 31129 | 54224 |
| GPR180 | 8035 | 31130 | 54225 |
| GPR182 | 8036 | 31131 | 54226 |
| GPR183 | 8037 | 31132 | 54227 |
| GPR19 | 8038 | 31133 | 54228 |
| GPR20 | 8039 | 31134 | 54229 |
| GPR21 | 8040 | 31135 | 54230 |
| GPR22 | 8041 | 31136 | 54231 |
| GPR25 | 8042 | 31137 | 54232 |
| GPR26 | 8043 | 31138 | 54233 |
| GPR27 | 8044 | 31139 | 54234 |
| GPR3 | 8045 | 31140 | 54235 |
| GPR31 | 8046 | 31141 | 54236 |
| GPR32 | 8047 | 31142 | 54237 |
| GPR33 | 8048 | 31143 | 54238 |
| GPR34 | 8049 | 31144 | 54239 |
| GPR35 | 8050 | 31145 | 54240 |
| GPR37 | 8051 | 31146 | 54241 |
| GPR37L1 | 8052 | 31147 | 54242 |
| GPR39 | 8053 | 31148 | 54243 |
| GPR4 | 8054 | 31149 | 54244 |
| GPR42 | 8055 | 31150 | 54245 |
| GPR45 | 8056 | 31151 | 54246 |
| GPR50 | 8057 | 31152 | 54247 |
| GPR52 | 8058 | 31153 | 54248 |
| GPR55 | 8059 | 31154 | 54249 |
| GPR6 | 8060 | 31155 | 54250 |
| GPR61 | 8061 | 31156 | 54251 |
| GPR62 | 8062 | 31157 | 54252 |
| GPR63 | 8063 | 31158 | 54253 |
| GPR65 | 8064 | 31159 | 54254 |
| GPR68 | 8065 | 31160 | 54255 |
| GPR75 | 8066 | 31161 | 54256 |
| GPR78 | 8067 | 31162 | 54257 |
| GPR82 | 8068 | 31163 | 54258 |
| GPR83 | 8069 | 31164 | 54259 |
| GPR84 | 8070 | 31165 | 54260 |
| GPR85 | 8071 | 31166 | 54261 |
| GPR87 | 8072 | 31167 | 54262 |
| GPR88 | 8073 | 31168 | 54263 |
| GPR89A | 8074 | 31169 | 54264 |
| GPRASP1 | 8075 | 31170 | 54265 |
| GPRASP2 | 8076 | 31171 | 54266 |
| GPRC5A | 8077 | 31172 | 54267 |
| GPRC5B | 8078 | 31173 | 54268 |
| GPRC5C | 8079 | 31174 | 54269 |
| GPRC5D | 8080 | 31175 | 54270 |
| GPRC6A | 8081 | 31176 | 54271 |
| GPRIN1 | 8082 | 31177 | 54272 |
| GPRIN2 | 8083 | 31178 | 54273 |
| GPRIN3 | 8084 | 31179 | 54274 |
| GPS1 | 8085 | 31180 | 54275 |
| GPS2 | 8086 | 31181 | 54276 |
| GPSM1 | 8087 | 31182 | 54277 |
| GPSM1 | 8088 | 31183 | 54278 |
| GPSM1 | 8089 | 31184 | 54279 |
| GPSM2 | 8090 | 31185 | 54280 |
| GPSM3 | 8091 | 31186 | 54281 |
| GPT | 8092 | 31187 | 54282 |
| GPT2 | 8093 | 31188 | 54283 |
| GPX1 | 8094 | 31189 | 54284 |
| GPX1 | 8095 | 31190 | 54285 |
| GPX2 | 8096 | 31191 | 54286 |
| GPX3 | 8097 | 31192 | 54287 |
| GPX4 | 8098 | 31193 | 54288 |
| GPX4 | 8099 | 31194 | 54289 |
| GPX4 | 8100 | 31195 | 54290 |
| GPX5 | 8101 | 31196 | 54291 |
| GPX5 | 8102 | 31197 | 54292 |
| GPX6 | 8103 | 31198 | 54293 |
| GPX7 | 8104 | 31199 | 54294 |
| GPX8 | 8105 | 31200 | 54295 |
| GPX8 | 8106 | 31201 | 54296 |
| GRAMD1A | 8107 | 31202 | 54297 |
| GRAMD1B | 8108 | 31203 | 54298 |
| GRAMD1C | 8109 | 31204 | 54299 |
| GRAMD2A | 8110 | 31205 | 54300 |
| GRAMD2B | 8111 | 31206 | 54301 |
| GRAMD4 | 8112 | 31207 | 54302 |
| GRAP | 8113 | 31208 | 54303 |
| GRAP | 8114 | 31209 | 54304 |
| GRAP2 | 8115 | 31210 | 54305 |
| GRAPL | 8116 | 31211 | 54306 |
| GRASP | 8117 | 31212 | 54307 |
| GRB10 | 8118 | 31213 | 54308 |
| GRB14 | 8119 | 31214 | 54309 |
| GRB2 | 8120 | 31215 | 54310 |
| GRB7 | 8121 | 31216 | 54311 |
| GRB7 | 8122 | 31217 | 54312 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| GREB1 | 8123 | 31218 | 54313 |
| GREB1 | 8124 | 31219 | 54314 |
| GREB1 | 8125 | 31220 | 54315 |
| GREB1L | 8126 | 31221 | 54316 |
| GREM1 | 8127 | 31222 | 54317 |
| GREM2 | 8128 | 31223 | 54318 |
| GRHL1 | 8129 | 31224 | 54319 |
| GRHL2 | 8130 | 31225 | 54320 |
| GRHL3 | 8131 | 31226 | 54321 |
| GRHL3 | 8132 | 31227 | 54322 |
| GRHPR | 8133 | 31228 | 54323 |
| GRIA1 | 8134 | 31229 | 54324 |
| GRIA2 | 8135 | 31230 | 54325 |
| GRIA3 | 8136 | 31231 | 54326 |
| GRIA3 | 8137 | 31232 | 54327 |
| GRIA4 | 8138 | 31233 | 54328 |
| GRIA4 | 8139 | 31234 | 54329 |
| GRIA4 | 8140 | 31235 | 54330 |
| GRID1 | 8141 | 31236 | 54331 |
| GRID2 | 8142 | 31237 | 54332 |
| GRID2IP | 8143 | 31238 | 54333 |
| GRIFIN | 8144 | 31239 | 54334 |
| GRIK1 | 8145 | 31240 | 54335 |
| GRIK1 | 8146 | 31241 | 54336 |
| GRIK1 | 8147 | 31242 | 54337 |
| GRIK2 | 8148 | 31243 | 54338 |
| GRIK2 | 8149 | 31244 | 54339 |
| GRIK2 | 8150 | 31245 | 54340 |
| GRIK3 | 8151 | 31246 | 54341 |
| GRIK4 | 8152 | 31247 | 54342 |
| GRIK4 | 8153 | 31248 | 54343 |
| GRIK5 | 8154 | 31249 | 54344 |
| GRIK5 | 8155 | 31250 | 54345 |
| GRIN1 | 8156 | 31251 | 54346 |
| GRIN1 | 8157 | 31252 | 54347 |
| GRIN2A | 8158 | 31253 | 54348 |
| GRIN2A | 8159 | 31254 | 54349 |
| GRIN2B | 8160 | 31255 | 54350 |
| GRIN2C | 8161 | 31256 | 54351 |
| GRIN2C | 8162 | 31257 | 54352 |
| GRIN2D | 8163 | 31258 | 54353 |
| GRIN3A | 8164 | 31259 | 54354 |
| GRIN3B | 8165 | 31260 | 54355 |
| GRINA | 8166 | 31261 | 54356 |
| GRIP1 | 8167 | 31262 | 54357 |
| GRIP2 | 8168 | 31263 | 54358 |
| GRIPAP1 | 8169 | 31264 | 54359 |
| GRK1 | 8170 | 31265 | 54360 |
| GRK2 | 8171 | 31266 | 54361 |
| GRK3 | 8172 | 31267 | 54362 |
| GRK4 | 8173 | 31268 | 54363 |
| GRK5 | 8174 | 31269 | 54364 |
| GRK6 | 8175 | 31270 | 54365 |
| GRK6 | 8176 | 31271 | 54366 |
| GRK6 | 8177 | 31272 | 54367 |
| GRK7 | 8178 | 31273 | 54368 |
| GRM1 | 8179 | 31274 | 54369 |
| GRM1 | 8180 | 31275 | 54370 |
| GRM1 | 8181 | 31276 | 54371 |
| GRM2 | 8182 | 31277 | 54372 |
| GRM3 | 8183 | 31278 | 54373 |
| GRM4 | 8184 | 31279 | 54374 |
| GRM5 | 8185 | 31280 | 54375 |
| GRM6 | 8186 | 31281 | 54376 |
| GRM7 | 8187 | 31282 | 54377 |
| GRM7 | 8188 | 31283 | 54378 |
| GRM8 | 8189 | 31284 | 54379 |
| GRM8 | 8190 | 31285 | 54380 |
| GRN | 8191 | 31286 | 54381 |
| GRP | 8192 | 31287 | 54382 |
| GRP | 8193 | 31288 | 54383 |
| GRPEL1 | 8194 | 31289 | 54384 |
| GRPEL2 | 8195 | 31290 | 54385 |
| GRPR | 8196 | 31291 | 54386 |
| GRSF1 | 8197 | 31292 | 54387 |
| GRTP1 | 8198 | 31293 | 54388 |
| GRTP1 | 8199 | 31294 | 54389 |
| GRTP1 | 8200 | 31295 | 54390 |
| GRWD1 | 8201 | 31296 | 54391 |
| GRXCR1 | 8202 | 31297 | 54392 |
| GRXCR2 | 8203 | 31298 | 54393 |
| GSAP | 8204 | 31299 | 54394 |
| GSAP | 8205 | 31300 | 54395 |
| GSC | 8206 | 31301 | 54396 |
| GSC2 | 8207 | 31302 | 54397 |
| GSDMA | 8208 | 31303 | 54398 |
| GSDMB | 8209 | 31304 | 54399 |
| GSDMC | 8210 | 31305 | 54400 |
| GSDMD | 8211 | 31306 | 54401 |
| GSE1 | 8212 | 31307 | 54402 |
| GSG1 | 8213 | 31308 | 54403 |
| GSG1 | 8214 | 31309 | 54404 |
| GSG1L | 8215 | 31310 | 54405 |
| GSG1L | 8216 | 31311 | 54406 |
| GSG1L2 | 8217 | 31312 | 54407 |
| GSK3A | 8218 | 31313 | 54408 |
| GSK3B | 8219 | 31314 | 54409 |
| GSKIP | 8220 | 31315 | 54410 |
| GSN | 8221 | 31316 | 54411 |
| GSPT1 | 8222 | 31317 | 54412 |
| GSPT2 | 8223 | 31318 | 54413 |
| GSR | 8224 | 31319 | 54414 |
| GSS | 8225 | 31320 | 54415 |
| GSTA1 | 8226 | 31321 | 54416 |
| GSTA2 | 8227 | 31322 | 54417 |
| GSTA3 | 8228 | 31323 | 54418 |
| GSTA4 | 8229 | 31324 | 54419 |
| GSTCD | 8230 | 31325 | 54420 |
| GSTK1 | 8231 | 31326 | 54421 |
| GSTM1 | 8232 | 31327 | 54422 |
| GSTM2 | 8233 | 31328 | 54423 |
| GSTM3 | 8234 | 31329 | 54424 |
| GSTM4 | 8235 | 31330 | 54425 |
| GSTM4 | 8236 | 31331 | 54426 |
| GSTM5 | 8237 | 31332 | 54427 |
| GSTO1 | 8238 | 31333 | 54428 |
| GSTO2 | 8239 | 31334 | 54429 |
| GSTP1 | 8240 | 31335 | 54430 |
| GSTT2 | 8241 | 31336 | 54431 |
| GSTZ1 | 8242 | 31337 | 54432 |
| GSX1 | 8243 | 31338 | 54433 |
| GSX2 | 8244 | 31339 | 54434 |
| GTDC1 | 8245 | 31340 | 54435 |
| GTDC1 | 8246 | 31341 | 54436 |
| GTDC1 | 8247 | 31342 | 54437 |
| GTF2A1 | 8248 | 31343 | 54438 |
| GTF2A2 | 8249 | 31344 | 54439 |
| GTF2B | 8250 | 31345 | 54440 |
| GTF2E1 | 8251 | 31346 | 54441 |
| GTF2E2 | 8252 | 31347 | 54442 |
| GTF2E2 | 8253 | 31348 | 54443 |
| GTF2F1 | 8254 | 31349 | 54444 |
| GTF2F2 | 8255 | 31350 | 54445 |
| GTF2H1 | 8256 | 31351 | 54446 |
| GTF2H2C_2 | 8257 | 31352 | 54447 |
| GTF2H3 | 8258 | 31353 | 54448 |
| GTF2H4 | 8259 | 31354 | 54449 |
| GTF2H5 | 8260 | 31355 | 54450 |
| GTF2I | 8261 | 31356 | 54451 |
| GTF2I | 8262 | 31357 | 54452 |
| GTF2IRD1 | 8263 | 31358 | 54453 |
| GTF2IRD2 | 8264 | 31359 | 54454 |
| GTF2IRD2B | 8265 | 31360 | 54455 |
| GTF3A | 8266 | 31361 | 54456 |
| GTF3C1 | 8267 | 31362 | 54457 |
| GTF3C2 | 8268 | 31363 | 54458 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| GTF3C3 | 8269 | 31364 | 54459 |
| GTF3C3 | 8270 | 31365 | 54460 |
| GTF3C4 | 8271 | 31366 | 54461 |
| GTF3C5 | 8272 | 31367 | 54462 |
| GTF3C6 | 8273 | 31368 | 54463 |
| GTPBP1 | 8274 | 31369 | 54464 |
| GTPBP10 | 8275 | 31370 | 54465 |
| GTPBP2 | 8276 | 31371 | 54466 |
| GTPBP3 | 8277 | 31372 | 54467 |
| GTPBP4 | 8278 | 31373 | 54468 |
| GTPBP6 | 8279 | 31374 | 54469 |
| GTPBP8 | 8280 | 31375 | 54470 |
| GTSCR1 | 8281 | 31376 | 54471 |
| GTSE1 | 8282 | 31377 | 54472 |
| GTSF1 | 8283 | 31378 | 54473 |
| GTSF1L | 8284 | 31379 | 54474 |
| GUCA1A | 8285 | 31380 | 54475 |
| GUCA1B | 8286 | 31381 | 54476 |
| GUCA1C | 8287 | 31382 | 54477 |
| GUCA2A | 8288 | 31383 | 54478 |
| GUCA2B | 8289 | 31384 | 54479 |
| GUCD1 | 8290 | 31385 | 54480 |
| GUCD1 | 8291 | 31386 | 54481 |
| GUCY1A2 | 8292 | 31387 | 54482 |
| GUCY1A3 | 8293 | 31388 | 54483 |
| GUCY1A3 | 8294 | 31389 | 54484 |
| GUCY1B3 | 8295 | 31390 | 54485 |
| GUCY2C | 8296 | 31391 | 54486 |
| GUCY2D | 8297 | 31392 | 54487 |
| GUCY2F | 8298 | 31393 | 54488 |
| GUF1 | 8299 | 31394 | 54489 |
| GUK1 | 8300 | 31395 | 54490 |
| GUK1 | 8301 | 31396 | 54491 |
| GULP1 | 8302 | 31397 | 54492 |
| GULP1 | 8303 | 31398 | 54493 |
| GUSB | 8304 | 31399 | 54494 |
| GVQW2 | 8305 | 31400 | 54495 |
| GXYLT1 | 8306 | 31401 | 54496 |
| GXYLT2 | 8307 | 31402 | 54497 |
| GYG1 | 8308 | 31403 | 54498 |
| GYG1 | 8309 | 31404 | 54499 |
| GYG2 | 8310 | 31405 | 54500 |
| GYPA | 8311 | 31406 | 54501 |
| GYPB | 8312 | 31407 | 54502 |
| GYPC | 8313 | 31408 | 54503 |
| GYPC | 8314 | 31409 | 54504 |
| GYPE | 8315 | 31410 | 54505 |
| GYS1 | 8316 | 31411 | 54506 |
| GYS2 | 8317 | 31412 | 54507 |
| GZF1 | 8318 | 31413 | 54508 |
| GZF1 | 8319 | 31414 | 54509 |
| GZMA | 8320 | 31415 | 54510 |
| GZMB | 8321 | 31416 | 54511 |
| GZMH | 8322 | 31417 | 54512 |
| GZMK | 8323 | 31418 | 54513 |
| GZMM | 8324 | 31419 | 54514 |
| H2AFX | 8325 | 31420 | 54515 |
| H2AFZ | 8326 | 31421 | 54516 |
| H6PD | 8327 | 31422 | 54517 |
| HAAO | 8328 | 31423 | 54518 |
| HABP2 | 8329 | 31424 | 54519 |
| HABP4 | 8330 | 31425 | 54520 |
| HACD1 | 8331 | 31426 | 54521 |
| HACD2 | 8332 | 31427 | 54522 |
| HACD3 | 8333 | 31428 | 54523 |
| HACD4 | 8334 | 31429 | 54524 |
| HACE1 | 8335 | 31430 | 54525 |
| HACL1 | 8336 | 31431 | 54526 |
| HADH | 8337 | 31432 | 54527 |
| HADHA | 8338 | 31433 | 54528 |
| HADHB | 8339 | 31434 | 54529 |
| HAGH | 8340 | 31435 | 54530 |
| HAGH | 8341 | 31436 | 54531 |
| HAGHL | 8342 | 31437 | 54532 |
| HAGHL | 8343 | 31438 | 54533 |
| HAL | 8344 | 31439 | 54534 |
| HAL | 8345 | 31440 | 54535 |
| HAMP | 8346 | 31441 | 54536 |
| HAND1 | 8347 | 31442 | 54537 |
| HAND2 | 8348 | 31443 | 54538 |
| HAO1 | 8349 | 31444 | 54539 |
| HAO2 | 8350 | 31445 | 54540 |
| HAP1 | 8351 | 31446 | 54541 |
| HAPLN1 | 8352 | 31447 | 54542 |
| HAPLN2 | 8353 | 31448 | 54543 |
| HAPLN3 | 8354 | 31449 | 54544 |
| HAPLN4 | 8355 | 31450 | 54545 |
| HARBI1 | 8356 | 31451 | 54546 |
| HARS | 8357 | 31452 | 54547 |
| HARS2 | 8358 | 31453 | 54548 |
| HAS1 | 8359 | 31454 | 54549 |
| HAS2 | 8360 | 31455 | 54550 |
| HAS3 | 8361 | 31456 | 54551 |
| HAS3 | 8362 | 31457 | 54552 |
| HASPIN | 8363 | 31458 | 54553 |
| HAT1 | 8364 | 31459 | 54554 |
| HAUS1 | 8365 | 31460 | 54555 |
| HAUS2 | 8366 | 31461 | 54556 |
| HAUS2 | 8367 | 31462 | 54557 |
| HAUS3 | 8368 | 31463 | 54558 |
| HAUS4 | 8369 | 31464 | 54559 |
| HAUS5 | 8370 | 31465 | 54560 |
| HAUS6 | 8371 | 31466 | 54561 |
| HAUS7 | 8372 | 31467 | 54562 |
| HAUS8 | 8373 | 31468 | 54563 |
| HAVCR1 | 8374 | 31469 | 54564 |
| HAVCR1 | 8375 | 31470 | 54565 |
| HAVCR2 | 8376 | 31471 | 54566 |
| HAX1 | 8377 | 31472 | 54567 |
| HBA1 | 8378 | 31473 | 54568 |
| HBB | 8379 | 31474 | 54569 |
| HBD | 8380 | 31475 | 54570 |
| HBE1 | 8381 | 31476 | 54571 |
| HBEGF | 8382 | 31477 | 54572 |
| HBG1 | 8383 | 31478 | 54573 |
| HBM | 8384 | 31479 | 54574 |
| HBP1 | 8385 | 31480 | 54575 |
| HBQ1 | 8386 | 31481 | 54576 |
| HBS1L | 8387 | 31482 | 54577 |
| HBS1L | 8388 | 31483 | 54578 |
| HBZ | 8389 | 31484 | 54579 |
| HCAR1 | 8390 | 31485 | 54580 |
| HCAR2 | 8391 | 31486 | 54581 |
| HCAR3 | 8392 | 31487 | 54582 |
| HCCS | 8393 | 31488 | 54583 |
| HCFC1 | 8394 | 31489 | 54584 |
| HCFC1R1 | 8395 | 31490 | 54585 |
| HCFC2 | 8396 | 31491 | 54586 |
| HCG22 | 8397 | 31492 | 54587 |
| HCK | 8398 | 31493 | 54588 |
| HCLS1 | 8399 | 31494 | 54589 |
| HCN1 | 8400 | 31495 | 54590 |
| HCN2 | 8401 | 31496 | 54591 |
| HCN3 | 8402 | 31497 | 54592 |
| HCN4 | 8403 | 31498 | 54593 |
| HCRT | 8404 | 31499 | 54594 |
| HCRTR1 | 8405 | 31500 | 54595 |
| HCRTR2 | 8406 | 31501 | 54596 |
| HCST | 8407 | 31502 | 54597 |
| HDAC1 | 8408 | 31503 | 54598 |
| HDAC10 | 8409 | 31504 | 54599 |
| HDAC11 | 8410 | 31505 | 54600 |
| HDAC2 | 8411 | 31506 | 54601 |
| HDAC3 | 8412 | 31507 | 54602 |
| HDAC4 | 8413 | 31508 | 54603 |
| HDAC5 | 8414 | 31509 | 54604 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| HDAC6 | 8415 | 31510 | 54605 |
| HDAC6 | 8416 | 31511 | 54606 |
| HDAC7 | 8417 | 31512 | 54607 |
| HDAC8 | 8418 | 31513 | 54608 |
| HDAC8 | 8419 | 31514 | 54609 |
| HDAC8 | 8420 | 31515 | 54610 |
| HDAC8 | 8421 | 31516 | 54611 |
| HDAC9 | 8422 | 31517 | 54612 |
| HDAC9 | 8423 | 31518 | 54613 |
| HDAC9 | 8424 | 31519 | 54614 |
| HDAC9 | 8425 | 31520 | 54615 |
| HDC | 8426 | 31521 | 54616 |
| HDDC2 | 8427 | 31522 | 54617 |
| HDDC3 | 8428 | 31523 | 54618 |
| HDDC3 | 8429 | 31524 | 54619 |
| HDGF | 8430 | 31525 | 54620 |
| HDGFL1 | 8431 | 31526 | 54621 |
| HDGFL2 | 8432 | 31527 | 54622 |
| HDGFL3 | 8433 | 31528 | 54623 |
| HDHD2 | 8434 | 31529 | 54624 |
| HDHD3 | 8435 | 31530 | 54625 |
| HDHD5 | 8436 | 31531 | 54626 |
| HDLBP | 8437 | 31532 | 54627 |
| HDLBP | 8438 | 31533 | 54628 |
| HDX | 8439 | 31534 | 54629 |
| HEATR1 | 8440 | 31535 | 54630 |
| HEATR3 | 8441 | 31536 | 54631 |
| HEATR4 | 8442 | 31537 | 54632 |
| HEATR5A | 8443 | 31538 | 54633 |
| HEATR5B | 8444 | 31539 | 54634 |
| HEATR6 | 8445 | 31540 | 54635 |
| HEATR9 | 8446 | 31541 | 54636 |
| HEBP1 | 8447 | 31542 | 54637 |
| HEBP2 | 8448 | 31543 | 54638 |
| HEBP2 | 8449 | 31544 | 54639 |
| HECA | 8450 | 31545 | 54640 |
| HECTD1 | 8451 | 31546 | 54641 |
| HECTD2 | 8452 | 31547 | 54642 |
| HECTD2 | 8453 | 31548 | 54643 |
| HECTD3 | 8454 | 31549 | 54644 |
| HECTD4 | 8455 | 31550 | 54645 |
| HECW1 | 8456 | 31551 | 54646 |
| HECW2 | 8457 | 31552 | 54647 |
| HEG1 | 8458 | 31553 | 54648 |
| HELB | 8459 | 31554 | 54649 |
| HELLS | 8460 | 31555 | 54650 |
| HELQ | 8461 | 31556 | 54651 |
| HELQ | 8462 | 31557 | 54652 |
| HELT | 8463 | 31558 | 54653 |
| HELZ | 8464 | 31559 | 54654 |
| HELZ2 | 8465 | 31560 | 54655 |
| HEMGN | 8466 | 31561 | 54656 |
| HEMK1 | 8467 | 31562 | 54657 |
| HENMT1 | 8468 | 31563 | 54658 |
| HEPACAM | 8469 | 31564 | 54659 |
| HEPACAM2 | 8470 | 31565 | 54660 |
| HEPH | 8471 | 31566 | 54661 |
| HEPHL1 | 8472 | 31567 | 54662 |
| HEPN1 | 8473 | 31568 | 54663 |
| HERC1 | 8474 | 31569 | 54664 |
| HERC2 | 8475 | 31570 | 54665 |
| HERC3 | 8476 | 31571 | 54666 |
| HERC3 | 8477 | 31572 | 54667 |
| HERC4 | 8478 | 31573 | 54668 |
| HERC4 | 8479 | 31574 | 54669 |
| HERC5 | 8480 | 31575 | 54670 |
| HERC6 | 8481 | 31576 | 54671 |
| HERPUD1 | 8482 | 31577 | 54672 |
| HERPUD1 | 8483 | 31578 | 54673 |
| HERPUD2 | 8484 | 31579 | 54674 |
| HES1 | 8485 | 31580 | 54675 |
| HES2 | 8486 | 31581 | 54676 |
| HES3 | 8487 | 31582 | 54677 |
| HES4 | 8488 | 31583 | 54678 |
| HES5 | 8489 | 31584 | 54679 |
| HES6 | 8490 | 31585 | 54680 |
| HES7 | 8491 | 31586 | 54681 |
| HESX1 | 8492 | 31587 | 54682 |
| HEXA | 8493 | 31588 | 54683 |
| HEXB | 8494 | 31589 | 54684 |
| HEXDC | 8495 | 31590 | 54685 |
| HEXDC | 8496 | 31591 | 54686 |
| HEXIM1 | 8497 | 31592 | 54687 |
| HEXIM2 | 8498 | 31593 | 54688 |
| HEY1 | 8499 | 31594 | 54689 |
| HEY2 | 8500 | 31595 | 54690 |
| HEYL | 8501 | 31596 | 54691 |
| HFE | 8502 | 31597 | 54692 |
| HFE | 8503 | 31598 | 54693 |
| HFE | 8504 | 31599 | 54694 |
| HFE2 | 8505 | 31600 | 54695 |
| HFM1 | 8506 | 31601 | 54696 |
| HGC6.3 | 8507 | 31602 | 54697 |
| HGD | 8508 | 31603 | 54698 |
| HGF | 8509 | 31604 | 54699 |
| HGF | 8510 | 31605 | 54700 |
| HGF | 8511 | 31606 | 54701 |
| HGFAC | 8512 | 31607 | 54702 |
| HGH1 | 8513 | 31608 | 54703 |
| HGS | 8514 | 31609 | 54704 |
| HGSNAT | 8515 | 31610 | 54705 |
| HHAT | 8516 | 31611 | 54706 |
| HHATL | 8517 | 31612 | 54707 |
| HHEX | 8518 | 31613 | 54708 |
| HHIP | 8519 | 31614 | 54709 |
| HHIPL1 | 8520 | 31615 | 54710 |
| HHIPL1 | 8521 | 31616 | 54711 |
| HHIPL2 | 8522 | 31617 | 54712 |
| HHLA1 | 8523 | 31618 | 54713 |
| HHLA2 | 8524 | 31619 | 54714 |
| HHLA3 | 8525 | 31620 | 54715 |
| HHLA3 | 8526 | 31621 | 54716 |
| HIBADH | 8527 | 31622 | 54717 |
| HIBCH | 8528 | 31623 | 54718 |
| HIBCH | 8529 | 31624 | 54719 |
| HIC1 | 8530 | 31625 | 54720 |
| HIC2 | 8531 | 31626 | 54721 |
| HID1 | 8532 | 31627 | 54722 |
| HIF1A | 8533 | 31628 | 54723 |
| HIF1A | 8534 | 31629 | 54724 |
| HIF1AN | 8535 | 31630 | 54725 |
| HIF3A | 8536 | 31631 | 54726 |
| HIF3A | 8537 | 31632 | 54727 |
| HIGD1A | 8538 | 31633 | 54728 |
| HIGD1B | 8539 | 31634 | 54729 |
| HIGD1C | 8540 | 31635 | 54730 |
| HIGD2A | 8541 | 31636 | 54731 |
| HIGD2B | 8542 | 31637 | 54732 |
| HIKESHI | 8543 | 31638 | 54733 |
| HILPDA | 8544 | 31639 | 54734 |
| HINFP | 8545 | 31640 | 54735 |
| HINFP | 8546 | 31641 | 54736 |
| HINT1 | 8547 | 31642 | 54737 |
| HINT2 | 8548 | 31643 | 54738 |
| HINT3 | 8549 | 31644 | 54739 |
| HIP1 | 8550 | 31645 | 54740 |
| HIP1R | 8551 | 31646 | 54741 |
| HIP1R | 8552 | 31647 | 54742 |
| HIPK1 | 8553 | 31648 | 54743 |
| HIPK1 | 8554 | 31649 | 54744 |
| HIPK2 | 8555 | 31650 | 54745 |
| HIPK3 | 8556 | 31651 | 54746 |
| HIPK4 | 8557 | 31652 | 54747 |
| HIRA | 8558 | 31653 | 54748 |
| HIRIP3 | 8559 | 31654 | 54749 |
| HIST1H1C | 8560 | 31655 | 54750 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| HIST1H1E | 8561 | 31656 | 54751 |
| HIST1H2AM | 8562 | 31657 | 54752 |
| HIST1H2BN | 8563 | 31658 | 54753 |
| HIST1H3F | 8564 | 31659 | 54754 |
| HIST1H3H | 8565 | 31660 | 54755 |
| HIST1H4C | 8566 | 31661 | 54756 |
| HIST1H4D | 8567 | 31662 | 54757 |
| HIST1H4H | 8568 | 31663 | 54758 |
| HIST1H4J | 8569 | 31664 | 54759 |
| HIST2H2AA3 | 8570 | 31665 | 54760 |
| HIST2H3C | 8571 | 31666 | 54761 |
| HIST2H4B | 8572 | 31667 | 54762 |
| HIST3H2A | 8573 | 31668 | 54763 |
| HIST3H2BB | 8574 | 31669 | 54764 |
| HIVEP1 | 8575 | 31670 | 54765 |
| HIVEP2 | 8576 | 31671 | 54766 |
| HIVEP3 | 8577 | 31672 | 54767 |
| HJURP | 8578 | 31673 | 54768 |
| HK1 | 8579 | 31674 | 54769 |
| HK2 | 8580 | 31675 | 54770 |
| HK3 | 8581 | 31676 | 54771 |
| HKDC1 | 8582 | 31677 | 54772 |
| HKR1 | 8583 | 31678 | 54773 |
| HKR1 | 8584 | 31679 | 54774 |
| HLA-C | 8585 | 31680 | 54775 |
| HLA-DMA | 8586 | 31681 | 54776 |
| HLA-DMB | 8587 | 31682 | 54777 |
| HLA-DOA | 8588 | 31683 | 54778 |
| HLA-DOB | 8589 | 31684 | 54779 |
| HLA-DPA1 | 8590 | 31685 | 54780 |
| HLA-DPB1 | 8591 | 31686 | 54781 |
| HLA-DQA1 | 8592 | 31687 | 54782 |
| HLA-DQA2 | 8593 | 31688 | 54783 |
| HLA-DQB1 | 8594 | 31689 | 54784 |
| HLA-DQB1 | 8595 | 31690 | 54785 |
| HLA-DQB1 | 8596 | 31691 | 54786 |
| HLA-DQB2 | 8597 | 31692 | 54787 |
| HLA-DRA | 8598 | 31693 | 54788 |
| HLA-DRB1 | 8599 | 31694 | 54789 |
| HLA-DRB1 | 8600 | 31695 | 54790 |
| HLA-DRB4 | 8601 | 31696 | 54791 |
| HLA-DRB5 | 8602 | 31697 | 54792 |
| HLA-E | 8603 | 31698 | 54793 |
| HLA-F | 8604 | 31699 | 54794 |
| HLA-F | 8605 | 31700 | 54795 |
| HLA-G | 8606 | 31701 | 54796 |
| HLCS | 8607 | 31702 | 54797 |
| HLF | 8608 | 31703 | 54798 |
| HLTF | 8609 | 31704 | 54799 |
| HLX | 8610 | 31705 | 54800 |
| HM13 | 8611 | 31706 | 54801 |
| HM13 | 8612 | 31707 | 54802 |
| HM13 | 8613 | 31708 | 54803 |
| HMBOX1 | 8614 | 31709 | 54804 |
| HMBOX1 | 8615 | 31710 | 54805 |
| HMBOX1 | 8616 | 31711 | 54806 |
| HMBS | 8617 | 31712 | 54807 |
| HMCES | 8618 | 31713 | 54808 |
| HMCN1 | 8619 | 31714 | 54809 |
| HMCN2 | 8620 | 31715 | 54810 |
| HMG20A | 8621 | 31716 | 54811 |
| HMG20B | 8622 | 31717 | 54812 |
| HMGA1 | 8623 | 31718 | 54813 |
| HMGA2 | 8624 | 31719 | 54814 |
| HMGA2 | 8625 | 31720 | 54815 |
| HMGA2 | 8626 | 31721 | 54816 |
| HMGA2 | 8627 | 31722 | 54817 |
| HMGB1 | 8628 | 31723 | 54818 |
| HMGB2 | 8629 | 31724 | 54819 |
| HMGB3 | 8630 | 31725 | 54820 |
| HMGB4 | 8631 | 31726 | 54821 |
| HMGCL | 8632 | 31727 | 54822 |
| HMGCLL1 | 8633 | 31728 | 54823 |
| HMGCR | 8634 | 31729 | 54824 |
| HMGCS1 | 8635 | 31730 | 54825 |
| HMGCS2 | 8636 | 31731 | 54826 |
| HMGN1 | 8637 | 31732 | 54827 |
| HMGN2 | 8638 | 31733 | 54828 |
| HMGN3 | 8639 | 31734 | 54829 |
| HMGN3 | 8640 | 31735 | 54830 |
| HMGN3 | 8641 | 31736 | 54831 |
| HMGN3 | 8642 | 31737 | 54832 |
| HMGN4 | 8643 | 31738 | 54833 |
| HMGN5 | 8644 | 31739 | 54834 |
| HMGXB3 | 8645 | 31740 | 54835 |
| HMGXB4 | 8646 | 31741 | 54836 |
| HMHB1 | 8647 | 31742 | 54837 |
| HMMR | 8648 | 31743 | 54838 |
| HMOX1 | 8649 | 31744 | 54839 |
| HMOX2 | 8650 | 31745 | 54840 |
| HMSD | 8651 | 31746 | 54841 |
| HMX1 | 8652 | 31747 | 54842 |
| HMX1 | 8653 | 31748 | 54843 |
| HMX2 | 8654 | 31749 | 54844 |
| HMX3 | 8655 | 31750 | 54845 |
| HNF1A | 8656 | 31751 | 54846 |
| HNF1B | 8657 | 31752 | 54847 |
| HNF1B | 8658 | 31753 | 54848 |
| HNF4A | 8659 | 31754 | 54849 |
| HNF4A | 8660 | 31755 | 54850 |
| HNF4G | 8661 | 31756 | 54851 |
| HNMT | 8662 | 31757 | 54852 |
| HNMT | 8663 | 31758 | 54853 |
| HNMT | 8664 | 31759 | 54854 |
| HNRNPAO | 8665 | 31760 | 54855 |
| HNRNPA1 | 8666 | 31761 | 54856 |
| HNRNPA2B1 | 8667 | 31762 | 54857 |
| HNRNPA3 | 8668 | 31763 | 54858 |
| HNRNPAB | 8669 | 31764 | 54859 |
| HNRNPC | 8670 | 31765 | 54860 |
| HNRNPCL2 | 8671 | 31766 | 54861 |
| HNRNPD | 8672 | 31767 | 54862 |
| HNRNPDL | 8673 | 31768 | 54863 |
| HNRNPF | 8674 | 31769 | 54864 |
| HNRNPH1 | 8675 | 31770 | 54865 |
| HNRNPH2 | 8676 | 31771 | 54866 |
| HNRNPH3 | 8677 | 31772 | 54867 |
| HNRNPK | 8678 | 31773 | 54868 |
| HNRNPK | 8679 | 31774 | 54869 |
| HNRNPL | 8680 | 31775 | 54870 |
| HNRNPLL | 8681 | 31776 | 54871 |
| HNRNPM | 8682 | 31777 | 54872 |
| HNRNPR | 8683 | 31778 | 54873 |
| HNRNPU | 8684 | 31779 | 54874 |
| HNRNPUL1 | 8685 | 31780 | 54875 |
| HNRNPUL2 | 8686 | 31781 | 54876 |
| HOGA1 | 8687 | 31782 | 54877 |
| HOMER1 | 8688 | 31783 | 54878 |
| HOMER1 | 8689 | 31784 | 54879 |
| HOMER2 | 8690 | 31785 | 54880 |
| HOMER3 | 8691 | 31786 | 54881 |
| HOMEZ | 8692 | 31787 | 54882 |
| HOOK1 | 8693 | 31788 | 54883 |
| HOOK2 | 8694 | 31789 | 54884 |
| HOOK3 | 8695 | 31790 | 54885 |
| HOPX | 8696 | 31791 | 54886 |
| HOPX | 8697 | 31792 | 54887 |
| HORMAD1 | 8698 | 31793 | 54888 |
| HORMAD2 | 8699 | 31794 | 54889 |
| HOTS | 8700 | 31795 | 54890 |
| HOXA1 | 8701 | 31796 | 54891 |
| HOXA1 | 8702 | 31797 | 54892 |
| HOXA10 | 8703 | 31798 | 54893 |
| HOXA11 | 8704 | 31799 | 54894 |
| HOXA13 | 8705 | 31800 | 54895 |
| HOXA2 | 8706 | 31801 | 54896 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| HOXA3 | 8707 | 31802 | 54897 |
| HOXA4 | 8708 | 31803 | 54898 |
| HOXA5 | 8709 | 31804 | 54899 |
| HOXA6 | 8710 | 31805 | 54900 |
| HOXA7 | 8711 | 31806 | 54901 |
| HOXA9 | 8712 | 31807 | 54902 |
| HOXB1 | 8713 | 31808 | 54903 |
| HOXB13 | 8714 | 31809 | 54904 |
| HOXB2 | 8715 | 31810 | 54905 |
| HOXB3 | 8716 | 31811 | 54906 |
| HOXB4 | 8717 | 31812 | 54907 |
| HOXB5 | 8718 | 31813 | 54908 |
| HOXB6 | 8719 | 31814 | 54909 |
| HOXB7 | 8720 | 31815 | 54910 |
| HOXB8 | 8721 | 31816 | 54911 |
| HOXB9 | 8722 | 31817 | 54912 |
| HOXC10 | 8723 | 31818 | 54913 |
| HOXC11 | 8724 | 31819 | 54914 |
| HOXC12 | 8725 | 31820 | 54915 |
| HOXC13 | 8726 | 31821 | 54916 |
| HOXC4 | 8727 | 31822 | 54917 |
| HOXC5 | 8728 | 31823 | 54918 |
| HOXC6 | 8729 | 31824 | 54919 |
| HOXC8 | 8730 | 31825 | 54920 |
| HOXC9 | 8731 | 31826 | 54921 |
| HOXD1 | 8732 | 31827 | 54922 |
| HOXD10 | 8733 | 31828 | 54923 |
| HOXD11 | 8734 | 31829 | 54924 |
| HOXD12 | 8735 | 31830 | 54925 |
| HOXD13 | 8736 | 31831 | 54926 |
| HOXD3 | 8737 | 31832 | 54927 |
| HOXD4 | 8738 | 31833 | 54928 |
| HOXD8 | 8739 | 31834 | 54929 |
| HOXD9 | 8740 | 31835 | 54930 |
| HP | 8741 | 31836 | 54931 |
| HP1BP3 | 8742 | 31837 | 54932 |
| HPCA | 8743 | 31838 | 54933 |
| HPCAL1 | 8744 | 31839 | 54934 |
| HPCAL4 | 8745 | 31840 | 54935 |
| HPD | 8746 | 31841 | 54936 |
| HPDL | 8747 | 31842 | 54937 |
| HPF1 | 8748 | 31843 | 54938 |
| HPGD | 8749 | 31844 | 54939 |
| HPGDS | 8750 | 31845 | 54940 |
| HPN | 8751 | 31846 | 54941 |
| HPRT1 | 8752 | 31847 | 54942 |
| HPS1 | 8753 | 31848 | 54943 |
| HPS1 | 8754 | 31849 | 54944 |
| HPS1 | 8755 | 31850 | 54945 |
| HPS3 | 8756 | 31851 | 54946 |
| HPS4 | 8757 | 31852 | 54947 |
| HPS4 | 8758 | 31853 | 54948 |
| HPS4 | 8759 | 31854 | 54949 |
| HPS5 | 8760 | 31855 | 54950 |
| HPS6 | 8761 | 31856 | 54951 |
| HPSE | 8762 | 31857 | 54952 |
| HPSE2 | 8763 | 31858 | 54953 |
| HPSE2 | 8764 | 31859 | 54954 |
| HPX | 8765 | 31860 | 54955 |
| HR | 8766 | 31861 | 54956 |
| HRAS | 8767 | 31862 | 54957 |
| HRAS | 8768 | 31863 | 54958 |
| HRASLS | 8769 | 31864 | 54959 |
| HRASLS2 | 8770 | 31865 | 54960 |
| HRASLS5 | 8771 | 31866 | 54961 |
| HRASLS5 | 8772 | 31867 | 54962 |
| HRC | 8773 | 31868 | 54963 |
| HRCT1 | 8774 | 31869 | 54964 |
| HRG | 8775 | 31870 | 54965 |
| HRH1 | 8776 | 31871 | 54966 |
| HRH2 | 8777 | 31872 | 54967 |
| HRH2 | 8778 | 31873 | 54968 |
| HRH3 | 8779 | 31874 | 54969 |
| HRH4 | 8780 | 31875 | 54970 |
| HRK | 8781 | 31876 | 54971 |
| HRNR | 8782 | 31877 | 54972 |
| HS1BP3 | 8783 | 31878 | 54973 |
| HS2ST1 | 8784 | 31879 | 54974 |
| HS2ST1 | 8785 | 31880 | 54975 |
| HS3ST1 | 8786 | 31881 | 54976 |
| HS3ST2 | 8787 | 31882 | 54977 |
| HS3ST3A1 | 8788 | 31883 | 54978 |
| HS3ST3B1 | 8789 | 31884 | 54979 |
| HS3ST4 | 8790 | 31885 | 54980 |
| HS3ST5 | 8791 | 31886 | 54981 |
| HS3ST6 | 8792 | 31887 | 54982 |
| HS6ST1 | 8793 | 31888 | 54983 |
| HS6ST2 | 8794 | 31889 | 54984 |
| HS6ST3 | 8795 | 31890 | 54985 |
| HSBP1 | 8796 | 31891 | 54986 |
| HSBP1L1 | 8797 | 31892 | 54987 |
| HSCB | 8798 | 31893 | 54988 |
| HSCB | 8799 | 31894 | 54989 |
| HSD11B1 | 8800 | 31895 | 54990 |
| HSD11B1L | 8801 | 31896 | 54991 |
| HSD11B1L | 8802 | 31897 | 54992 |
| HSD11B1L | 8803 | 31898 | 54993 |
| HSD11B2 | 8804 | 31899 | 54994 |
| HSD17B1 | 8805 | 31900 | 54995 |
| HSD17B10 | 8806 | 31901 | 54996 |
| HSD17B11 | 8807 | 31902 | 54997 |
| HSD17B12 | 8808 | 31903 | 54998 |
| HSD17B13 | 8809 | 31904 | 54999 |
| HSD17B14 | 8810 | 31905 | 55000 |
| HSD17B2 | 8811 | 31906 | 55001 |
| HSD17B3 | 8812 | 31907 | 55002 |
| HSD17B4 | 8813 | 31908 | 55003 |
| HSD17B6 | 8814 | 31909 | 55004 |
| HSD17B7 | 8815 | 31910 | 55005 |
| HSD17B7 | 8816 | 31911 | 55006 |
| HSD17B7 | 8817 | 31912 | 55007 |
| HSD17B8 | 8818 | 31913 | 55008 |
| HSD3B2 | 8819 | 31914 | 55009 |
| HSD3B7 | 8820 | 31915 | 55010 |
| HSD3B7 | 8821 | 31916 | 55011 |
| HSDL1 | 8822 | 31917 | 55012 |
| HSDL2 | 8823 | 31918 | 55013 |
| HSF1 | 8824 | 31919 | 55014 |
| HSF2 | 8825 | 31920 | 55015 |
| HSF2 | 8826 | 31921 | 55016 |
| HSF2BP | 8827 | 31922 | 55017 |
| HSF4 | 8828 | 31923 | 55018 |
| HSF5 | 8829 | 31924 | 55019 |
| HSFX2 | 8830 | 31925 | 55020 |
| HSFX3 | 8831 | 31926 | 55021 |
| HSFX4 | 8832 | 31927 | 55022 |
| HSFY1 | 8833 | 31928 | 55023 |
| HSFY2 | 8834 | 31929 | 55024 |
| HSH2D | 8835 | 31930 | 55025 |
| HSH2D | 8836 | 31931 | 55026 |
| HSP90AA1 | 8837 | 31932 | 55027 |
| HSP90AB1 | 8838 | 31933 | 55028 |
| HSP90B1 | 8839 | 31934 | 55029 |
| HSPA12A | 8840 | 31935 | 55030 |
| HSPA12B | 8841 | 31936 | 55031 |
| HSPA13 | 8842 | 31937 | 55032 |
| HSPA14 | 8843 | 31938 | 55033 |
| HSPA14 | 8844 | 31939 | 55034 |
| HSPA1A | 8845 | 31940 | 55035 |
| HSPA1B | 8846 | 31941 | 55036 |
| HSPA1L | 8847 | 31942 | 55037 |
| HSPA2 | 8848 | 31943 | 55038 |
| HSPA4 | 8849 | 31944 | 55039 |
| HSPA4L | 8850 | 31945 | 55040 |
| HSPA5 | 8851 | 31946 | 55041 |
| HSPA6 | 8852 | 31947 | 55042 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| HSPA8 | 8853 | 31948 | 55043 |
| HSPA9 | 8854 | 31949 | 55044 |
| HSPB1 | 8855 | 31950 | 55045 |
| HSPB11 | 8856 | 31951 | 55046 |
| HSPB2 | 8857 | 31952 | 55047 |
| HSPB3 | 8858 | 31953 | 55048 |
| HSPB6 | 8859 | 31954 | 55049 |
| HSPB7 | 8860 | 31955 | 55050 |
| HSPB8 | 8861 | 31956 | 55051 |
| HSPB9 | 8862 | 31957 | 55052 |
| HSPBAP1 | 8863 | 31958 | 55053 |
| HSPBP1 | 8864 | 31959 | 55054 |
| HSPD1 | 8865 | 31960 | 55055 |
| HSPE1 | 8866 | 31961 | 55056 |
| HSPG2 | 8867 | 31962 | 55057 |
| HSPH1 | 8868 | 31963 | 55058 |
| HSPH1 | 8869 | 31964 | 55059 |
| HTATIP2 | 8870 | 31965 | 55060 |
| HTATIP2 | 8871 | 31966 | 55061 |
| HTATSF1 | 8872 | 31967 | 55062 |
| HTN1 | 8873 | 31968 | 55063 |
| HTN3 | 8874 | 31969 | 55064 |
| HTR1A | 8875 | 31970 | 55065 |
| HTR1B | 8876 | 31971 | 55066 |
| HTR1D | 8877 | 31972 | 55067 |
| HTR1E | 8878 | 31973 | 55068 |
| HTR1F | 8879 | 31974 | 55069 |
| HTR2A | 8880 | 31975 | 55070 |
| HTR2B | 8881 | 31976 | 55071 |
| HTR2C | 8882 | 31977 | 55072 |
| HTR3A | 8883 | 31978 | 55073 |
| HTR3B | 8884 | 31979 | 55074 |
| HTR3C | 8885 | 31980 | 55075 |
| HTR3D | 8886 | 31981 | 55076 |
| HTR4 | 8887 | 31982 | 55077 |
| HTR4 | 8888 | 31983 | 55078 |
| HTR4 | 8889 | 31984 | 55079 |
| HTR4 | 8890 | 31985 | 55080 |
| HTR4 | 8891 | 31986 | 55081 |
| HTR5A | 8892 | 31987 | 55082 |
| HTR6 | 8893 | 31988 | 55083 |
| HTR7 | 8894 | 31989 | 55084 |
| HTR7 | 8895 | 31990 | 55085 |
| HTRA1 | 8896 | 31991 | 55086 |
| HTRA2 | 8897 | 31992 | 55087 |
| HTRA3 | 8898 | 31993 | 55088 |
| HTRA3 | 8899 | 31994 | 55089 |
| HTRA4 | 8900 | 31995 | 55090 |
| HTT | 8901 | 31996 | 55091 |
| HUNK | 8902 | 31997 | 55092 |
| HUS1 | 8903 | 31998 | 55093 |
| HUS1B | 8904 | 31999 | 55094 |
| HUWE1 | 8905 | 32000 | 55095 |
| HVCN1 | 8906 | 32001 | 55096 |
| HYAL1 | 8907 | 32002 | 55097 |
| HYAL2 | 8908 | 32003 | 55098 |
| HYAL3 | 8909 | 32004 | 55099 |
| HYAL4 | 8910 | 32005 | 55100 |
| HYDIN | 8911 | 32006 | 55101 |
| HYDIN | 8912 | 32007 | 55102 |
| HYDIN | 8913 | 32008 | 55103 |
| HYI | 8914 | 32009 | 55104 |
| HYI | 8915 | 32010 | 55105 |
| HYKK | 8916 | 32011 | 55106 |
| HYKK | 8917 | 32012 | 55107 |
| HYLS1 | 8918 | 32013 | 55108 |
| HYOU1 | 8919 | 32014 | 55109 |
| HYPK | 8920 | 32015 | 55110 |
| HYPM | 8921 | 32016 | 55111 |
| IAH1 | 8922 | 32017 | 55112 |
| IAPP | 8923 | 32018 | 55113 |
| IARS | 8924 | 32019 | 55114 |
| IARS2 | 8925 | 32020 | 55115 |
| IBA57 | 8926 | 32021 | 55116 |
| IBSP | 8927 | 32022 | 55117 |
| IBTK | 8928 | 32023 | 55118 |
| ICA1 | 8929 | 32024 | 55119 |
| ICA1L | 8930 | 32025 | 55120 |
| ICA1L | 8931 | 32026 | 55121 |
| ICAM1 | 8932 | 32027 | 55122 |
| ICAM2 | 8933 | 32028 | 55123 |
| ICAM3 | 8934 | 32029 | 55124 |
| ICAM4 | 8935 | 32030 | 55125 |
| ICAM4 | 8936 | 32031 | 55126 |
| ICAM5 | 8937 | 32032 | 55127 |
| ICE1 | 8938 | 32033 | 55128 |
| ICE2 | 8939 | 32034 | 55129 |
| ICE2 | 8940 | 32035 | 55130 |
| ICK | 8941 | 32036 | 55131 |
| ICMT | 8942 | 32037 | 55132 |
| ICOS | 8943 | 32038 | 55133 |
| ICOSLG | 8944 | 32039 | 55134 |
| ICOSLG | 8945 | 32040 | 55135 |
| ID1 | 8946 | 32041 | 55136 |
| ID1 | 8947 | 32042 | 55137 |
| ID2 | 8948 | 32043 | 55138 |
| ID3 | 8949 | 32044 | 55139 |
| ID4 | 8950 | 32045 | 55140 |
| IDE | 8951 | 32046 | 55141 |
| IDH1 | 8952 | 32047 | 55142 |
| IDH2 | 8953 | 32048 | 55143 |
| IDH3A | 8954 | 32049 | 55144 |
| IDH3B | 8955 | 32050 | 55145 |
| IDH3B | 8956 | 32051 | 55146 |
| IDH3B | 8957 | 32052 | 55147 |
| IDH3B | 8958 | 32053 | 55148 |
| IDH3G | 8959 | 32054 | 55149 |
| IDH3G | 8960 | 32055 | 55150 |
| IDI1 | 8961 | 32056 | 55151 |
| IDI2 | 8962 | 32057 | 55152 |
| IDNK | 8963 | 32058 | 55153 |
| IDO1 | 8964 | 32059 | 55154 |
| IDO2 | 8965 | 32060 | 55155 |
| IDS | 8966 | 32061 | 55156 |
| IDS | 8967 | 32062 | 55157 |
| IDUA | 8968 | 32063 | 55158 |
| IER2 | 8969 | 32064 | 55159 |
| IER3 | 8970 | 32065 | 55160 |
| IER3IP1 | 8971 | 32066 | 55161 |
| IER5 | 8972 | 32067 | 55162 |
| IER5L | 8973 | 32068 | 55163 |
| IFFO1 | 8974 | 32069 | 55164 |
| IFFO2 | 8975 | 32070 | 55165 |
| IFI16 | 8976 | 32071 | 55166 |
| IFI27 | 8977 | 32072 | 55167 |
| IFI27 | 8978 | 32073 | 55168 |
| IFI27L1 | 8979 | 32074 | 55169 |
| IFI27L2 | 8980 | 32075 | 55170 |
| IFI30 | 8981 | 32076 | 55171 |
| IFI35 | 8982 | 32077 | 55172 |
| IFI44 | 8983 | 32078 | 55173 |
| IFI44L | 8984 | 32079 | 55174 |
| IFI6 | 8985 | 32080 | 55175 |
| IFIH1 | 8986 | 32081 | 55176 |
| IFIT1 | 8987 | 32082 | 55177 |
| IFIT1B | 8988 | 32083 | 55178 |
| IFIT2 | 8989 | 32084 | 55179 |
| IFIT3 | 8990 | 32085 | 55180 |
| IFIT5 | 8991 | 32086 | 55181 |
| IFITM1 | 8992 | 32087 | 55182 |
| IFITM10 | 8993 | 32088 | 55183 |
| IFITM2 | 8994 | 32089 | 55184 |
| IFITM3 | 8995 | 32090 | 55185 |
| IFITM5 | 8996 | 32091 | 55186 |
| IFNA1 | 8997 | 32092 | 55187 |
| IFNA16 | 8998 | 32093 | 55188 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| IFNA21 | 8999 | 32094 | 55189 |
| IFNA4 | 9000 | 32095 | 55190 |
| IFNA6 | 9001 | 32096 | 55191 |
| IFNA8 | 9002 | 32097 | 55192 |
| IFNAR1 | 9003 | 32098 | 55193 |
| IFNAR2 | 9004 | 32099 | 55194 |
| IFNAR2 | 9005 | 32100 | 55195 |
| IFNAR2 | 9006 | 32101 | 55196 |
| IFNB1 | 9007 | 32102 | 55197 |
| IFNE | 9008 | 32103 | 55198 |
| IFNG | 9009 | 32104 | 55199 |
| IFNGR1 | 9010 | 32105 | 55200 |
| IFNGR2 | 9011 | 32106 | 55201 |
| IFNK | 9012 | 32107 | 55202 |
| IFNL1 | 9013 | 32108 | 55203 |
| IFNL2 | 9014 | 32109 | 55204 |
| IFNL3 | 9015 | 32110 | 55205 |
| IFNL4 | 9016 | 32111 | 55206 |
| IFNLR1 | 9017 | 32112 | 55207 |
| IFNW1 | 9018 | 32113 | 55208 |
| IFRD1 | 9019 | 32114 | 55209 |
| IFRD2 | 9020 | 32115 | 55210 |
| IFT122 | 9021 | 32116 | 55211 |
| IFT140 | 9022 | 32117 | 55212 |
| IFT172 | 9023 | 32118 | 55213 |
| IFT20 | 9024 | 32119 | 55214 |
| IFT20 | 9025 | 32120 | 55215 |
| IFT22 | 9026 | 32121 | 55216 |
| IFT27 | 9027 | 32122 | 55217 |
| IFT43 | 9028 | 32123 | 55218 |
| IFT43 | 9029 | 32124 | 55219 |
| IFT46 | 9030 | 32125 | 55220 |
| IFT52 | 9031 | 32126 | 55221 |
| IFT52 | 9032 | 32127 | 55222 |
| IFT52 | 9033 | 32128 | 55223 |
| IFT57 | 9034 | 32129 | 55224 |
| IFT74 | 9035 | 32130 | 55225 |
| IFT74 | 9036 | 32131 | 55226 |
| IFT74 | 9037 | 32132 | 55227 |
| IFT80 | 9038 | 32133 | 55228 |
| IFT81 | 9039 | 32134 | 55229 |
| IFT81 | 9040 | 32135 | 55230 |
| IFT88 | 9041 | 32136 | 55231 |
| IFT88 | 9042 | 32137 | 55232 |
| IGBP1 | 9043 | 32138 | 55233 |
| IGDCC3 | 9044 | 32139 | 55234 |
| IGDCC4 | 9045 | 32140 | 55235 |
| IGF1 | 9046 | 32141 | 55236 |
| IGF1 | 9047 | 32142 | 55237 |
| IGF1 | 9048 | 32143 | 55238 |
| IGF1R | 9049 | 32144 | 55239 |
| IGF2 | 9050 | 32145 | 55240 |
| IGF2BP1 | 9051 | 32146 | 55241 |
| IGF2BP2 | 9052 | 32147 | 55242 |
| IGF2BP3 | 9053 | 32148 | 55243 |
| IGF2R | 9054 | 32149 | 55244 |
| IGFALS | 9055 | 32150 | 55245 |
| IGFBP1 | 9056 | 32151 | 55246 |
| IGFBP2 | 9057 | 32152 | 55247 |
| IGFBP3 | 9058 | 32153 | 55248 |
| IGFBP4 | 9059 | 32154 | 55249 |
| IGFBP5 | 9060 | 32155 | 55250 |
| IGFBP6 | 9061 | 32156 | 55251 |
| IGFBP7 | 9062 | 32157 | 55252 |
| IGFBP7 | 9063 | 32158 | 55253 |
| IGFBPL1 | 9064 | 32159 | 55254 |
| IGFL1 | 9065 | 32160 | 55255 |
| IGFL2 | 9066 | 32161 | 55256 |
| IGFL3 | 9067 | 32162 | 55257 |
| IGFL4 | 9068 | 32163 | 55258 |
| IGFLR1 | 9069 | 32164 | 55259 |
| IGFLR1 | 9070 | 32165 | 55260 |
| IGFN1 | 9071 | 32166 | 55261 |
| IGHMBP2 | 9072 | 32167 | 55262 |
| IGIP | 9073 | 32168 | 55263 |
| IGLL1 | 9074 | 32169 | 55264 |
| IGLL1 | 9075 | 32170 | 55265 |
| IGLL5 | 9076 | 32171 | 55266 |
| IGLON5 | 9077 | 32172 | 55267 |
| IGSF1 | 9078 | 32173 | 55268 |
| IGSF1 | 9079 | 32174 | 55269 |
| IGSF10 | 9080 | 32175 | 55270 |
| IGSF11 | 9081 | 32176 | 55271 |
| IGSF21 | 9082 | 32177 | 55272 |
| IGSF22 | 9083 | 32178 | 55273 |
| IGSF23 | 9084 | 32179 | 55274 |
| IGSF3 | 9085 | 32180 | 55275 |
| IGSF5 | 9086 | 32181 | 55276 |
| IGSF6 | 9087 | 32182 | 55277 |
| IGSF8 | 9088 | 32183 | 55278 |
| IGSF9 | 9089 | 32184 | 55279 |
| IGSF9B | 9090 | 32185 | 55280 |
| IHH | 9091 | 32186 | 55281 |
| IK | 9092 | 32187 | 55282 |
| IKBIP | 9093 | 32188 | 55283 |
| IKBIP | 9094 | 32189 | 55284 |
| IKBKB | 9095 | 32190 | 55285 |
| IKBKE | 9096 | 32191 | 55286 |
| IKBKE | 9097 | 32192 | 55287 |
| IKBKG | 9098 | 32193 | 55288 |
| IKZF1 | 9099 | 32194 | 55289 |
| IKZF1 | 9100 | 32195 | 55290 |
| IKZF1 | 9101 | 32196 | 55291 |
| IKZF2 | 9102 | 32197 | 55292 |
| IKZF3 | 9103 | 32198 | 55293 |
| IKZF3 | 9104 | 32199 | 55294 |
| IKZF4 | 9105 | 32200 | 55295 |
| IKZF5 | 9106 | 32201 | 55296 |
| IL10 | 9107 | 32202 | 55297 |
| IL10RA | 9108 | 32203 | 55298 |
| IL10RB | 9109 | 32204 | 55299 |
| IL11 | 9110 | 32205 | 55300 |
| IL11RA | 9111 | 32206 | 55301 |
| IL12A | 9112 | 32207 | 55302 |
| IL12B | 9113 | 32208 | 55303 |
| IL12RB1 | 9114 | 32209 | 55304 |
| IL12RB1 | 9115 | 32210 | 55305 |
| IL12RB1 | 9116 | 32211 | 55306 |
| IL12RB2 | 9117 | 32212 | 55307 |
| IL12RB2 | 9118 | 32213 | 55308 |
| IL12RB2 | 9119 | 32214 | 55309 |
| IL13 | 9120 | 32215 | 55310 |
| IL13RA1 | 9121 | 32216 | 55311 |
| IL13RA2 | 9122 | 32217 | 55312 |
| IL15 | 9123 | 32218 | 55313 |
| IL15RA | 9124 | 32219 | 55314 |
| IL15RA | 9125 | 32220 | 55315 |
| IL16 | 9126 | 32221 | 55316 |
| IL17A | 9127 | 32222 | 55317 |
| IL17B | 9128 | 32223 | 55318 |
| IL17C | 9129 | 32224 | 55319 |
| IL17D | 9130 | 32225 | 55320 |
| IL17F | 9131 | 32226 | 55321 |
| IL17RA | 9132 | 32227 | 55322 |
| IL17RB | 9133 | 32228 | 55323 |
| IL17RC | 9134 | 32229 | 55324 |
| IL17RD | 9135 | 32230 | 55325 |
| IL17RE | 9136 | 32231 | 55326 |
| IL17RE | 9137 | 32232 | 55327 |
| IL17REL | 9138 | 32233 | 55328 |
| IL18 | 9139 | 32234 | 55329 |
| IL18BP | 9140 | 32235 | 55330 |
| IL18BP | 9141 | 32236 | 55331 |
| IL18BP | 9142 | 32237 | 55332 |
| IL18R1 | 9143 | 32238 | 55333 |
| IL18RAP | 9144 | 32239 | 55334 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| IL19 | 9145 | 32240 | 55335 |
| IL1A | 9146 | 32241 | 55336 |
| IL1B | 9147 | 32242 | 55337 |
| IL1F10 | 9148 | 32243 | 55338 |
| IL1R1 | 9149 | 32244 | 55339 |
| IL1R1 | 9150 | 32245 | 55340 |
| IL1R2 | 9151 | 32246 | 55341 |
| IL1R2 | 9152 | 32247 | 55342 |
| IL1RAP | 9153 | 32248 | 55343 |
| IL1RAP | 9154 | 32249 | 55344 |
| IL1RAP | 9155 | 32250 | 55345 |
| IL1RAPL1 | 9156 | 32251 | 55346 |
| IL1RAPL2 | 9157 | 32252 | 55347 |
| IL1RL1 | 9158 | 32253 | 55348 |
| IL1RL1 | 9159 | 32254 | 55349 |
| IL1RL2 | 9160 | 32255 | 55350 |
| IL1RN | 9161 | 32256 | 55351 |
| IL2 | 9162 | 32257 | 55352 |
| IL20 | 9163 | 32258 | 55353 |
| IL20RA | 9164 | 32259 | 55354 |
| IL20RB | 9165 | 32260 | 55355 |
| IL21 | 9166 | 32261 | 55356 |
| IL21 | 9167 | 32262 | 55357 |
| IL21R | 9168 | 32263 | 55358 |
| IL22 | 9169 | 32264 | 55359 |
| IL22RA1 | 9170 | 32265 | 55360 |
| IL22RA2 | 9171 | 32266 | 55361 |
| IL22RA2 | 9172 | 32267 | 55362 |
| IL23A | 9173 | 32268 | 55363 |
| IL23R | 9174 | 32269 | 55364 |
| IL24 | 9175 | 32270 | 55365 |
| IL24 | 9176 | 32271 | 55366 |
| IL25 | 9177 | 32272 | 55367 |
| IL26 | 9178 | 32273 | 55368 |
| IL27 | 9179 | 32274 | 55369 |
| IL27RA | 9180 | 32275 | 55370 |
| IL2RA | 9181 | 32276 | 55371 |
| IL2RB | 9182 | 32277 | 55372 |
| IL2RG | 9183 | 32278 | 55373 |
| IL3 | 9184 | 32279 | 55374 |
| IL31 | 9185 | 32280 | 55375 |
| IL31RA | 9186 | 32281 | 55376 |
| IL31RA | 9187 | 32282 | 55377 |
| IL31RA | 9188 | 32283 | 55378 |
| IL32 | 9189 | 32284 | 55379 |
| IL33 | 9190 | 32285 | 55380 |
| IL34 | 9191 | 32286 | 55381 |
| IL36A | 9192 | 32287 | 55382 |
| IL36B | 9193 | 32288 | 55383 |
| IL36B | 9194 | 32289 | 55384 |
| IL36G | 9195 | 32290 | 55385 |
| IL36RN | 9196 | 32291 | 55386 |
| IL37 | 9197 | 32292 | 55387 |
| IL3RA | 9198 | 32293 | 55388 |
| IL4 | 9199 | 32294 | 55389 |
| IL4I1 | 9200 | 32295 | 55390 |
| IL4R | 9201 | 32296 | 55391 |
| IL5 | 9202 | 32297 | 55392 |
| IL5RA | 9203 | 32298 | 55393 |
| IL5RA | 9204 | 32299 | 55394 |
| IL5RA | 9205 | 32300 | 55395 |
| IL6 | 9206 | 32301 | 55396 |
| IL6R | 9207 | 32302 | 55397 |
| IL6R | 9208 | 32303 | 55398 |
| IL6R | 9209 | 32304 | 55399 |
| IL6ST | 9210 | 32305 | 55400 |
| IL7 | 9211 | 32306 | 55401 |
| IL7 | 9212 | 32307 | 55402 |
| IL7 | 9213 | 32308 | 55403 |
| IL7R | 9214 | 32309 | 55404 |
| IL9 | 9215 | 32310 | 55405 |
| IL9R | 9216 | 32311 | 55406 |
| IL9R | 9217 | 32312 | 55407 |
| ILDR1 | 9218 | 32313 | 55408 |
| ILDR2 | 9219 | 32314 | 55409 |
| ILF2 | 9220 | 32315 | 55410 |
| ILF3 | 9221 | 32316 | 55411 |
| ILF3 | 9222 | 32317 | 55412 |
| ILF3 | 9223 | 32318 | 55413 |
| ILK | 9224 | 32319 | 55414 |
| ILKAP | 9225 | 32320 | 55415 |
| ILVBL | 9226 | 32321 | 55416 |
| IMMP1L | 9227 | 32322 | 55417 |
| IMMP2L | 9228 | 32323 | 55418 |
| IMMP2L | 9229 | 32324 | 55419 |
| IMMP2L | 9230 | 32325 | 55420 |
| IMMP2L | 9231 | 32326 | 55421 |
| IMMT | 9232 | 32327 | 55422 |
| IMP3 | 9233 | 32328 | 55423 |
| IMP4 | 9234 | 32329 | 55424 |
| IMPA1 | 9235 | 32330 | 55425 |
| IMPA1 | 9236 | 32331 | 55426 |
| IMPA2 | 9237 | 32332 | 55427 |
| IMPACT | 9238 | 32333 | 55428 |
| IMPAD1 | 9239 | 32334 | 55429 |
| IMPDH1 | 9240 | 32335 | 55430 |
| IMPDH2 | 9241 | 32336 | 55431 |
| IMPG1 | 9242 | 32337 | 55432 |
| IMPG2 | 9243 | 32338 | 55433 |
| INA | 9244 | 32339 | 55434 |
| INAFM1 | 9245 | 32340 | 55435 |
| INAFM2 | 9246 | 32341 | 55436 |
| INCA1 | 9247 | 32342 | 55437 |
| INCENP | 9248 | 32343 | 55438 |
| INF2 | 9249 | 32344 | 55439 |
| INF2 | 9250 | 32345 | 55440 |
| INF2 | 9251 | 32346 | 55441 |
| ING1 | 9252 | 32347 | 55442 |
| ING2 | 9253 | 32348 | 55443 |
| ING3 | 9254 | 32349 | 55444 |
| ING3 | 9255 | 32350 | 55445 |
| ING4 | 9256 | 32351 | 55446 |
| ING4 | 9257 | 32352 | 55447 |
| ING5 | 9258 | 32353 | 55448 |
| ING5 | 9259 | 32354 | 55449 |
| ING5 | 9260 | 32355 | 55450 |
| INHA | 9261 | 32356 | 55451 |
| INHBA | 9262 | 32357 | 55452 |
| INHBB | 9263 | 32358 | 55453 |
| INHBC | 9264 | 32359 | 55454 |
| INHBE | 9265 | 32360 | 55455 |
| INIP | 9266 | 32361 | 55456 |
| INIP | 9267 | 32362 | 55457 |
| INMT | 9268 | 32363 | 55458 |
| INO80 | 9269 | 32364 | 55459 |
| INO80B | 9270 | 32365 | 55460 |
| INO80C | 9271 | 32366 | 55461 |
| INO80D | 9272 | 32367 | 55462 |
| INO80E | 9273 | 32368 | 55463 |
| INO80E | 9274 | 32369 | 55464 |
| INPP1 | 9275 | 32370 | 55465 |
| INPP4A | 9276 | 32371 | 55466 |
| INPP4A | 9277 | 32372 | 55467 |
| INPP4B | 9278 | 32373 | 55468 |
| INPP4B | 9279 | 32374 | 55469 |
| INPP5A | 9280 | 32375 | 55470 |
| INPP5B | 9281 | 32376 | 55471 |
| INPP5D | 9282 | 32377 | 55472 |
| INPP5E | 9283 | 32378 | 55473 |
| INPP5F | 9284 | 32379 | 55474 |
| INPP5F | 9285 | 32380 | 55475 |
| INPP5J | 9286 | 32381 | 55476 |
| INPP5K | 9287 | 32382 | 55477 |
| INPPL1 | 9288 | 32383 | 55478 |
| INS | 9289 | 32384 | 55479 |
| INS-IGF2 | 9290 | 32385 | 55480 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| INSC | 9291 | 32386 | 55481 |
| INSC | 9292 | 32387 | 55482 |
| INSIG1 | 9293 | 32388 | 55483 |
| INSIG1 | 9294 | 32389 | 55484 |
| INSIG1 | 9295 | 32390 | 55485 |
| INSIG2 | 9296 | 32391 | 55486 |
| INSIG2 | 9297 | 32392 | 55487 |
| INSL3 | 9298 | 32393 | 55488 |
| INSL3 | 9299 | 32394 | 55489 |
| INSL4 | 9300 | 32395 | 55490 |
| INSL5 | 9301 | 32396 | 55491 |
| INSL6 | 9302 | 32397 | 55492 |
| INSM1 | 9303 | 32398 | 55493 |
| INSM2 | 9304 | 32399 | 55494 |
| INSR | 9305 | 32400 | 55495 |
| INSRR | 9306 | 32401 | 55496 |
| INTS1 | 9307 | 32402 | 55497 |
| INTS10 | 9308 | 32403 | 55498 |
| INTS11 | 9309 | 32404 | 55499 |
| INTS12 | 9310 | 32405 | 55500 |
| INTS13 | 9311 | 32406 | 55501 |
| INTS14 | 9312 | 32407 | 55502 |
| INTS2 | 9313 | 32408 | 55503 |
| INTS3 | 9314 | 32409 | 55504 |
| INTS4 | 9315 | 32410 | 55505 |
| INTS5 | 9316 | 32411 | 55506 |
| INTS6 | 9317 | 32412 | 55507 |
| INTS6 | 9318 | 32413 | 55508 |
| INTS6L | 9319 | 32414 | 55509 |
| INTS6L | 9320 | 32415 | 55510 |
| INTS7 | 9321 | 32416 | 55511 |
| INTS8 | 9322 | 32417 | 55512 |
| INTS9 | 9323 | 32418 | 55513 |
| INTU | 9324 | 32419 | 55514 |
| INVS | 9325 | 32420 | 55515 |
| IP6K1 | 9326 | 32421 | 55516 |
| IP6K2 | 9327 | 32422 | 55517 |
| IP6K2 | 9328 | 32423 | 55518 |
| IP6K2 | 9329 | 32424 | 55519 |
| IP6K2 | 9330 | 32425 | 55520 |
| IP6K3 | 9331 | 32426 | 55521 |
| IPCEF1 | 9332 | 32427 | 55522 |
| IPMK | 9333 | 32428 | 55523 |
| IPO11 | 9334 | 32429 | 55524 |
| IPO13 | 9335 | 32430 | 55525 |
| IPO4 | 9336 | 32431 | 55526 |
| IPO5 | 9337 | 32432 | 55527 |
| IPO7 | 9338 | 32433 | 55528 |
| IPO8 | 9339 | 32434 | 55529 |
| IPO9 | 9340 | 32435 | 55530 |
| IPP | 9341 | 32436 | 55531 |
| IPP | 9342 | 32437 | 55532 |
| IPPK | 9343 | 32438 | 55533 |
| IQCA1 | 9344 | 32439 | 55534 |
| IQCA1L | 9345 | 32440 | 55535 |
| IQCB1 | 9346 | 32441 | 55536 |
| IQCC | 9347 | 32442 | 55537 |
| IQCD | 9348 | 32443 | 55538 |
| IQCE | 9349 | 32444 | 55539 |
| IQCE | 9350 | 32445 | 55540 |
| IQCF1 | 9351 | 32446 | 55541 |
| IQCF2 | 9352 | 32447 | 55542 |
| IQCF3 | 9353 | 32448 | 55543 |
| IQCF5 | 9354 | 32449 | 55544 |
| IQCF6 | 9355 | 32450 | 55545 |
| IQCG | 9356 | 32451 | 55546 |
| IQCG | 9357 | 32452 | 55547 |
| IQCH | 9358 | 32453 | 55548 |
| IQCH | 9359 | 32454 | 55549 |
| IQCH | 9360 | 32455 | 55550 |
| IQCH | 9361 | 32456 | 55551 |
| IQCJ | 9362 | 32457 | 55552 |
| IQCJ | 9363 | 32458 | 55553 |
| IQCK | 9364 | 32459 | 55554 |
| IQCK | 9365 | 32460 | 55555 |
| IQGAP1 | 9366 | 32461 | 55556 |
| IQGAP2 | 9367 | 32462 | 55557 |
| IQGAP3 | 9368 | 32463 | 55558 |
| IQSEC1 | 9369 | 32464 | 55559 |
| IQSEC1 | 9370 | 32465 | 55560 |
| IQSEC1 | 9371 | 32466 | 55561 |
| IQSEC2 | 9372 | 32467 | 55562 |
| IQSEC2 | 9373 | 32468 | 55563 |
| IQSEC2 | 9374 | 32469 | 55564 |
| IQSEC3 | 9375 | 32470 | 55565 |
| IQSEC3 | 9376 | 32471 | 55566 |
| IQUB | 9377 | 32472 | 55567 |
| IRAKI | 9378 | 32473 | 55568 |
| IRAK1BP1 | 9379 | 32474 | 55569 |
| IRAK2 | 9380 | 32475 | 55570 |
| IRAK3 | 9381 | 32476 | 55571 |
| IRAK4 | 9382 | 32477 | 55572 |
| IREB2 | 9383 | 32478 | 55573 |
| IREB2 | 9384 | 32479 | 55574 |
| IRF1 | 9385 | 32480 | 55575 |
| IRF2 | 9386 | 32481 | 55576 |
| IRF2BP1 | 9387 | 32482 | 55577 |
| IRF2BP2 | 9388 | 32483 | 55578 |
| IRF2BPL | 9389 | 32484 | 55579 |
| IRF3 | 9390 | 32485 | 55580 |
| IRF3 | 9391 | 32486 | 55581 |
| IRF4 | 9392 | 32487 | 55582 |
| IRF5 | 9393 | 32488 | 55583 |
| IRF6 | 9394 | 32489 | 55584 |
| IRF7 | 9395 | 32490 | 55585 |
| IRF8 | 9396 | 32491 | 55586 |
| IRF9 | 9397 | 32492 | 55587 |
| IRGC | 9398 | 32493 | 55588 |
| IRGM | 9399 | 32494 | 55589 |
| IRGM | 9400 | 32495 | 55590 |
| IRGQ | 9401 | 32496 | 55591 |
| IRS1 | 9402 | 32497 | 55592 |
| IRS2 | 9403 | 32498 | 55593 |
| IRS4 | 9404 | 32499 | 55594 |
| IRX1 | 9405 | 32500 | 55595 |
| IRX2 | 9406 | 32501 | 55596 |
| IRX3 | 9407 | 32502 | 55597 |
| IRX4 | 9408 | 32503 | 55598 |
| IRX5 | 9409 | 32504 | 55599 |
| IRX6 | 9410 | 32505 | 55600 |
| ISCA1 | 9411 | 32506 | 55601 |
| ISCA2 | 9412 | 32507 | 55602 |
| ISCA2 | 9413 | 32508 | 55603 |
| ISCU | 9414 | 32509 | 55604 |
| ISCU | 9415 | 32510 | 55605 |
| ISCU | 9416 | 32511 | 55606 |
| ISG15 | 9417 | 32512 | 55607 |
| ISG20 | 9418 | 32513 | 55608 |
| ISG20L2 | 9419 | 32514 | 55609 |
| ISL1 | 9420 | 32515 | 55610 |
| ISL2 | 9421 | 32516 | 55611 |
| ISLR | 9422 | 32517 | 55612 |
| ISLR2 | 9423 | 32518 | 55613 |
| ISM1 | 9424 | 32519 | 55614 |
| ISM2 | 9425 | 32520 | 55615 |
| ISM2 | 9426 | 32521 | 55616 |
| ISOC1 | 9427 | 32522 | 55617 |
| ISOC2 | 9428 | 32523 | 55618 |
| ISPD | 9429 | 32524 | 55619 |
| IST1 | 9430 | 32525 | 55620 |
| ISX | 9431 | 32526 | 55621 |
| ISY1 | 9432 | 32527 | 55622 |
| ISY1-RAB43 | 9433 | 32528 | 55623 |
| ISYNA1 | 9434 | 32529 | 55624 |
| ITCH | 9435 | 32530 | 55625 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| ITFG1 | 9436 | 32531 | 55626 |
| ITFG1 | 9437 | 32532 | 55627 |
| ITFG2 | 9438 | 32533 | 55628 |
| ITGA1 | 9439 | 32534 | 55629 |
| ITGA10 | 9440 | 32535 | 55630 |
| ITGA11 | 9441 | 32536 | 55631 |
| ITGA2 | 9442 | 32537 | 55632 |
| ITGA2B | 9443 | 32538 | 55633 |
| ITGA3 | 9444 | 32539 | 55634 |
| ITGA4 | 9445 | 32540 | 55635 |
| ITGA4 | 9446 | 32541 | 55636 |
| ITGA5 | 9447 | 32542 | 55637 |
| ITGA6 | 9448 | 32543 | 55638 |
| ITGA6 | 9449 | 32544 | 55639 |
| ITGA7 | 9450 | 32545 | 55640 |
| ITGA8 | 9451 | 32546 | 55641 |
| ITGA9 | 9452 | 32547 | 55642 |
| ITGAD | 9453 | 32548 | 55643 |
| ITGAE | 9454 | 32549 | 55644 |
| ITGAL | 9455 | 32550 | 55645 |
| ITGAM | 9456 | 32551 | 55646 |
| ITGAV | 9457 | 32552 | 55647 |
| ITGAX | 9458 | 32553 | 55648 |
| ITGAX | 9459 | 32554 | 55649 |
| ITGB1 | 9460 | 32555 | 55650 |
| ITGB1 | 9461 | 32556 | 55651 |
| ITGB1BP1 | 9462 | 32557 | 55652 |
| ITGB1BP2 | 9463 | 32558 | 55653 |
| ITGB2 | 9464 | 32559 | 55654 |
| ITGB3 | 9465 | 32560 | 55655 |
| ITGB3BP | 9466 | 32561 | 55656 |
| ITGB3BP | 9467 | 32562 | 55657 |
| ITGB4 | 9468 | 32563 | 55658 |
| ITGB5 | 9469 | 32564 | 55659 |
| ITGB6 | 9470 | 32565 | 55660 |
| ITGB7 | 9471 | 32566 | 55661 |
| ITGB8 | 9472 | 32567 | 55662 |
| ITGBL1 | 9473 | 32568 | 55663 |
| ITIH1 | 9474 | 32569 | 55664 |
| ITIH2 | 9475 | 32570 | 55665 |
| ITIH3 | 9476 | 32571 | 55666 |
| ITIH4 | 9477 | 32572 | 55667 |
| ITIH5 | 9478 | 32573 | 55668 |
| ITIH5 | 9479 | 32574 | 55669 |
| ITIH6 | 9480 | 32575 | 55670 |
| ITK | 9481 | 32576 | 55671 |
| ITLN1 | 9482 | 32577 | 55672 |
| ITLN2 | 9483 | 32578 | 55673 |
| ITM2A | 9484 | 32579 | 55674 |
| ITM2B | 9485 | 32580 | 55675 |
| ITM2C | 9486 | 32581 | 55676 |
| ITPA | 9487 | 32582 | 55677 |
| ITPA | 9488 | 32583 | 55678 |
| ITPA | 9489 | 32584 | 55679 |
| ITPK1 | 9490 | 32585 | 55680 |
| ITPK1 | 9491 | 32586 | 55681 |
| ITPKA | 9492 | 32587 | 55682 |
| ITPKB | 9493 | 32588 | 55683 |
| ITPKC | 9494 | 32589 | 55684 |
| ITPR1 | 9495 | 32590 | 55685 |
| ITPR2 | 9496 | 32591 | 55686 |
| ITPR3 | 9497 | 32592 | 55687 |
| ITPRIP | 9498 | 32593 | 55688 |
| ITPRIPL1 | 9499 | 32594 | 55689 |
| ITPRIPL2 | 9500 | 32595 | 55690 |
| ITSN1 | 9501 | 32596 | 55691 |
| ITSN1 | 9502 | 32597 | 55692 |
| ITSN2 | 9503 | 32598 | 55693 |
| ITSN2 | 9504 | 32599 | 55694 |
| ITSN2 | 9505 | 32600 | 55695 |
| IVD | 9506 | 32601 | 55696 |
| IVL | 9507 | 32602 | 55697 |
| IVNS1ABP | 9508 | 32603 | 55698 |
| IWS1 | 9509 | 32604 | 55699 |
| IYD | 9510 | 32605 | 55700 |
| IYD | 9511 | 32606 | 55701 |
| IYD | 9512 | 32607 | 55702 |
| IZUMO1 | 9513 | 32608 | 55703 |
| IZUMO1 | 9514 | 32609 | 55704 |
| IZUMO1R | 9515 | 32610 | 55705 |
| IZUMO2 | 9516 | 32611 | 55706 |
| IZUMO2 | 9517 | 32612 | 55707 |
| IZUMO3 | 9518 | 32613 | 55708 |
| IZUMO4 | 9519 | 32614 | 55709 |
| JADE1 | 9520 | 32615 | 55710 |
| JADE1 | 9521 | 32616 | 55711 |
| JADE2 | 9522 | 32617 | 55712 |
| JADE3 | 9523 | 32618 | 55713 |
| JAG1 | 9524 | 32619 | 55714 |
| JAG2 | 9525 | 32620 | 55715 |
| JAGN1 | 9526 | 32621 | 55716 |
| JAK1 | 9527 | 32622 | 55717 |
| JAK2 | 9528 | 32623 | 55718 |
| JAK3 | 9529 | 32624 | 55719 |
| JAKMIP1 | 9530 | 32625 | 55720 |
| JAKMIP1 | 9531 | 32626 | 55721 |
| JAKMIP2 | 9532 | 32627 | 55722 |
| JAKMIP2 | 9533 | 32628 | 55723 |
| JAKMIP3 | 9534 | 32629 | 55724 |
| JAKMIP3 | 9535 | 32630 | 55725 |
| JAM2 | 9536 | 32631 | 55726 |
| JAM2 | 9537 | 32632 | 55727 |
| JAM3 | 9538 | 32633 | 55728 |
| JAML | 9539 | 32634 | 55729 |
| JARID2 | 9540 | 32635 | 55730 |
| JAZF1 | 9541 | 32636 | 55731 |
| JCAD | 9542 | 32637 | 55732 |
| JCHAIN | 9543 | 32638 | 55733 |
| JDP2 | 9544 | 32639 | 55734 |
| JKAMP | 9545 | 32640 | 55735 |
| JKAMP | 9546 | 32641 | 55736 |
| JMJD1C | 9547 | 32642 | 55737 |
| JMJD4 | 9548 | 32643 | 55738 |
| JMJD6 | 9549 | 32644 | 55739 |
| JMJD6 | 9550 | 32645 | 55740 |
| JMJD7 | 9551 | 32646 | 55741 |
| JMJD7-PLA2G4B | 9552 | 32647 | 55742 |
| JMJD7-PLA2G4B | 9553 | 32648 | 55743 |
| JMJD8 | 9554 | 32649 | 55744 |
| JMJD8 | 9555 | 32650 | 55745 |
| JMY | 9556 | 32651 | 55746 |
| JOSD1 | 9557 | 32652 | 55747 |
| JOSD2 | 9558 | 32653 | 55748 |
| JPH1 | 9559 | 32654 | 55749 |
| JPH2 | 9560 | 32655 | 55750 |
| JPH2 | 9561 | 32656 | 55751 |
| JPH3 | 9562 | 32657 | 55752 |
| JPH3 | 9563 | 32658 | 55753 |
| JPH3 | 9564 | 32659 | 55754 |
| JPH4 | 9565 | 32660 | 55755 |
| JPT1 | 9566 | 32661 | 55756 |
| JPT1 | 9567 | 32662 | 55757 |
| JPT1 | 9568 | 32663 | 55758 |
| JPT1 | 9569 | 32664 | 55759 |
| JPT2 | 9570 | 32665 | 55760 |
| JRK | 9571 | 32666 | 55761 |
| JRK | 9572 | 32667 | 55762 |
| JRKL | 9573 | 32668 | 55763 |
| JSRP1 | 9574 | 32669 | 55764 |
| JTB | 9575 | 32670 | 55765 |
| JUN | 9576 | 32671 | 55766 |
| JUNB | 9577 | 32672 | 55767 |
| JUND | 9578 | 32673 | 55768 |
| JUP | 9579 | 32674 | 55769 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| KAAG1 | 9580 | 32675 | 55770 |
| KALRN | 9581 | 32676 | 55771 |
| KALRN | 9582 | 32677 | 55772 |
| KALRN | 9583 | 32678 | 55773 |
| KANK1 | 9584 | 32679 | 55774 |
| KANK2 | 9585 | 32680 | 55775 |
| KANK3 | 9586 | 32681 | 55776 |
| KANK4 | 9587 | 32682 | 55777 |
| KANSL1 | 9588 | 32683 | 55778 |
| KANSL1L | 9589 | 32684 | 55779 |
| KANSL2 | 9590 | 32685 | 55780 |
| KANSL3 | 9591 | 32686 | 55781 |
| KANSL3 | 9592 | 32687 | 55782 |
| KARS | 9593 | 32688 | 55783 |
| KAT14 | 9594 | 32689 | 55784 |
| KAT2A | 9595 | 32690 | 55785 |
| KAT2B | 9596 | 32691 | 55786 |
| KAT5 | 9597 | 32692 | 55787 |
| KAT6A | 9598 | 32693 | 55788 |
| KAT6A | 9599 | 32694 | 55789 |
| KAT6B | 9600 | 32695 | 55790 |
| KAT7 | 9601 | 32696 | 55791 |
| KAT8 | 9602 | 32697 | 55792 |
| KAT8 | 9603 | 32698 | 55793 |
| KATNA1 | 9604 | 32699 | 55794 |
| KATNA1 | 9605 | 32700 | 55795 |
| KATNAL1 | 9606 | 32701 | 55796 |
| KATNAL2 | 9607 | 32702 | 55797 |
| KATNAL2 | 9608 | 32703 | 55798 |
| KATNAL2 | 9609 | 32704 | 55799 |
| KATNAL2 | 9610 | 32705 | 55800 |
| KATNB1 | 9611 | 32706 | 55801 |
| KATNBL1 | 9612 | 32707 | 55802 |
| KAZALD1 | 9613 | 32708 | 55803 |
| KAZALD1 | 9614 | 32709 | 55804 |
| KAZN | 9615 | 32710 | 55805 |
| KAZN | 9616 | 32711 | 55806 |
| KBTBD11 | 9617 | 32712 | 55807 |
| KBTBD12 | 9618 | 32713 | 55808 |
| KBTBD13 | 9619 | 32714 | 55809 |
| KBTBD2 | 9620 | 32715 | 55810 |
| KBTBD3 | 9621 | 32716 | 55811 |
| KBTBD4 | 9622 | 32717 | 55812 |
| KBTBD6 | 9623 | 32718 | 55813 |
| KBTBD7 | 9624 | 32719 | 55814 |
| KBTBD8 | 9625 | 32720 | 55815 |
| KCMF1 | 9626 | 32721 | 55816 |
| KCNA1 | 9627 | 32722 | 55817 |
| KCNA10 | 9628 | 32723 | 55818 |
| KCNA2 | 9629 | 32724 | 55819 |
| KCNA2 | 9630 | 32725 | 55820 |
| KCNA3 | 9631 | 32726 | 55821 |
| KCNA4 | 9632 | 32727 | 55822 |
| KCNA5 | 9633 | 32728 | 55823 |
| KCNA6 | 9634 | 32729 | 55824 |
| KCNA7 | 9635 | 32730 | 55825 |
| KCNAB1 | 9636 | 32731 | 55826 |
| KCNAB2 | 9637 | 32732 | 55827 |
| KCNAB3 | 9638 | 32733 | 55828 |
| KCNB1 | 9639 | 32734 | 55829 |
| KCNB2 | 9640 | 32735 | 55830 |
| KCNC1 | 9641 | 32736 | 55831 |
| KCNC1 | 9642 | 32737 | 55832 |
| KCNC2 | 9643 | 32738 | 55833 |
| KCNC2 | 9644 | 32739 | 55834 |
| KCNC2 | 9645 | 32740 | 55835 |
| KCNC2 | 9646 | 32741 | 55836 |
| KCNC3 | 9647 | 32742 | 55837 |
| KCNC4 | 9648 | 32743 | 55838 |
| KCNC4 | 9649 | 32744 | 55839 |
| KCND1 | 9650 | 32745 | 55840 |
| KCND2 | 9651 | 32746 | 55841 |
| KCND3 | 9652 | 32747 | 55842 |
| KCNE1 | 9653 | 32748 | 55843 |
| KCNE2 | 9654 | 32749 | 55844 |
| KCNE3 | 9655 | 32750 | 55845 |
| KCNE4 | 9656 | 32751 | 55846 |
| KCNE5 | 9657 | 32752 | 55847 |
| KCNF1 | 9658 | 32753 | 55848 |
| KCNG1 | 9659 | 32754 | 55849 |
| KCNG2 | 9660 | 32755 | 55850 |
| KCNG3 | 9661 | 32756 | 55851 |
| KCNG4 | 9662 | 32757 | 55852 |
| KCNH1 | 9663 | 32758 | 55853 |
| KCNH2 | 9664 | 32759 | 55854 |
| KCNH2 | 9665 | 32760 | 55855 |
| KCNH3 | 9666 | 32761 | 55856 |
| KCNH4 | 9667 | 32762 | 55857 |
| KCNH5 | 9668 | 32763 | 55858 |
| KCNH5 | 9669 | 32764 | 55859 |
| KCNH6 | 9670 | 32765 | 55860 |
| KCNH7 | 9671 | 32766 | 55861 |
| KCNH7 | 9672 | 32767 | 55862 |
| KCNH8 | 9673 | 32768 | 55863 |
| KCNIP1 | 9674 | 32769 | 55864 |
| KCNIP2 | 9675 | 32770 | 55865 |
| KCNIP2 | 9676 | 32771 | 55866 |
| KCNIP3 | 9677 | 32772 | 55867 |
| KCNIP4 | 9678 | 32773 | 55868 |
| KCNJ1 | 9679 | 32774 | 55869 |
| KCNJ10 | 9680 | 32775 | 55870 |
| KCNJ11 | 9681 | 32776 | 55871 |
| KCNJ12 | 9682 | 32777 | 55872 |
| KCNJ13 | 9683 | 32778 | 55873 |
| KCNJ14 | 9684 | 32779 | 55874 |
| KCNJ15 | 9685 | 32780 | 55875 |
| KCNJ16 | 9686 | 32781 | 55876 |
| KCNJ18 | 9687 | 32782 | 55877 |
| KCNJ2 | 9688 | 32783 | 55878 |
| KCNJ3 | 9689 | 32784 | 55879 |
| KCNJ3 | 9690 | 32785 | 55880 |
| KCNJ3 | 9691 | 32786 | 55881 |
| KCNJ3 | 9692 | 32787 | 55882 |
| KCNJ4 | 9693 | 32788 | 55883 |
| KCNJ5 | 9694 | 32789 | 55884 |
| KCNJ6 | 9695 | 32790 | 55885 |
| KCNJ8 | 9696 | 32791 | 55886 |
| KCNJ9 | 9697 | 32792 | 55887 |
| KCNK1 | 9698 | 32793 | 55888 |
| KCNK10 | 9699 | 32794 | 55889 |
| KCNK12 | 9700 | 32795 | 55890 |
| KCNK13 | 9701 | 32796 | 55891 |
| KCNK15 | 9702 | 32797 | 55892 |
| KCNK16 | 9703 | 32798 | 55893 |
| KCNK16 | 9704 | 32799 | 55894 |
| KCNK16 | 9705 | 32800 | 55895 |
| KCNK17 | 9706 | 32801 | 55896 |
| KCNK17 | 9707 | 32802 | 55897 |
| KCNK18 | 9708 | 32803 | 55898 |
| KCNK2 | 9709 | 32804 | 55899 |
| KCNK3 | 9710 | 32805 | 55900 |
| KCNK4 | 9711 | 32806 | 55901 |
| KCNK5 | 9712 | 32807 | 55902 |
| KCNK6 | 9713 | 32808 | 55903 |
| KCNK7 | 9714 | 32809 | 55904 |
| KCNK7 | 9715 | 32810 | 55905 |
| KCNK7 | 9716 | 32811 | 55906 |
| KCNK9 | 9717 | 32812 | 55907 |
| KCNMA1 | 9718 | 32813 | 55908 |
| KCNMA1 | 9719 | 32814 | 55909 |
| KCNMA1 | 9720 | 32815 | 55910 |
| KCNMA1 | 9721 | 32816 | 55911 |
| KCNMA1 | 9722 | 32817 | 55912 |
| KCNMA1 | 9723 | 32818 | 55913 |
| KCNMB1 | 9724 | 32819 | 55914 |
| KCNMB2 | 9725 | 32820 | 55915 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| KCNMB3 | 9726 | 32821 | 55916 |
| KCNMB3 | 9727 | 32822 | 55917 |
| KCNMB4 | 9728 | 32823 | 55918 |
| KCNN1 | 9729 | 32824 | 55919 |
| KCNN2 | 9730 | 32825 | 55920 |
| KCNN3 | 9731 | 32826 | 55921 |
| KCNN4 | 9732 | 32827 | 55922 |
| KCNQ1 | 9733 | 32828 | 55923 |
| KCNQ2 | 9734 | 32829 | 55924 |
| KCNQ2 | 9735 | 32830 | 55925 |
| KCNQ3 | 9736 | 32831 | 55926 |
| KCNQ4 | 9737 | 32832 | 55927 |
| KCNQ5 | 9738 | 32833 | 55928 |
| KCNRG | 9739 | 32834 | 55929 |
| KCNRG | 9740 | 32835 | 55930 |
| KCNS1 | 9741 | 32836 | 55931 |
| KCNS2 | 9742 | 32837 | 55932 |
| KCNS3 | 9743 | 32838 | 55933 |
| KCNT1 | 9744 | 32839 | 55934 |
| KCNT2 | 9745 | 32840 | 55935 |
| KCNU1 | 9746 | 32841 | 55936 |
| KCNV1 | 9747 | 32842 | 55937 |
| KCNV2 | 9748 | 32843 | 55938 |
| KCP | 9749 | 32844 | 55939 |
| KCP | 9750 | 32845 | 55940 |
| KCTD1 | 9751 | 32846 | 55941 |
| KCTD10 | 9752 | 32847 | 55942 |
| KCTD11 | 9753 | 32848 | 55943 |
| KCTD12 | 9754 | 32849 | 55944 |
| KCTD13 | 9755 | 32850 | 55945 |
| KCTD15 | 9756 | 32851 | 55946 |
| KCTD15 | 9757 | 32852 | 55947 |
| KCTD16 | 9758 | 32853 | 55948 |
| KCTD17 | 9759 | 32854 | 55949 |
| KCTD17 | 9760 | 32855 | 55950 |
| KCTD17 | 9761 | 32856 | 55951 |
| KCTD18 | 9762 | 32857 | 55952 |
| KCTD19 | 9763 | 32858 | 55953 |
| KCTD2 | 9764 | 32859 | 55954 |
| KCTD20 | 9765 | 32860 | 55955 |
| KCTD21 | 9766 | 32861 | 55956 |
| KCTD3 | 9767 | 32862 | 55957 |
| KCTD4 | 9768 | 32863 | 55958 |
| KCTD5 | 9769 | 32864 | 55959 |
| KCTD6 | 9770 | 32865 | 55960 |
| KCTD7 | 9771 | 32866 | 55961 |
| KCTD7 | 9772 | 32867 | 55962 |
| KCTD8 | 9773 | 32868 | 55963 |
| KCTD9 | 9774 | 32869 | 55964 |
| KDELC1 | 9775 | 32870 | 55965 |
| KDELC2 | 9776 | 32871 | 55966 |
| KDELR1 | 9777 | 32872 | 55967 |
| KDELR2 | 9778 | 32873 | 55968 |
| KDELR2 | 9779 | 32874 | 55969 |
| KDELR3 | 9780 | 32875 | 55970 |
| KDELR3 | 9781 | 32876 | 55971 |
| KDF1 | 9782 | 32877 | 55972 |
| KDM1A | 9783 | 32878 | 55973 |
| KDM1B | 9784 | 32879 | 55974 |
| KDM2A | 9785 | 32880 | 55975 |
| KDM2B | 9786 | 32881 | 55976 |
| KDM2B | 9787 | 32882 | 55977 |
| KDM3A | 9788 | 32883 | 55978 |
| KDM3B | 9789 | 32884 | 55979 |
| KDM4A | 9790 | 32885 | 55980 |
| KDM4B | 9791 | 32886 | 55981 |
| KDM4C | 9792 | 32887 | 55982 |
| KDM4C | 9793 | 32888 | 55983 |
| KDM4C | 9794 | 32889 | 55984 |
| KDM4C | 9795 | 32890 | 55985 |
| KDM4D | 9796 | 32891 | 55986 |
| KDM4E | 9797 | 32892 | 55987 |
| KDM5A | 9798 | 32893 | 55988 |
| KDM5B | 9799 | 32894 | 55989 |
| KDM5C | 9800 | 32895 | 55990 |
| KDM5C | 9801 | 32896 | 55991 |
| KDM5C | 9802 | 32897 | 55992 |
| KDM5C | 9803 | 32898 | 55993 |
| KDM5D | 9804 | 32899 | 55994 |
| KDM6A | 9805 | 32900 | 55995 |
| KDM6B | 9806 | 32901 | 55996 |
| KDM7A | 9807 | 32902 | 55997 |
| KDM8 | 9808 | 32903 | 55998 |
| KDR | 9809 | 32904 | 55999 |
| KDSR | 9810 | 32905 | 56000 |
| KEAP1 | 9811 | 32906 | 56001 |
| KEL | 9812 | 32907 | 56002 |
| KERA | 9813 | 32908 | 56003 |
| KHDC1 | 9814 | 32909 | 56004 |
| KHDC1L | 9815 | 32910 | 56005 |
| KHDC3L | 9816 | 32911 | 56006 |
| KHDRBS1 | 9817 | 32912 | 56007 |
| KHDRBS2 | 9818 | 32913 | 56008 |
| KHDRBS3 | 9819 | 32914 | 56009 |
| KHK | 9820 | 32915 | 56010 |
| KHNYN | 9821 | 32916 | 56011 |
| KHSRP | 9822 | 32917 | 56012 |
| KIAA0040 | 9823 | 32918 | 56013 |
| KIAA0100 | 9824 | 32919 | 56014 |
| KIAA0100 | 9825 | 32920 | 56015 |
| KIAA0141 | 9826 | 32921 | 56016 |
| KIAA0141 | 9827 | 32922 | 56017 |
| KIAA0232 | 9828 | 32923 | 56018 |
| KIAA0319 | 9829 | 32924 | 56019 |
| KIAA0319 | 9830 | 32925 | 56020 |
| KIAA0319L | 9831 | 32926 | 56021 |
| KIAA0355 | 9832 | 32927 | 56022 |
| KIAA0368 | 9833 | 32928 | 56023 |
| KIAA0391 | 9834 | 32929 | 56024 |
| KIAA0408 | 9835 | 32930 | 56025 |
| KIAA0513 | 9836 | 32931 | 56026 |
| KIAA0513 | 9837 | 32932 | 56027 |
| KIAA0556 | 9838 | 32933 | 56028 |
| KIAA0586 | 9839 | 32934 | 56029 |
| KIAA0586 | 9840 | 32935 | 56030 |
| KIAA0586 | 9841 | 32936 | 56031 |
| KIAA0753 | 9842 | 32937 | 56032 |
| KIAA0754 | 9843 | 32938 | 56033 |
| KIAA0825 | 9844 | 32939 | 56034 |
| KIAA0825 | 9845 | 32940 | 56035 |
| KIAA0895 | 9846 | 32941 | 56036 |
| KIAA0895L | 9847 | 32942 | 56037 |
| KIAA0907 | 9848 | 32943 | 56038 |
| KIAA0930 | 9849 | 32944 | 56039 |
| KIAA1024 | 9850 | 32945 | 56040 |
| KIAA1024L | 9851 | 32946 | 56041 |
| KIAA1107 | 9852 | 32947 | 56042 |
| KIAA1109 | 9853 | 32948 | 56043 |
| KIAA1143 | 9854 | 32949 | 56044 |
| KIAA1143 | 9855 | 32950 | 56045 |
| KIAA1147 | 9856 | 32951 | 56046 |
| KIAA1191 | 9857 | 32952 | 56047 |
| KIAA1210 | 9858 | 32953 | 56048 |
| KIAA1211 | 9859 | 32954 | 56049 |
| KIAA1211L | 9860 | 32955 | 56050 |
| KIAA1217 | 9861 | 32956 | 56051 |
| KIAA1217 | 9862 | 32957 | 56052 |
| KIAA1257 | 9863 | 32958 | 56053 |
| KIAA1257 | 9864 | 32959 | 56054 |
| KIAA1324 | 9865 | 32960 | 56055 |
| KIAA1324 | 9866 | 32961 | 56056 |
| KIAA1324L | 9867 | 32962 | 56057 |
| KIAA1328 | 9868 | 32963 | 56058 |
| KIAA1456 | 9869 | 32964 | 56059 |
| KIAA1468 | 9870 | 32965 | 56060 |
| KIAA1468 | 9871 | 32966 | 56061 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| KIAA1522 | 9872 | 32967 | 56062 |
| KIAA1522 | 9873 | 32968 | 56063 |
| KIAA1549 | 9874 | 32969 | 56064 |
| KIAA1549L | 9875 | 32970 | 56065 |
| KIAA1551 | 9876 | 32971 | 56066 |
| KIAA1586 | 9877 | 32972 | 56067 |
| KIAA1614 | 9878 | 32973 | 56068 |
| KIAA1644 | 9879 | 32974 | 56069 |
| KIAA1671 | 9880 | 32975 | 56070 |
| KIAA1683 | 9881 | 32976 | 56071 |
| KIAA1755 | 9882 | 32977 | 56072 |
| KIAA1841 | 9883 | 32978 | 56073 |
| KIAA1841 | 9884 | 32979 | 56074 |
| KIAA1958 | 9885 | 32980 | 56075 |
| KIAA1958 | 9886 | 32981 | 56076 |
| KIAA2012 | 9887 | 32982 | 56077 |
| KIAA2013 | 9888 | 32983 | 56078 |
| KIAA2026 | 9889 | 32984 | 56079 |
| KIDINS220 | 9890 | 32985 | 56080 |
| KIDINS220 | 9891 | 32986 | 56081 |
| KIDINS220 | 9892 | 32987 | 56082 |
| KIF11 | 9893 | 32988 | 56083 |
| KIF12 | 9894 | 32989 | 56084 |
| KIF13A | 9895 | 32990 | 56085 |
| KIF13A | 9896 | 32991 | 56086 |
| KIF13A | 9897 | 32992 | 56087 |
| KIF13B | 9898 | 32993 | 56088 |
| KIF14 | 9899 | 32994 | 56089 |
| KIF15 | 9900 | 32995 | 56090 |
| KIF16B | 9901 | 32996 | 56091 |
| KIF16B | 9902 | 32997 | 56092 |
| KIF17 | 9903 | 32998 | 56093 |
| KIF18A | 9904 | 32999 | 56094 |
| KIF18B | 9905 | 33000 | 56095 |
| KIF18B | 9906 | 33001 | 56096 |
| KIF19 | 9907 | 33002 | 56097 |
| KIF1A | 9908 | 33003 | 56098 |
| KIF1B | 9909 | 33004 | 56099 |
| KIF1B | 9910 | 33005 | 56100 |
| KIF1BP | 9911 | 33006 | 56101 |
| KIF1C | 9912 | 33007 | 56102 |
| KIF20A | 9913 | 33008 | 56103 |
| KIF20B | 9914 | 33009 | 56104 |
| KIF21A | 9915 | 33010 | 56105 |
| KIF21B | 9916 | 33011 | 56106 |
| KIF21B | 9917 | 33012 | 56107 |
| KIF22 | 9918 | 33013 | 56108 |
| KIF23 | 9919 | 33014 | 56109 |
| KIF24 | 9920 | 33015 | 56110 |
| KIF25 | 9921 | 33016 | 56111 |
| KIF26A | 9922 | 33017 | 56112 |
| KIF26B | 9923 | 33018 | 56113 |
| KIF27 | 9924 | 33019 | 56114 |
| KIF2A | 9925 | 33020 | 56115 |
| KIF2B | 9926 | 33021 | 56116 |
| KIF2C | 9927 | 33022 | 56117 |
| KIF3A | 9928 | 33023 | 56118 |
| KIF3B | 9929 | 33024 | 56119 |
| KIF3C | 9930 | 33025 | 56120 |
| KIF4A | 9931 | 33026 | 56121 |
| KIF5A | 9932 | 33027 | 56122 |
| KIF5B | 9933 | 33028 | 56123 |
| KIF5C | 9934 | 33029 | 56124 |
| KIF6 | 9935 | 33030 | 56125 |
| KIF6 | 9936 | 33031 | 56126 |
| KIF6 | 9937 | 33032 | 56127 |
| KIF7 | 9938 | 33033 | 56128 |
| KIF9 | 9939 | 33034 | 56129 |
| KIFAP3 | 9940 | 33035 | 56130 |
| KIFC1 | 9941 | 33036 | 56131 |
| KIFC2 | 9942 | 33037 | 56132 |
| KIFC3 | 9943 | 33038 | 56133 |
| KIFC3 | 9944 | 33039 | 56134 |
| KIN | 9945 | 33040 | 56135 |
| KIR2DL3 | 9946 | 33041 | 56136 |
| KIR2DL4 | 9947 | 33042 | 56137 |
| KIR2DL4 | 9948 | 33043 | 56138 |
| KIR2DS2 | 9949 | 33044 | 56139 |
| KIR2DS2 | 9950 | 33045 | 56140 |
| KIR2DS4*003 allele | 9951 | 33046 | 56141 |
| KIR3DL2 | 9952 | 33047 | 56142 |
| KIR3DL3 | 9953 | 33048 | 56143 |
| KIR3DS1 | 9954 | 33049 | 56144 |
| KIRREL1 | 9955 | 33050 | 56145 |
| KIRREL2 | 9956 | 33051 | 56146 |
| KIRREL2 | 9957 | 33052 | 56147 |
| KIRREL3 | 9958 | 33053 | 56148 |
| KIRREL3 | 9959 | 33054 | 56149 |
| KISS1 | 9960 | 33055 | 56150 |
| KISS1R | 9961 | 33056 | 56151 |
| KIT | 9962 | 33057 | 56152 |
| KITLG | 9963 | 33058 | 56153 |
| KIZ | 9964 | 33059 | 56154 |
| KL | 9965 | 33060 | 56155 |
| KLB | 9966 | 33061 | 56156 |
| KLC1 | 9967 | 33062 | 56157 |
| KLC1 | 9968 | 33063 | 56158 |
| KLC2 | 9969 | 33064 | 56159 |
| KLC3 | 9970 | 33065 | 56160 |
| KLC4 | 9971 | 33066 | 56161 |
| KLC4 | 9972 | 33067 | 56162 |
| KLF1 | 9973 | 33068 | 56163 |
| KLF10 | 9974 | 33069 | 56164 |
| KLF11 | 9975 | 33070 | 56165 |
| KLF12 | 9976 | 33071 | 56166 |
| KLF13 | 9977 | 33072 | 56167 |
| KLF13 | 9978 | 33073 | 56168 |
| KLF14 | 9979 | 33074 | 56169 |
| KLF15 | 9980 | 33075 | 56170 |
| KLF16 | 9981 | 33076 | 56171 |
| KLF17 | 9982 | 33077 | 56172 |
| KLF2 | 9983 | 33078 | 56173 |
| KLF3 | 9984 | 33079 | 56174 |
| KLF4 | 9985 | 33080 | 56175 |
| KLF5 | 9986 | 33081 | 56176 |
| KLF6 | 9987 | 33082 | 56177 |
| KLF6 | 9988 | 33083 | 56178 |
| KLF7 | 9989 | 33084 | 56179 |
| KLF8 | 9990 | 33085 | 56180 |
| KLF8 | 9991 | 33086 | 56181 |
| KLF9 | 9992 | 33087 | 56182 |
| KLHDC1 | 9993 | 33088 | 56183 |
| KLHDC10 | 9994 | 33089 | 56184 |
| KLHDC2 | 9995 | 33090 | 56185 |
| KLHDC3 | 9996 | 33091 | 56186 |
| KLHDC4 | 9997 | 33092 | 56187 |
| KLHDC7A | 9998 | 33093 | 56188 |
| KLHDC7B | 9999 | 33094 | 56189 |
| KLHDC8A | 10000 | 33095 | 56190 |
| KLHDC8B | 10001 | 33096 | 56191 |
| KLHDC9 | 10002 | 33097 | 56192 |
| KLHDC9 | 10003 | 33098 | 56193 |
| KLHL1 | 10004 | 33099 | 56194 |
| KLHL10 | 10005 | 33100 | 56195 |
| KLHL11 | 10006 | 33101 | 56196 |
| KLHL12 | 10007 | 33102 | 56197 |
| KLHL13 | 10008 | 33103 | 56198 |
| KLHL14 | 10009 | 33104 | 56199 |
| KLHL15 | 10010 | 33105 | 56200 |
| KLHL17 | 10011 | 33106 | 56201 |
| KLHL18 | 10012 | 33107 | 56202 |
| KLHL2 | 10013 | 33108 | 56203 |
| KLHL20 | 10014 | 33109 | 56204 |
| KLHL21 | 10015 | 33110 | 56205 |
| KLHL21 | 10016 | 33111 | 56206 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| KLHL22 | 10017 | 33112 | 56207 |
| KLHL23 | 10018 | 33113 | 56208 |
| KLHL24 | 10019 | 33114 | 56209 |
| KLHL25 | 10020 | 33115 | 56210 |
| KLHL26 | 10021 | 33116 | 56211 |
| KLHL26 | 10022 | 33117 | 56212 |
| KLHL26 | 10023 | 33118 | 56213 |
| KLHL28 | 10024 | 33119 | 56214 |
| KLHL29 | 10025 | 33120 | 56215 |
| KLHL3 | 10026 | 33121 | 56216 |
| KLHL30 | 10027 | 33122 | 56217 |
| KLHL31 | 10028 | 33123 | 56218 |
| KLHL32 | 10029 | 33124 | 56219 |
| KLHL32 | 10030 | 33125 | 56220 |
| KLHL32 | 10031 | 33126 | 56221 |
| KLHL33 | 10032 | 33127 | 56222 |
| KLHL34 | 10033 | 33128 | 56223 |
| KLHL35 | 10034 | 33129 | 56224 |
| KLHL36 | 10035 | 33130 | 56225 |
| KLHL38 | 10036 | 33131 | 56226 |
| KLHL4 | 10037 | 33132 | 56227 |
| KLHL4 | 10038 | 33133 | 56228 |
| KLHL40 | 10039 | 33134 | 56229 |
| KLHL41 | 10040 | 33135 | 56230 |
| KLHL42 | 10041 | 33136 | 56231 |
| KLHL5 | 10042 | 33137 | 56232 |
| KLHL6 | 10043 | 33138 | 56233 |
| KLHL7 | 10044 | 33139 | 56234 |
| KLHL7 | 10045 | 33140 | 56235 |
| KLHL8 | 10046 | 33141 | 56236 |
| KLHL9 | 10047 | 33142 | 56237 |
| KLK1 | 10048 | 33143 | 56238 |
| KLK10 | 10049 | 33144 | 56239 |
| KLK11 | 10050 | 33145 | 56240 |
| KLK12 | 10051 | 33146 | 56241 |
| KLK12 | 10052 | 33147 | 56242 |
| KLK13 | 10053 | 33148 | 56243 |
| KLK13 | 10054 | 33149 | 56244 |
| KLK14 | 10055 | 33150 | 56245 |
| KLK15 | 10056 | 33151 | 56246 |
| KLK15 | 10057 | 33152 | 56247 |
| KLK2 | 10058 | 33153 | 56248 |
| KLK2 | 10059 | 33154 | 56249 |
| KLK3 | 10060 | 33155 | 56250 |
| KLK3 | 10061 | 33156 | 56251 |
| KLK4 | 10062 | 33157 | 56252 |
| KLK4 | 10063 | 33158 | 56253 |
| KLK5 | 10064 | 33159 | 56254 |
| KLK6 | 10065 | 33160 | 56255 |
| KLK6 | 10066 | 33161 | 56256 |
| KLK7 | 10067 | 33162 | 56257 |
| KLK8 | 10068 | 33163 | 56258 |
| KLK8 | 10069 | 33164 | 56259 |
| KLK9 | 10070 | 33165 | 56260 |
| KLKB1 | 10071 | 33166 | 56261 |
| KLKB1 | 10072 | 33167 | 56262 |
| KLLN | 10073 | 33168 | 56263 |
| KLRB1 | 10074 | 33169 | 56264 |
| KLRC1 | 10075 | 33170 | 56265 |
| KLRC2 | 10076 | 33171 | 56266 |
| KLRC3 | 10077 | 33172 | 56267 |
| KLRC4 | 10078 | 33173 | 56268 |
| KLRD1 | 10079 | 33174 | 56269 |
| KLRF1 | 10080 | 33175 | 56270 |
| KLRF1 | 10081 | 33176 | 56271 |
| KLRF2 | 10082 | 33177 | 56272 |
| KLRG1 | 10083 | 33178 | 56273 |
| KLRG1 | 10084 | 33179 | 56274 |
| KLRG2 | 10085 | 33180 | 56275 |
| KLRK1 | 10086 | 33181 | 56276 |
| KMO | 10087 | 33182 | 56277 |
| KMT2A | 10088 | 33183 | 56278 |
| KMT2B | 10089 | 33184 | 56279 |
| KMT2C | 10090 | 33185 | 56280 |
| KMT2D | 10091 | 33186 | 56281 |
| KMT2E | 10092 | 33187 | 56282 |
| KMT5A | 10093 | 33188 | 56283 |
| KMT5B | 10094 | 33189 | 56284 |
| KMT5B | 10095 | 33190 | 56285 |
| KMT5C | 10096 | 33191 | 56286 |
| KNCN | 10097 | 33192 | 56287 |
| KNDC1 | 10098 | 33193 | 56288 |
| KNDC1 | 10099 | 33194 | 56289 |
| KNDC1 | 10100 | 33195 | 56290 |
| KNDC1 | 10101 | 33196 | 56291 |
| KNG1 | 10102 | 33197 | 56292 |
| KNG1 | 10103 | 33198 | 56293 |
| KNL1 | 10104 | 33199 | 56294 |
| KNOP1 | 10105 | 33200 | 56295 |
| KNSTRN | 10106 | 33201 | 56296 |
| KNSTRN | 10107 | 33202 | 56297 |
| KNSTRN | 10108 | 33203 | 56298 |
| KNTC1 | 10109 | 33204 | 56299 |
| KPNA1 | 10110 | 33205 | 56300 |
| KPNA2 | 10111 | 33206 | 56301 |
| KPNA3 | 10112 | 33207 | 56302 |
| KPNA4 | 10113 | 33208 | 56303 |
| KPNA5 | 10114 | 33209 | 56304 |
| KPNA6 | 10115 | 33210 | 56305 |
| KPNA7 | 10116 | 33211 | 56306 |
| KPNB1 | 10117 | 33212 | 56307 |
| KPRP | 10118 | 33213 | 56308 |
| KPTN | 10119 | 33214 | 56309 |
| KRAS | 10120 | 33215 | 56310 |
| KRAS | 10121 | 33216 | 56311 |
| KRBA1 | 10122 | 33217 | 56312 |
| KRBA2 | 10123 | 33218 | 56313 |
| KRBOX1 | 10124 | 33219 | 56314 |
| KRBOX4 | 10125 | 33220 | 56315 |
| KRBOX4 | 10126 | 33221 | 56316 |
| KRCC1 | 10127 | 33222 | 56317 |
| KREMEN1 | 10128 | 33223 | 56318 |
| KREMEN1 | 10129 | 33224 | 56319 |
| KREMEN2 | 10130 | 33225 | 56320 |
| KREMEN2 | 10131 | 33226 | 56321 |
| KRI1 | 10132 | 33227 | 56322 |
| KRIT1 | 10133 | 33228 | 56323 |
| KRR1 | 10134 | 33229 | 56324 |
| KRT1 | 10135 | 33230 | 56325 |
| KRT10 | 10136 | 33231 | 56326 |
| KRT12 | 10137 | 33232 | 56327 |
| KRT13 | 10138 | 33233 | 56328 |
| KRT13 | 10139 | 33234 | 56329 |
| KRT14 | 10140 | 33235 | 56330 |
| KRT15 | 10141 | 33236 | 56331 |
| KRT16 | 10142 | 33237 | 56332 |
| KRT17 | 10143 | 33238 | 56333 |
| KRT18 | 10144 | 33239 | 56334 |
| KRT19 | 10145 | 33240 | 56335 |
| KRT2 | 10146 | 33241 | 56336 |
| KRT20 | 10147 | 33242 | 56337 |
| KRT222 | 10148 | 33243 | 56338 |
| KRT23 | 10149 | 33244 | 56339 |
| KRT24 | 10150 | 33245 | 56340 |
| KRT25 | 10151 | 33246 | 56341 |
| KRT26 | 10152 | 33247 | 56342 |
| KRT27 | 10153 | 33248 | 56343 |
| KRT28 | 10154 | 33249 | 56344 |
| KRT3 | 10155 | 33250 | 56345 |
| KRT31 | 10156 | 33251 | 56346 |
| KRT32 | 10157 | 33252 | 56347 |
| KRT33A | 10158 | 33253 | 56348 |
| KRT33B | 10159 | 33254 | 56349 |
| KRT34 | 10160 | 33255 | 56350 |
| KRT35 | 10161 | 33256 | 56351 |
| KRT36 | 10162 | 33257 | 56352 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| KRT37 | 10163 | 33258 | 56353 |
| KRT38 | 10164 | 33259 | 56354 |
| KRT39 | 10165 | 33260 | 56355 |
| KRT4 | 10166 | 33261 | 56356 |
| KRT40 | 10167 | 33262 | 56357 |
| KRT5 | 10168 | 33263 | 56358 |
| KRT6A | 10169 | 33264 | 56359 |
| KRT6B | 10170 | 33265 | 56360 |
| KRT7 | 10171 | 33266 | 56361 |
| KRT71 | 10172 | 33267 | 56362 |
| KRT72 | 10173 | 33268 | 56363 |
| KRT73 | 10174 | 33269 | 56364 |
| KRT74 | 10175 | 33270 | 56365 |
| KRT75 | 10176 | 33271 | 56366 |
| KRT76 | 10177 | 33272 | 56367 |
| KRT77 | 10178 | 33273 | 56368 |
| KRT78 | 10179 | 33274 | 56369 |
| KRT79 | 10180 | 33275 | 56370 |
| KRT8 | 10181 | 33276 | 56371 |
| KRT80 | 10182 | 33277 | 56372 |
| KRT80 | 10183 | 33278 | 56373 |
| KRT81 | 10184 | 33279 | 56374 |
| KRT82 | 10185 | 33280 | 56375 |
| KRT83 | 10186 | 33281 | 56376 |
| KRT84 | 10187 | 33282 | 56377 |
| KRT85 | 10188 | 33283 | 56378 |
| KRT86 | 10189 | 33284 | 56379 |
| KRT9 | 10190 | 33285 | 56380 |
| KRTAP1-1 | 10191 | 33286 | 56381 |
| KRTAP1-3 | 10192 | 33287 | 56382 |
| KRTAP1-4 | 10193 | 33288 | 56383 |
| KRTAP1-5 | 10194 | 33289 | 56384 |
| KRTAP10-11 | 10195 | 33290 | 56385 |
| KRTAP10-2 | 10196 | 33291 | 56386 |
| KRTAP10-3 | 10197 | 33292 | 56387 |
| KRTAP10-4 | 10198 | 33293 | 56388 |
| KRTAP10-5 | 10199 | 33294 | 56389 |
| KRTAP10-6 | 10200 | 33295 | 56390 |
| KRTAP10-7 | 10201 | 33296 | 56391 |
| KRTAP10-9 | 10202 | 33297 | 56392 |
| KRTAP11-1 | 10203 | 33298 | 56393 |
| KRTAP12-1 | 10204 | 33299 | 56394 |
| KRTAP12-3 | 10205 | 33300 | 56395 |
| KRTAP12-4 | 10206 | 33301 | 56396 |
| KRTAP13-1 | 10207 | 33302 | 56397 |
| KRTAP13-2 | 10208 | 33303 | 56398 |
| KRTAP13-3 | 10209 | 33304 | 56399 |
| KRTAP13-4 | 10210 | 33305 | 56400 |
| KRTAP15-1 | 10211 | 33306 | 56401 |
| KRTAP16-1 | 10212 | 33307 | 56402 |
| KRTAP17-1 | 10213 | 33308 | 56403 |
| KRTAP19-1 | 10214 | 33309 | 56404 |
| KRTAP19-2 | 10215 | 33310 | 56405 |
| KRTAP19-3 | 10216 | 33311 | 56406 |
| KRTAP19-4 | 10217 | 33312 | 56407 |
| KRTAP19-5 | 10218 | 33313 | 56408 |
| KRTAP19-6 | 10219 | 33314 | 56409 |
| KRTAP19-7 | 10220 | 33315 | 56410 |
| KRTAP19-8 | 10221 | 33316 | 56411 |
| KRTAP2-2 | 10222 | 33317 | 56412 |
| KRTAP2-3 | 10223 | 33318 | 56413 |
| KRTAP2-4 | 10224 | 33319 | 56414 |
| KRTAP20-1 | 10225 | 33320 | 56415 |
| KRTAP20-2 | 10226 | 33321 | 56416 |
| KRTAP20-3 | 10227 | 33322 | 56417 |
| KRTAP20-4 | 10228 | 33323 | 56418 |
| KRTAP21-1 | 10229 | 33324 | 56419 |
| KRTAP21-2 | 10230 | 33325 | 56420 |
| KRTAP21-3 | 10231 | 33326 | 56421 |
| KRTAP22-1 | 10232 | 33327 | 56422 |
| KRTAP22-2 | 10233 | 33328 | 56423 |
| KRTAP23-1 | 10234 | 33329 | 56424 |
| KRTAP24-1 | 10235 | 33330 | 56425 |
| KRTAP25-1 | 10236 | 33331 | 56426 |
| KRTAP26-1 | 10237 | 33332 | 56427 |
| KRTAP27-1 | 10238 | 33333 | 56428 |
| KRTAP29-1 | 10239 | 33334 | 56429 |
| KRTAP3-1 | 10240 | 33335 | 56430 |
| KRTAP3-2 | 10241 | 33336 | 56431 |
| KRTAP3-3 | 10242 | 33337 | 56432 |
| KRTAP4-1 | 10243 | 33338 | 56433 |
| KRTAP4-12 | 10244 | 33339 | 56434 |
| KRTAP4-2 | 10245 | 33340 | 56435 |
| KRTAP4-3 | 10246 | 33341 | 56436 |
| KRTAP4-4 | 10247 | 33342 | 56437 |
| KRTAP4-5 | 10248 | 33343 | 56438 |
| KRTAP4-6 | 10249 | 33344 | 56439 |
| KRTAP4-8 | 10250 | 33345 | 56440 |
| KRTAP5-1 | 10251 | 33346 | 56441 |
| KRTAP5-4 | 10252 | 33347 | 56442 |
| KRTAP5-6 | 10253 | 33348 | 56443 |
| KRTAP5-8 | 10254 | 33349 | 56444 |
| KRTAP5-9 | 10255 | 33350 | 56445 |
| KRTAP6-1 | 10256 | 33351 | 56446 |
| KRTAP6-2 | 10257 | 33352 | 56447 |
| KRTAP6-3 | 10258 | 33353 | 56448 |
| KRTAP7-1 | 10259 | 33354 | 56449 |
| KRTAP8-1 | 10260 | 33355 | 56450 |
| KRTAP9-1 | 10261 | 33356 | 56451 |
| KRTAP9-3 | 10262 | 33357 | 56452 |
| KRTAP9-4 | 10263 | 33358 | 56453 |
| KRTAP9-6 | 10264 | 33359 | 56454 |
| KRTAP9-7 | 10265 | 33360 | 56455 |
| KRTAP9-8 | 10266 | 33361 | 56456 |
| KRTAP9-9 | 10267 | 33362 | 56457 |
| KRTCAP2 | 10268 | 33363 | 56458 |
| KRTCAP3 | 10269 | 33364 | 56459 |
| KRTDAP | 10270 | 33365 | 56460 |
| KSR1 | 10271 | 33366 | 56461 |
| KSR2 | 10272 | 33367 | 56462 |
| KTI12 | 10273 | 33368 | 56463 |
| KTN1 | 10274 | 33369 | 56464 |
| KXD1 | 10275 | 33370 | 56465 |
| KY | 10276 | 33371 | 56466 |
| KY | 10277 | 33372 | 56467 |
| KYAT1 | 10278 | 33373 | 56468 |
| KYAT3 | 10279 | 33374 | 56469 |
| KYNU | 10280 | 33375 | 56470 |
| KYNU | 10281 | 33376 | 56471 |
| L1CAM | 10282 | 33377 | 56472 |
| L1TD1 | 10283 | 33378 | 56473 |
| L2HGDH | 10284 | 33379 | 56474 |
| L3HYPDH | 10285 | 33380 | 56475 |
| L3HYPDH | 10286 | 33381 | 56476 |
| L3HYPDH | 10287 | 33382 | 56477 |
| L3MBTL1 | 10288 | 33383 | 56478 |
| L3MBTL2 | 10289 | 33384 | 56479 |
| L3MBTL3 | 10290 | 33385 | 56480 |
| L3MBTL4 | 10291 | 33386 | 56481 |
| LACC1 | 10292 | 33387 | 56482 |
| LACC1 | 10293 | 33388 | 56483 |
| LACRT | 10294 | 33389 | 56484 |
| LACTB | 10295 | 33390 | 56485 |
| LACTB | 10296 | 33391 | 56486 |
| LACTB | 10297 | 33392 | 56487 |
| LACTB2 | 10298 | 33393 | 56488 |
| LACTBL1 | 10299 | 33394 | 56489 |
| LAD1 | 10300 | 33395 | 56490 |
| LAG3 | 10301 | 33396 | 56491 |
| LAGE3 | 10302 | 33397 | 56492 |
| LAIR1 | 10303 | 33398 | 56493 |
| LAIR2 | 10304 | 33399 | 56494 |
| LALBA | 10305 | 33400 | 56495 |
| LAMA1 | 10306 | 33401 | 56496 |
| LAMA2 | 10307 | 33402 | 56497 |
| LAMA3 | 10308 | 33403 | 56498 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| LAMA3 | 10309 | 33404 | 56499 |
| LAMA4 | 10310 | 33405 | 56500 |
| LAMA4 | 10311 | 33406 | 56501 |
| LAMA5 | 10312 | 33407 | 56502 |
| LAMB1 | 10313 | 33408 | 56503 |
| LAMB2 | 10314 | 33409 | 56504 |
| LAMB3 | 10315 | 33410 | 56505 |
| LAMB4 | 10316 | 33411 | 56506 |
| LAMB4 | 10317 | 33412 | 56507 |
| LAMB4 | 10318 | 33413 | 56508 |
| LAMC1 | 10319 | 33414 | 56509 |
| LAMC2 | 10320 | 33415 | 56510 |
| LAMC2 | 10321 | 33416 | 56511 |
| LAMC3 | 10322 | 33417 | 56512 |
| LAMP1 | 10323 | 33418 | 56513 |
| LAMP2 | 10324 | 33419 | 56514 |
| LAMP2 | 10325 | 33420 | 56515 |
| LAMP2 | 10326 | 33421 | 56516 |
| LAMP3 | 10327 | 33422 | 56517 |
| LAMP5 | 10328 | 33423 | 56518 |
| LAMTOR1 | 10329 | 33424 | 56519 |
| LAMTOR2 | 10330 | 33425 | 56520 |
| LAMTOR3 | 10331 | 33426 | 56521 |
| LAMTOR4 | 10332 | 33427 | 56522 |
| LAMTOR4 | 10333 | 33428 | 56523 |
| LAMTOR5 | 10334 | 33429 | 56524 |
| LANCL1 | 10335 | 33430 | 56525 |
| LANCL2 | 10336 | 33431 | 56526 |
| LANCL3 | 10337 | 33432 | 56527 |
| LANCL3 | 10338 | 33433 | 56528 |
| LAP3 | 10339 | 33434 | 56529 |
| LAPTM4A | 10340 | 33435 | 56530 |
| LAPTM4B | 10341 | 33436 | 56531 |
| LAPTM5 | 10342 | 33437 | 56532 |
| LARGE1 | 10343 | 33438 | 56533 |
| LARGE2 | 10344 | 33439 | 56534 |
| LARP1 | 10345 | 33440 | 56535 |
| LARP1B | 10346 | 33441 | 56536 |
| LARP1B | 10347 | 33442 | 56537 |
| LARP1B | 10348 | 33443 | 56538 |
| LARP1B | 10349 | 33444 | 56539 |
| LARP4 | 10350 | 33445 | 56540 |
| LARP4 | 10351 | 33446 | 56541 |
| LARP4 | 10352 | 33447 | 56542 |
| LARP4 | 10353 | 33448 | 56543 |
| LARP4B | 10354 | 33449 | 56544 |
| LARP6 | 10355 | 33450 | 56545 |
| LARP6 | 10356 | 33451 | 56546 |
| LARP7 | 10357 | 33452 | 56547 |
| LARS | 10358 | 33453 | 56548 |
| LARS2 | 10359 | 33454 | 56549 |
| LAS1L | 10360 | 33455 | 56550 |
| LASP1 | 10361 | 33456 | 56551 |
| LAT | 10362 | 33457 | 56552 |
| LAT2 | 10363 | 33458 | 56553 |
| LATS1 | 10364 | 33459 | 56554 |
| LATS1 | 10365 | 33460 | 56555 |
| LATS2 | 10366 | 33461 | 56556 |
| LAX1 | 10367 | 33462 | 56557 |
| LAYN | 10368 | 33463 | 56558 |
| LBH | 10369 | 33464 | 56559 |
| LBHD1 | 10370 | 33465 | 56560 |
| LBP | 10371 | 33466 | 56561 |
| LBR | 10372 | 33467 | 56562 |
| LBX1 | 10373 | 33468 | 56563 |
| LBX2 | 10374 | 33469 | 56564 |
| LCA5 | 10375 | 33470 | 56565 |
| LCA5L | 10376 | 33471 | 56566 |
| LCAT | 10377 | 33472 | 56567 |
| LCE1B | 10378 | 33473 | 56568 |
| LCE1C | 10379 | 33474 | 56569 |
| LCE2A | 10380 | 33475 | 56570 |
| LCE2C | 10381 | 33476 | 56571 |
| LCE3A | 10382 | 33477 | 56572 |
| LCE3B | 10383 | 33478 | 56573 |
| LCE3E | 10384 | 33479 | 56574 |
| LCE4A | 10385 | 33480 | 56575 |
| LCE5A | 10386 | 33481 | 56576 |
| LCE6A | 10387 | 33482 | 56577 |
| LCK | 10388 | 33483 | 56578 |
| LCLAT1 | 10389 | 33484 | 56579 |
| LCMT1 | 10390 | 33485 | 56580 |
| LCMT2 | 10391 | 33486 | 56581 |
| LCN1 | 10392 | 33487 | 56582 |
| LCN1 | 10393 | 33488 | 56583 |
| LCN10 | 10394 | 33489 | 56584 |
| LCN12 | 10395 | 33490 | 56585 |
| LCN15 | 10396 | 33491 | 56586 |
| LCN2 | 10397 | 33492 | 56587 |
| LCN6 | 10398 | 33493 | 56588 |
| LCN8 | 10399 | 33494 | 56589 |
| LCN9 | 10400 | 33495 | 56590 |
| LCNL1 | 10401 | 33496 | 56591 |
| LCOR | 10402 | 33497 | 56592 |
| LCOR | 10403 | 33498 | 56593 |
| LCOR | 10404 | 33499 | 56594 |
| LCORL | 10405 | 33500 | 56595 |
| LCORL | 10406 | 33501 | 56596 |
| LCP1 | 10407 | 33502 | 56597 |
| LCP2 | 10408 | 33503 | 56598 |
| LCT | 10409 | 33504 | 56599 |
| LCTL | 10410 | 33505 | 56600 |
| LDAH | 10411 | 33506 | 56601 |
| LDAH | 10412 | 33507 | 56602 |
| LDB1 | 10413 | 33508 | 56603 |
| LDB2 | 10414 | 33509 | 56604 |
| LDB2 | 10415 | 33510 | 56605 |
| LDB2 | 10416 | 33511 | 56606 |
| LDB3 | 10417 | 33512 | 56607 |
| LDB3 | 10418 | 33513 | 56608 |
| LDHA | 10419 | 33514 | 56609 |
| LDHA | 10420 | 33515 | 56610 |
| LDHA | 10421 | 33516 | 56611 |
| LDHAL6A | 10422 | 33517 | 56612 |
| LDHAL6B | 10423 | 33518 | 56613 |
| LDHB | 10424 | 33519 | 56614 |
| LDHC | 10425 | 33520 | 56615 |
| LDHD | 10426 | 33521 | 56616 |
| LDLR | 10427 | 33522 | 56617 |
| LDLRAD1 | 10428 | 33523 | 56618 |
| LDLRAD1 | 10429 | 33524 | 56619 |
| LDLRAD2 | 10430 | 33525 | 56620 |
| LDLRAD3 | 10431 | 33526 | 56621 |
| LDLRAD4 | 10432 | 33527 | 56622 |
| LDLRAP1 | 10433 | 33528 | 56623 |
| LDOC1 | 10434 | 33529 | 56624 |
| LEAP2 | 10435 | 33530 | 56625 |
| LECT2 | 10436 | 33531 | 56626 |
| LEF1 | 10437 | 33532 | 56627 |
| LEF1 | 10438 | 33533 | 56628 |
| LEFTY1 | 10439 | 33534 | 56629 |
| LEFTY2 | 10440 | 33535 | 56630 |
| LEKR1 | 10441 | 33536 | 56631 |
| LEKR1 | 10442 | 33537 | 56632 |
| LELP1 | 10443 | 33538 | 56633 |
| LEMD1 | 10444 | 33539 | 56634 |
| LEMD1 | 10445 | 33540 | 56635 |
| LEMD2 | 10446 | 33541 | 56636 |
| LEMD3 | 10447 | 33542 | 56637 |
| LENEP | 10448 | 33543 | 56638 |
| LENG1 | 10449 | 33544 | 56639 |
| LENG8 | 10450 | 33545 | 56640 |
| LENG9 | 10451 | 33546 | 56641 |
| LEO1 | 10452 | 33547 | 56642 |
| LEO1 | 10453 | 33548 | 56643 |
| LEP | 10454 | 33549 | 56644 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| LEPR | 10455 | 33550 | 56645 |
| LEPR | 10456 | 33551 | 56646 |
| LEPR | 10457 | 33552 | 56647 |
| LEPR | 10458 | 33553 | 56648 |
| LEPROT | 10459 | 33554 | 56649 |
| LEPROT | 10460 | 33555 | 56650 |
| LEPROTL1 | 10461 | 33556 | 56651 |
| LEPROTL1 | 10462 | 33557 | 56652 |
| LETM1 | 10463 | 33558 | 56653 |
| LETM2 | 10464 | 33559 | 56654 |
| LETM2 | 10465 | 33560 | 56655 |
| LETMD1 | 10466 | 33561 | 56656 |
| LETMD1 | 10467 | 33562 | 56657 |
| LETMD1 | 10468 | 33563 | 56658 |
| LEUTX | 10469 | 33564 | 56659 |
| LEXM | 10470 | 33565 | 56660 |
| LEXM | 10471 | 33566 | 56661 |
| LFNG | 10472 | 33567 | 56662 |
| LFNG | 10473 | 33568 | 56663 |
| LGALS1 | 10474 | 33569 | 56664 |
| LGALS12 | 10475 | 33570 | 56665 |
| LGALS13 | 10476 | 33571 | 56666 |
| LGALS14 | 10477 | 33572 | 56667 |
| LGALS16 | 10478 | 33573 | 56668 |
| LGALS2 | 10479 | 33574 | 56669 |
| LGALS3 | 10480 | 33575 | 56670 |
| LGALS3 | 10481 | 33576 | 56671 |
| LGALS3BP | 10482 | 33577 | 56672 |
| LGALS4 | 10483 | 33578 | 56673 |
| LGALS7B | 10484 | 33579 | 56674 |
| LGALS8 | 10485 | 33580 | 56675 |
| LGALS9 | 10486 | 33581 | 56676 |
| LGALS9 | 10487 | 33582 | 56677 |
| LGALS9B | 10488 | 33583 | 56678 |
| LGALSL | 10489 | 33584 | 56679 |
| LGI1 | 10490 | 33585 | 56680 |
| LGI1 | 10491 | 33586 | 56681 |
| LGI2 | 10492 | 33587 | 56682 |
| LGI3 | 10493 | 33588 | 56683 |
| LGI4 | 10494 | 33589 | 56684 |
| LGMN | 10495 | 33590 | 56685 |
| LGR4 | 10496 | 33591 | 56686 |
| LGR5 | 10497 | 33592 | 56687 |
| LGR6 | 10498 | 33593 | 56688 |
| LGSN | 10499 | 33594 | 56689 |
| LGSN | 10500 | 33595 | 56690 |
| LHB | 10501 | 33596 | 56691 |
| LHCGR | 10502 | 33597 | 56692 |
| LHFPL1 | 10503 | 33598 | 56693 |
| LHFPL2 | 10504 | 33599 | 56694 |
| LHFPL3 | 10505 | 33600 | 56695 |
| LHFPL4 | 10506 | 33601 | 56696 |
| LHFPL5 | 10507 | 33602 | 56697 |
| LHFPL6 | 10508 | 33603 | 56698 |
| LHPP | 10509 | 33604 | 56699 |
| LHPP | 10510 | 33605 | 56700 |
| LHPP | 10511 | 33606 | 56701 |
| LHX1 | 10512 | 33607 | 56702 |
| LHX2 | 10513 | 33608 | 56703 |
| LHX3 | 10514 | 33609 | 56704 |
| LHX4 | 10515 | 33610 | 56705 |
| LHX5 | 10516 | 33611 | 56706 |
| LHX6 | 10517 | 33612 | 56707 |
| LHX6 | 10518 | 33613 | 56708 |
| LHX8 | 10519 | 33614 | 56709 |
| LHX9 | 10520 | 33615 | 56710 |
| LIAS | 10521 | 33616 | 56711 |
| LIAS | 10522 | 33617 | 56712 |
| LIAS | 10523 | 33618 | 56713 |
| LIAS | 10524 | 33619 | 56714 |
| LIF | 10525 | 33620 | 56715 |
| LIF | 10526 | 33621 | 56716 |
| LIFR | 10527 | 33622 | 56717 |
| LIG1 | 10528 | 33623 | 56718 |
| LIG3 | 10529 | 33624 | 56719 |
| LIG3 | 10530 | 33625 | 56720 |
| LIG4 | 10531 | 33626 | 56721 |
| LILRA1 | 10532 | 33627 | 56722 |
| LILRA1 | 10533 | 33628 | 56723 |
| LILRA2 | 10534 | 33629 | 56724 |
| LILRA2 | 10535 | 33630 | 56725 |
| LILRA3 | 10536 | 33631 | 56726 |
| LILRA4 | 10537 | 33632 | 56727 |
| LILRA5 | 10538 | 33633 | 56728 |
| LILRA5 | 10539 | 33634 | 56729 |
| LILRA6 | 10540 | 33635 | 56730 |
| LILRB1 | 10541 | 33636 | 56731 |
| LILRB1 | 10542 | 33637 | 56732 |
| LILRB2 | 10543 | 33638 | 56733 |
| LILRB2 | 10544 | 33639 | 56734 |
| LILRB2 | 10545 | 33640 | 56735 |
| LILRB3 | 10546 | 33641 | 56736 |
| LILRB4 | 10547 | 33642 | 56737 |
| LILRB4 | 10548 | 33643 | 56738 |
| LILRB5 | 10549 | 33644 | 56739 |
| LIM2 | 10550 | 33645 | 56740 |
| LIMA1 | 10551 | 33646 | 56741 |
| LIMCH1 | 10552 | 33647 | 56742 |
| LIMD1 | 10553 | 33648 | 56743 |
| LIMD2 | 10554 | 33649 | 56744 |
| LIME1 | 10555 | 33650 | 56745 |
| LIME1 | 10556 | 33651 | 56746 |
| LIMK1 | 10557 | 33652 | 56747 |
| LIMK2 | 10558 | 33653 | 56748 |
| LIMK2 | 10559 | 33654 | 56749 |
| LIMS1 | 10560 | 33655 | 56750 |
| LIMS2 | 10561 | 33656 | 56751 |
| LIMS4 | 10562 | 33657 | 56752 |
| LIN28A | 10563 | 33658 | 56753 |
| LIN28B | 10564 | 33659 | 56754 |
| LIN37 | 10565 | 33660 | 56755 |
| LIN52 | 10566 | 33661 | 56756 |
| LIN54 | 10567 | 33662 | 56757 |
| LIN7A | 10568 | 33663 | 56758 |
| LIN7B | 10569 | 33664 | 56759 |
| LIN7C | 10570 | 33665 | 56760 |
| LIN9 | 10571 | 33666 | 56761 |
| LINC00452 | 10572 | 33667 | 56762 |
| LINC00694 | 10573 | 33668 | 56763 |
| LINC00890 | 10574 | 33669 | 56764 |
| LINC01125 | 10575 | 33670 | 56765 |
| LINC01638 | 10576 | 33671 | 56766 |
| LINC01835 | 10577 | 33672 | 56767 |
| LINC02054 | 10578 | 33673 | 56768 |
| LINC02210-CRHR1 | 10579 | 33674 | 56769 |
| LINGO1 | 10580 | 33675 | 56770 |
| LINGO2 | 10581 | 33676 | 56771 |
| LINGO3 | 10582 | 33677 | 56772 |
| LINGO4 | 10583 | 33678 | 56773 |
| LINS1 | 10584 | 33679 | 56774 |
| LIPA | 10585 | 33680 | 56775 |
| LIPC | 10586 | 33681 | 56776 |
| LIPE | 10587 | 33682 | 56777 |
| LIPF | 10588 | 33683 | 56778 |
| LIPG | 10589 | 33684 | 56779 |
| LIPH | 10590 | 33685 | 56780 |
| LIPI | 10591 | 33686 | 56781 |
| LIPI | 10592 | 33687 | 56782 |
| LIPJ | 10593 | 33688 | 56783 |
| LIPK | 10594 | 33689 | 56784 |
| LIPM | 10595 | 33690 | 56785 |
| LIPN | 10596 | 33691 | 56786 |
| LIPT1 | 10597 | 33692 | 56787 |
| LIPT2 | 10598 | 33693 | 56788 |
| LIPT2 | 10599 | 33694 | 56789 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| LITAF | 10600 | 33695 | 56790 |
| LITAF | 10601 | 33696 | 56791 |
| LIX1 | 10602 | 33697 | 56792 |
| LIX1L | 10603 | 33698 | 56793 |
| LKAAEAR1 | 10604 | 33699 | 56794 |
| LKAAEAR1 | 10605 | 33700 | 56795 |
| LLCFC1 | 10606 | 33701 | 56796 |
| LLGL1 | 10607 | 33702 | 56797 |
| LLGL2 | 10608 | 33703 | 56798 |
| LLGL2 | 10609 | 33704 | 56799 |
| LLGL2 | 10610 | 33705 | 56800 |
| LLPH | 10611 | 33706 | 56801 |
| LMAN1 | 10612 | 33707 | 56802 |
| LMAN1L | 10613 | 33708 | 56803 |
| LMAN2 | 10614 | 33709 | 56804 |
| LMAN2L | 10615 | 33710 | 56805 |
| LMBR1 | 10616 | 33711 | 56806 |
| LMBR1L | 10617 | 33712 | 56807 |
| LMBRD1 | 10618 | 33713 | 56808 |
| LMBRD2 | 10619 | 33714 | 56809 |
| LMCD1 | 10620 | 33715 | 56810 |
| LMCD1 | 10621 | 33716 | 56811 |
| LMF1 | 10622 | 33717 | 56812 |
| LMF1 | 10623 | 33718 | 56813 |
| LMF2 | 10624 | 33719 | 56814 |
| LMLN | 10625 | 33720 | 56815 |
| LMNA | 10626 | 33721 | 56816 |
| LMNA | 10627 | 33722 | 56817 |
| LMNA | 10628 | 33723 | 56818 |
| LMNB1 | 10629 | 33724 | 56819 |
| LMNB2 | 10630 | 33725 | 56820 |
| LMNTD1 | 10631 | 33726 | 56821 |
| LMNTD2 | 10632 | 33727 | 56822 |
| LMO1 | 10633 | 33728 | 56823 |
| LMO2 | 10634 | 33729 | 56824 |
| LMO3 | 10635 | 33730 | 56825 |
| LMO4 | 10636 | 33731 | 56826 |
| LMO7 | 10637 | 33732 | 56827 |
| LMO7 | 10638 | 33733 | 56828 |
| LMO7DN | 10639 | 33734 | 56829 |
| LMOD1 | 10640 | 33735 | 56830 |
| LMOD2 | 10641 | 33736 | 56831 |
| LMOD3 | 10642 | 33737 | 56832 |
| LMTK2 | 10643 | 33738 | 56833 |
| LMTK3 | 10644 | 33739 | 56834 |
| LMX1A | 10645 | 33740 | 56835 |
| LMX1B | 10646 | 33741 | 56836 |
| LNP1 | 10647 | 33742 | 56837 |
| LNPEP | 10648 | 33743 | 56838 |
| LNPK | 10649 | 33744 | 56839 |
| LNX1 | 10650 | 33745 | 56840 |
| LNX2 | 10651 | 33746 | 56841 |
| LOC100128108 | 10652 | 33747 | 56842 |
| LOC100129083 | 10653 | 33748 | 56843 |
| LOC100129307 | 10654 | 33749 | 56844 |
| LOC100129697 | 10655 | 33750 | 56845 |
| LOC100129940 | 10656 | 33751 | 56846 |
| LOC100130357 | 10657 | 33752 | 56847 |
| LOC100130370 | 10658 | 33753 | 56848 |
| LOC100130451 | 10659 | 33754 | 56849 |
| LOC100130520 | 10660 | 33755 | 56850 |
| LOC100130705 | 10661 | 33756 | 56851 |
| LOC100130880 | 10662 | 33757 | 56852 |
| LOC100131107 | 10663 | 33758 | 56853 |
| LOC100131303 | 10664 | 33759 | 56854 |
| LOC100132813 | 10665 | 33760 | 56855 |
| LOC100134391 | 10666 | 33761 | 56856 |
| LOC100287036 | 10667 | 33762 | 56857 |
| LOC100287896 | 10668 | 33763 | 56858 |
| LOC100288966 | 10669 | 33764 | 56859 |
| LOC100289561 | 10670 | 33765 | 56860 |
| LOC100505549 | 10671 | 33766 | 56861 |
| LOC100505841 | 10672 | 33767 | 56862 |
| LOC100506127 | 10673 | 33768 | 56863 |
| LOC100506127 | 10674 | 33769 | 56864 |
| LOC100506127 | 10675 | 33770 | 56865 |
| LOC100506127 | 10676 | 33771 | 56866 |
| LOC100506388 | 10677 | 33772 | 56867 |
| LOC100506422 | 10678 | 33773 | 56868 |
| LOC100507507 | 10679 | 33774 | 56869 |
| LOC100996693 | 10680 | 33775 | 56870 |
| LOC100996842 | 10681 | 33776 | 56871 |
| LOC101927322 | 10682 | 33777 | 56872 |
| LOC101927503 | 10683 | 33778 | 56873 |
| LOC101927572 | 10684 | 33779 | 56874 |
| LOC101927572 | 10685 | 33780 | 56875 |
| LOC101927844 | 10686 | 33781 | 56876 |
| LOC101928120 | 10687 | 33782 | 56877 |
| LOC101928436 | 10688 | 33783 | 56878 |
| LOC101928436 | 10689 | 33784 | 56879 |
| LOC101928841 | 10690 | 33785 | 56880 |
| LOC101929372 | 10691 | 33786 | 56881 |
| LOC102723383 | 10692 | 33787 | 56882 |
| LOC102724219 | 10693 | 33788 | 56883 |
| LOC102724265 | 10694 | 33789 | 56884 |
| LOC102724652 | 10695 | 33790 | 56885 |
| LOC102724957 | 10696 | 33791 | 56886 |
| LOC105372977 | 10697 | 33792 | 56887 |
| LOC105375787 | 10698 | 33793 | 56888 |
| LOC105376731 | 10699 | 33794 | 56889 |
| LOC105377372 | 10700 | 33795 | 56890 |
| LOC107984640 | 10701 | 33796 | 56891 |
| LOC107984974 | 10702 | 33797 | 56892 |
| LOC107984974 | 10703 | 33798 | 56893 |
| LOC107984974 | 10704 | 33799 | 56894 |
| LOC110117498 | 10705 | 33800 | 56895 |
| LOC149373 | 10706 | 33801 | 56896 |
| LOC150051 | 10707 | 33802 | 56897 |
| LOC283710 | 10708 | 33803 | 56898 |
| LOC284898 | 10709 | 33804 | 56899 |
| LOC285556 | 10710 | 33805 | 56900 |
| LOC339862 | 10711 | 33806 | 56901 |
| LOC388282 | 10712 | 33807 | 56902 |
| LOC388692 | 10713 | 33808 | 56903 |
| LOC388780 | 10714 | 33809 | 56904 |
| LOC388813 | 10715 | 33810 | 56905 |
| LOC389199 | 10716 | 33811 | 56906 |
| LOC389602 | 10717 | 33812 | 56907 |
| LOC389831 | 10718 | 33813 | 56908 |
| LOC389895 | 10719 | 33814 | 56909 |
| LOC390877 | 10720 | 33815 | 56910 |
| LOC391322 | 10721 | 33816 | 56911 |
| LOC391322 | 10722 | 33817 | 56912 |
| LOC403312 | 10723 | 33818 | 56913 |
| LOC441155 | 10724 | 33819 | 56914 |
| LOC643802 | 10725 | 33820 | 56915 |
| LOC645177 | 10726 | 33821 | 56916 |
| LOC645188 | 10727 | 33822 | 56917 |
| LOC728392 | 10728 | 33823 | 56918 |
| LOC728485 | 10729 | 33824 | 56919 |
| LOC729159 | 10730 | 33825 | 56920 |
| LOC730098 | 10731 | 33826 | 56921 |
| LOC730183 | 10732 | 33827 | 56922 |
| LOC79999 | 10733 | 33828 | 56923 |
| LONP1 | 10734 | 33829 | 56924 |
| LONP2 | 10735 | 33830 | 56925 |
| LONRF1 | 10736 | 33831 | 56926 |
| LONRF2 | 10737 | 33832 | 56927 |
| LONRF3 | 10738 | 33833 | 56928 |
| LOR | 10739 | 33834 | 56929 |
| LOX | 10740 | 33835 | 56930 |
| LOXHD1 | 10741 | 33836 | 56931 |
| LOXHD1 | 10742 | 33837 | 56932 |
| LOXHD1 | 10743 | 33838 | 56933 |
| LOXL1 | 10744 | 33839 | 56934 |
| LOXL2 | 10745 | 33840 | 56935 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| LOXL3 | 10746 | 33841 | 56936 |
| LOXL4 | 10747 | 33842 | 56937 |
| LPA | 10748 | 33843 | 56938 |
| LPAR1 | 10749 | 33844 | 56939 |
| LPAR2 | 10750 | 33845 | 56940 |
| LPAR3 | 10751 | 33846 | 56941 |
| LPAR4 | 10752 | 33847 | 56942 |
| LPAR5 | 10753 | 33848 | 56943 |
| LPAR6 | 10754 | 33849 | 56944 |
| LPCAT1 | 10755 | 33850 | 56945 |
| LPCAT2 | 10756 | 33851 | 56946 |
| LPCAT3 | 10757 | 33852 | 56947 |
| LPCAT4 | 10758 | 33853 | 56948 |
| LPGAT1 | 10759 | 33854 | 56949 |
| LPIN1 | 10760 | 33855 | 56950 |
| LPIN2 | 10761 | 33856 | 56951 |
| LPIN3 | 10762 | 33857 | 56952 |
| LPL | 10763 | 33858 | 56953 |
| LPO | 10764 | 33859 | 56954 |
| LPP | 10765 | 33860 | 56955 |
| LPXN | 10766 | 33861 | 56956 |
| LRAT | 10767 | 33862 | 56957 |
| LRBA | 10768 | 33863 | 56958 |
| LRCH1 | 10769 | 33864 | 56959 |
| LRCH1 | 10770 | 33865 | 56960 |
| LRCH2 | 10771 | 33866 | 56961 |
| LRCH3 | 10772 | 33867 | 56962 |
| LRCH4 | 10773 | 33868 | 56963 |
| LRCH4 | 10774 | 33869 | 56964 |
| LRCOL1 | 10775 | 33870 | 56965 |
| LRFN1 | 10776 | 33871 | 56966 |
| LRFN2 | 10777 | 33872 | 56967 |
| LRFN3 | 10778 | 33873 | 56968 |
| LRFN4 | 10779 | 33874 | 56969 |
| LRFN5 | 10780 | 33875 | 56970 |
| LRFN5 | 10781 | 33876 | 56971 |
| LRG1 | 10782 | 33877 | 56972 |
| LRGUK | 10783 | 33878 | 56973 |
| LRIF1 | 10784 | 33879 | 56974 |
| LRIG1 | 10785 | 33880 | 56975 |
| LRIG2 | 10786 | 33881 | 56976 |
| LRIG3 | 10787 | 33882 | 56977 |
| LRIT1 | 10788 | 33883 | 56978 |
| LRIT2 | 10789 | 33884 | 56979 |
| LRIT3 | 10790 | 33885 | 56980 |
| LRMDA | 10791 | 33886 | 56981 |
| LRMP | 10792 | 33887 | 56982 |
| LRP1 | 10793 | 33888 | 56983 |
| LRP10 | 10794 | 33889 | 56984 |
| LRP10 | 10795 | 33890 | 56985 |
| LRP11 | 10796 | 33891 | 56986 |
| LRP12 | 10797 | 33892 | 56987 |
| LRP1B | 10798 | 33893 | 56988 |
| LRP2 | 10799 | 33894 | 56989 |
| LRP2BP | 10800 | 33895 | 56990 |
| LRP3 | 10801 | 33896 | 56991 |
| LRP4 | 10802 | 33897 | 56992 |
| LRP5 | 10803 | 33898 | 56993 |
| LRP5L | 10804 | 33899 | 56994 |
| LRP6 | 10805 | 33900 | 56995 |
| LRP8 | 10806 | 33901 | 56996 |
| LRPAP1 | 10807 | 33902 | 56997 |
| LRPPRC | 10808 | 33903 | 56998 |
| LRR1 | 10809 | 33904 | 56999 |
| LRRC1 | 10810 | 33905 | 57000 |
| LRRC10 | 10811 | 33906 | 57001 |
| LRRC10B | 10812 | 33907 | 57002 |
| LRRC14 | 10813 | 33908 | 57003 |
| LRRC14B | 10814 | 33909 | 57004 |
| LRRC15 | 10815 | 33910 | 57005 |
| LRRC17 | 10816 | 33911 | 57006 |
| LRRC17 | 10817 | 33912 | 57007 |
| LRRC18 | 10818 | 33913 | 57008 |
| LRRC19 | 10819 | 33914 | 57009 |
| LRRC2 | 10820 | 33915 | 57010 |
| LRRC20 | 10821 | 33916 | 57011 |
| LRRC20 | 10822 | 33917 | 57012 |
| LRRC23 | 10823 | 33918 | 57013 |
| LRRC23 | 10824 | 33919 | 57014 |
| LRRC24 | 10825 | 33920 | 57015 |
| LRRC25 | 10826 | 33921 | 57016 |
| LRRC26 | 10827 | 33922 | 57017 |
| LRRC27 | 10828 | 33923 | 57018 |
| LRRC27 | 10829 | 33924 | 57019 |
| LRRC27 | 10830 | 33925 | 57020 |
| LRRC27 | 10831 | 33926 | 57021 |
| LRRC28 | 10832 | 33927 | 57022 |
| LRRC29 | 10833 | 33928 | 57023 |
| LRRC3 | 10834 | 33929 | 57024 |
| LRRC30 | 10835 | 33930 | 57025 |
| LRRC31 | 10836 | 33931 | 57026 |
| LRRC31 | 10837 | 33932 | 57027 |
| LRRC32 | 10838 | 33933 | 57028 |
| LRRC34 | 10839 | 33934 | 57029 |
| LRRC34 | 10840 | 33935 | 57030 |
| LRRC36 | 10841 | 33936 | 57031 |
| LRRC37A | 10842 | 33937 | 57032 |
| LRRC37B | 10843 | 33938 | 57033 |
| LRRC38 | 10844 | 33939 | 57034 |
| LRRC39 | 10845 | 33940 | 57035 |
| LRRC39 | 10846 | 33941 | 57036 |
| LRRC3B | 10847 | 33942 | 57037 |
| LRRC3C | 10848 | 33943 | 57038 |
| LRRC4 | 10849 | 33944 | 57039 |
| LRRC40 | 10850 | 33945 | 57040 |
| LRRC41 | 10851 | 33946 | 57041 |
| LRRC42 | 10852 | 33947 | 57042 |
| LRRC43 | 10853 | 33948 | 57043 |
| LRRC45 | 10854 | 33949 | 57044 |
| LRRC46 | 10855 | 33950 | 57045 |
| LRRC47 | 10856 | 33951 | 57046 |
| LRRC49 | 10857 | 33952 | 57047 |
| LRRC4B | 10858 | 33953 | 57048 |
| LRRC4C | 10859 | 33954 | 57049 |
| LRRC52 | 10860 | 33955 | 57050 |
| LRRC55 | 10861 | 33956 | 57051 |
| LRRC56 | 10862 | 33957 | 57052 |
| LRRC57 | 10863 | 33958 | 57053 |
| LRRC58 | 10864 | 33959 | 57054 |
| LRRC59 | 10865 | 33960 | 57055 |
| LRRC6 | 10866 | 33961 | 57056 |
| LRRC61 | 10867 | 33962 | 57057 |
| LRRC63 | 10868 | 33963 | 57058 |
| LRRC66 | 10869 | 33964 | 57059 |
| LRRC69 | 10870 | 33965 | 57060 |
| LRRC7 | 10871 | 33966 | 57061 |
| LRRC7 | 10872 | 33967 | 57062 |
| LRRC70 | 10873 | 33968 | 57063 |
| LRRC71 | 10874 | 33969 | 57064 |
| LRRC72 | 10875 | 33970 | 57065 |
| LRRC73 | 10876 | 33971 | 57066 |
| LRRC74A | 10877 | 33972 | 57067 |
| LRRC74B | 10878 | 33973 | 57068 |
| LRRC75A | 10879 | 33974 | 57069 |
| LRRC75A | 10880 | 33975 | 57070 |
| LRRC75B | 10881 | 33976 | 57071 |
| LRRC8A | 10882 | 33977 | 57072 |
| LRRC8B | 10883 | 33978 | 57073 |
| LRRC8C | 10884 | 33979 | 57074 |
| LRRC8D | 10885 | 33980 | 57075 |
| LRRC8E | 10886 | 33981 | 57076 |
| LRRCC1 | 10887 | 33982 | 57077 |
| LRRD1 | 10888 | 33983 | 57078 |
| LRRFIP1 | 10889 | 33984 | 57079 |
| LRRFIP1 | 10890 | 33985 | 57080 |
| LRRFIP2 | 10891 | 33986 | 57081 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| LRRIQ1 | 10892 | 33987 | 57082 |
| LRRIQ3 | 10893 | 33988 | 57083 |
| LRRIQ3 | 10894 | 33989 | 57084 |
| LRRIQ4 | 10895 | 33990 | 57085 |
| LRRK1 | 10896 | 33991 | 57086 |
| LRRK2 | 10897 | 33992 | 57087 |
| LRRN1 | 10898 | 33993 | 57088 |
| LRRN2 | 10899 | 33994 | 57089 |
| LRRN3 | 10900 | 33995 | 57090 |
| LRRN4 | 10901 | 33996 | 57091 |
| LRRN4CL | 10902 | 33997 | 57092 |
| LRRTM1 | 10903 | 33998 | 57093 |
| LRRTM2 | 10904 | 33999 | 57094 |
| LRRTM3 | 10905 | 34000 | 57095 |
| LRRTM4 | 10906 | 34001 | 57096 |
| LRRTM4 | 10907 | 34002 | 57097 |
| LRSAM1 | 10908 | 34003 | 57098 |
| LRTM1 | 10909 | 34004 | 57099 |
| LRTM2 | 10910 | 34005 | 57100 |
| LRTOMT | 10911 | 34006 | 57101 |
| LRTOMT | 10912 | 34007 | 57102 |
| LRTOMT | 10913 | 34008 | 57103 |
| LRTOMT | 10914 | 34009 | 57104 |
| LRWD1 | 10915 | 34010 | 57105 |
| LSAMP | 10916 | 34011 | 57106 |
| LSG1 | 10917 | 34012 | 57107 |
| LSM1 | 10918 | 34013 | 57108 |
| LSM1 | 10919 | 34014 | 57109 |
| LSM1 | 10920 | 34015 | 57110 |
| LSM10 | 10921 | 34016 | 57111 |
| LSM11 | 10922 | 34017 | 57112 |
| LSM12 | 10923 | 34018 | 57113 |
| LSM14A | 10924 | 34019 | 57114 |
| LSM14A | 10925 | 34020 | 57115 |
| LSM14B | 10926 | 34021 | 57116 |
| LSM2 | 10927 | 34022 | 57117 |
| LSM3 | 10928 | 34023 | 57118 |
| LSM4 | 10929 | 34024 | 57119 |
| LSM5 | 10930 | 34025 | 57120 |
| LSM5 | 10931 | 34026 | 57121 |
| LSM6 | 10932 | 34027 | 57122 |
| LSM7 | 10933 | 34028 | 57123 |
| LSM8 | 10934 | 34029 | 57124 |
| LSMEM1 | 10935 | 34030 | 57125 |
| LSMEM2 | 10936 | 34031 | 57126 |
| LSP1 | 10937 | 34032 | 57127 |
| LSR | 10938 | 34033 | 57128 |
| LSS | 10939 | 34034 | 57129 |
| LST1 | 10940 | 34035 | 57130 |
| LST1 | 10941 | 34036 | 57131 |
| LTA | 10942 | 34037 | 57132 |
| LTA4H | 10943 | 34038 | 57133 |
| LTA4H | 10944 | 34039 | 57134 |
| LTB | 10945 | 34040 | 57135 |
| LTB | 10946 | 34041 | 57136 |
| LTB4R | 10947 | 34042 | 57137 |
| LTB4R2 | 10948 | 34043 | 57138 |
| LTBP1 | 10949 | 34044 | 57139 |
| LTBP2 | 10950 | 34045 | 57140 |
| LTBP3 | 10951 | 34046 | 57141 |
| LTBP4 | 10952 | 34047 | 57142 |
| LTBR | 10953 | 34048 | 57143 |
| LTC4S | 10954 | 34049 | 57144 |
| LTF | 10955 | 34050 | 57145 |
| LTK | 10956 | 34051 | 57146 |
| LTN1 | 10957 | 34052 | 57147 |
| LTV1 | 10958 | 34053 | 57148 |
| LUC7L | 10959 | 34054 | 57149 |
| LUC7L | 10960 | 34055 | 57150 |
| LUC7L2 | 10961 | 34056 | 57151 |
| LUC7L3 | 10962 | 34057 | 57152 |
| LUC7L3 | 10963 | 34058 | 57153 |
| LUM | 10964 | 34059 | 57154 |
| LURAP1 | 10965 | 34060 | 57155 |
| LURAP1L | 10966 | 34061 | 57156 |
| LUZP1 | 10967 | 34062 | 57157 |
| LUZP2 | 10968 | 34063 | 57158 |
| LUZP4 | 10969 | 34064 | 57159 |
| LUZP6 | 10970 | 34065 | 57160 |
| LVRN | 10971 | 34066 | 57161 |
| LXN | 10972 | 34067 | 57162 |
| LY6D | 10973 | 34068 | 57163 |
| LY6E | 10974 | 34069 | 57164 |
| LY6G5B | 10975 | 34070 | 57165 |
| LY6G5C | 10976 | 34071 | 57166 |
| LY6G6C | 10977 | 34072 | 57167 |
| LY6G6D | 10978 | 34073 | 57168 |
| LY6G6F | 10979 | 34074 | 57169 |
| LY6G6F-LY6G6D | 10980 | 34075 | 57170 |
| LY6H | 10981 | 34076 | 57171 |
| LY6K | 10982 | 34077 | 57172 |
| LY6K | 10983 | 34078 | 57173 |
| LY6K | 10984 | 34079 | 57174 |
| LY75 | 10985 | 34080 | 57175 |
| LY86 | 10986 | 34081 | 57176 |
| LY9 | 10987 | 34082 | 57177 |
| LY9 | 10988 | 34083 | 57178 |
| LY96 | 10989 | 34084 | 57179 |
| LYAR | 10990 | 34085 | 57180 |
| LYG1 | 10991 | 34086 | 57181 |
| LYG2 | 10992 | 34087 | 57182 |
| LYL1 | 10993 | 34088 | 57183 |
| LYN | 10994 | 34089 | 57184 |
| LYNX1 | 10995 | 34090 | 57185 |
| LYNX1 | 10996 | 34091 | 57186 |
| LYPD1 | 10997 | 34092 | 57187 |
| LYPD1 | 10998 | 34093 | 57188 |
| LYPD1 | 10999 | 34094 | 57189 |
| LYPD2 | 11000 | 34095 | 57190 |
| LYPD3 | 11001 | 34096 | 57191 |
| LYPD4 | 11002 | 34097 | 57192 |
| LYPD5 | 11003 | 34098 | 57193 |
| LYPD6 | 11004 | 34099 | 57194 |
| LYPD6B | 11005 | 34100 | 57195 |
| LYPD8 | 11006 | 34101 | 57196 |
| LYPLA1 | 11007 | 34102 | 57197 |
| LYPLA2 | 11008 | 34103 | 57198 |
| LYPLAL1 | 11009 | 34104 | 57199 |
| LYRM1 | 11010 | 34105 | 57200 |
| LYRM2 | 11011 | 34106 | 57201 |
| LYRM4 | 11012 | 34107 | 57202 |
| LYRM4 | 11013 | 34108 | 57203 |
| LYRM4 | 11014 | 34109 | 57204 |
| LYRM4 | 11015 | 34110 | 57205 |
| LYRM4 | 11016 | 34111 | 57206 |
| LYRM7 | 11017 | 34112 | 57207 |
| LYRM7 | 11018 | 34113 | 57208 |
| LYRM9 | 11019 | 34114 | 57209 |
| LYSMD1 | 11020 | 34115 | 57210 |
| LYSMD2 | 11021 | 34116 | 57211 |
| LYSMD3 | 11022 | 34117 | 57212 |
| LYSMD3 | 11023 | 34118 | 57213 |
| LYSMD4 | 11024 | 34119 | 57214 |
| LYST | 11025 | 34120 | 57215 |
| LYVE1 | 11026 | 34121 | 57216 |
| LYZ | 11027 | 34122 | 57217 |
| LYZL1 | 11028 | 34123 | 57218 |
| LYZL2 | 11029 | 34124 | 57219 |
| LYZL4 | 11030 | 34125 | 57220 |
| LYZL6 | 11031 | 34126 | 57221 |
| LZIC | 11032 | 34127 | 57222 |
| LZIC | 11033 | 34128 | 57223 |
| LZTFL1 | 11034 | 34129 | 57224 |
| LZTFL1 | 11035 | 34130 | 57225 |
| LZTR1 | 11036 | 34131 | 57226 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| LZTS1 | 11037 | 34132 | 57227 |
| LZTS2 | 11038 | 34133 | 57228 |
| LZTS3 | 11039 | 34134 | 57229 |
| M1AP | 11040 | 34135 | 57230 |
| M1AP | 11041 | 34136 | 57231 |
| M6PR | 11042 | 34137 | 57232 |
| MAATS1 | 11043 | 34138 | 57233 |
| MAB21L1 | 11044 | 34139 | 57234 |
| MAB21L2 | 11045 | 34140 | 57235 |
| MAB21L3 | 11046 | 34141 | 57236 |
| MACC1 | 11047 | 34142 | 57237 |
| MACF1 | 11048 | 34143 | 57238 |
| MACROD1 | 11049 | 34144 | 57239 |
| MACROD2 | 11050 | 34145 | 57240 |
| MAD1L1 | 11051 | 34146 | 57241 |
| MAD2L1 | 11052 | 34147 | 57242 |
| MAD2L1BP | 11053 | 34148 | 57243 |
| MAD2L2 | 11054 | 34149 | 57244 |
| MADCAM1 | 11055 | 34150 | 57245 |
| MADD | 11056 | 34151 | 57246 |
| MADD | 11057 | 34152 | 57247 |
| MAEA | 11058 | 34153 | 57248 |
| MAEL | 11059 | 34154 | 57249 |
| MAF | 11060 | 34155 | 57250 |
| MAF | 11061 | 34156 | 57251 |
| MAF1 | 11062 | 34157 | 57252 |
| MAFA | 11063 | 34158 | 57253 |
| MAFB | 11064 | 34159 | 57254 |
| MAFF | 11065 | 34160 | 57255 |
| MAFG | 11066 | 34161 | 57256 |
| MAFK | 11067 | 34162 | 57257 |
| MAG | 11068 | 34163 | 57258 |
| MAG | 11069 | 34164 | 57259 |
| MAGEA1 | 11070 | 34165 | 57260 |
| MAGEA10 | 11071 | 34166 | 57261 |
| MAGEA11 | 11072 | 34167 | 57262 |
| MAGEA12 | 11073 | 34168 | 57263 |
| MAGEA2B | 11074 | 34169 | 57264 |
| MAGEA3 | 11075 | 34170 | 57265 |
| MAGEA4 | 11076 | 34171 | 57266 |
| MAGEA5 | 11077 | 34172 | 57267 |
| MAGEA6 | 11078 | 34173 | 57268 |
| MAGEA8 | 11079 | 34174 | 57269 |
| MAGEA9B | 11080 | 34175 | 57270 |
| MAGEB1 | 11081 | 34176 | 57271 |
| MAGEB10 | 11082 | 34177 | 57272 |
| MAGEB16 | 11083 | 34178 | 57273 |
| MAGEB17 | 11084 | 34179 | 57274 |
| MAGEB18 | 11085 | 34180 | 57275 |
| MAGEB2 | 11086 | 34181 | 57276 |
| MAGEB3 | 11087 | 34182 | 57277 |
| MAGEB4 | 11088 | 34183 | 57278 |
| MAGEB5 | 11089 | 34184 | 57279 |
| MAGEB6 | 11090 | 34185 | 57280 |
| MAGEC1 | 11091 | 34186 | 57281 |
| MAGEC2 | 11092 | 34187 | 57282 |
| MAGEC3 | 11093 | 34188 | 57283 |
| MAGEC3 | 11094 | 34189 | 57284 |
| MAGED1 | 11095 | 34190 | 57285 |
| MAGED2 | 11096 | 34191 | 57286 |
| MAGED4 | 11097 | 34192 | 57287 |
| MAGED4 | 11098 | 34193 | 57288 |
| MAGEE1 | 11099 | 34194 | 57289 |
| MAGEE2 | 11100 | 34195 | 57290 |
| MAGEF1 | 11101 | 34196 | 57291 |
| MAGEH1 | 11102 | 34197 | 57292 |
| MAGEL2 | 11103 | 34198 | 57293 |
| MAGI1 | 11104 | 34199 | 57294 |
| MAGI1 | 11105 | 34200 | 57295 |
| MAGI1 | 11106 | 34201 | 57296 |
| MAGI2 | 11107 | 34202 | 57297 |
| MAGI3 | 11108 | 34203 | 57298 |
| MAGI3 | 11109 | 34204 | 57299 |
| MAGIX | 11110 | 34205 | 57300 |
| MAGOH | 11111 | 34206 | 57301 |
| MAGOHB | 11112 | 34207 | 57302 |
| MAGT1 | 11113 | 34208 | 57303 |
| MAIP1 | 11114 | 34209 | 57304 |
| MAJIN | 11115 | 34210 | 57305 |
| MAJIN | 11116 | 34211 | 57306 |
| MAK | 11117 | 34212 | 57307 |
| MAK 16 | 11118 | 34213 | 57308 |
| MAL | 11119 | 34214 | 57309 |
| MAL | 11120 | 34215 | 57310 |
| MAL2 | 11121 | 34216 | 57311 |
| MALL | 11122 | 34217 | 57312 |
| MALRD1 | 11123 | 34218 | 57313 |
| MALSU1 | 11124 | 34219 | 57314 |
| MALT1 | 11125 | 34220 | 57315 |
| MAMDC2 | 11126 | 34221 | 57316 |
| MAMDC2 | 11127 | 34222 | 57317 |
| MAMDC4 | 11128 | 34223 | 57318 |
| MAML1 | 11129 | 34224 | 57319 |
| MAML2 | 11130 | 34225 | 57320 |
| MAML3 | 11131 | 34226 | 57321 |
| MAMLD1 | 11132 | 34227 | 57322 |
| MAMLD1 | 11133 | 34228 | 57323 |
| MAMSTR | 11134 | 34229 | 57324 |
| MAN1A1 | 11135 | 34230 | 57325 |
| MAN1A2 | 11136 | 34231 | 57326 |
| MAN1B1 | 11137 | 34232 | 57327 |
| MAN1C1 | 11138 | 34233 | 57328 |
| MAN1C1 | 11139 | 34234 | 57329 |
| MAN2A1 | 11140 | 34235 | 57330 |
| MAN2A2 | 11141 | 34236 | 57331 |
| MAN2B1 | 11142 | 34237 | 57332 |
| MAN2B2 | 11143 | 34238 | 57333 |
| MAN2C1 | 11144 | 34239 | 57334 |
| MANBA | 11145 | 34240 | 57335 |
| MANBAL | 11146 | 34241 | 57336 |
| MANEA | 11147 | 34242 | 57337 |
| MANEAL | 11148 | 34243 | 57338 |
| MANEAL | 11149 | 34244 | 57339 |
| MANF | 11150 | 34245 | 57340 |
| MANSC1 | 11151 | 34246 | 57341 |
| MANSC4 | 11152 | 34247 | 57342 |
| MAOA | 11153 | 34248 | 57343 |
| MAOA | 11154 | 34249 | 57344 |
| MAOB | 11155 | 34250 | 57345 |
| MAP10 | 11156 | 34251 | 57346 |
| MAP1A | 11157 | 34252 | 57347 |
| MAP1B | 11158 | 34253 | 57348 |
| MAP1LC3A | 11159 | 34254 | 57349 |
| MAP1LC3B | 11160 | 34255 | 57350 |
| MAP1LC3B2 | 11161 | 34256 | 57351 |
| MAP1LC3C | 11162 | 34257 | 57352 |
| MAP1S | 11163 | 34258 | 57353 |
| MAP2 | 11164 | 34259 | 57354 |
| MAP2K1 | 11165 | 34260 | 57355 |
| MAP2K2 | 11166 | 34261 | 57356 |
| MAP2K3 | 11167 | 34262 | 57357 |
| MAP2K4 | 11168 | 34263 | 57358 |
| MAP2K5 | 11169 | 34264 | 57359 |
| MAP2K6 | 11170 | 34265 | 57360 |
| MAP2K7 | 11171 | 34266 | 57361 |
| MAP3K1 | 11172 | 34267 | 57362 |
| MAP3K10 | 11173 | 34268 | 57363 |
| MAP3K11 | 11174 | 34269 | 57364 |
| MAP3K12 | 11175 | 34270 | 57365 |
| MAP3K13 | 11176 | 34271 | 57366 |
| MAP3K14 | 11177 | 34272 | 57367 |
| MAP3K15 | 11178 | 34273 | 57368 |
| MAP3K19 | 11179 | 34274 | 57369 |
| MAP3K19 | 11180 | 34275 | 57370 |
| MAP3K2 | 11181 | 34276 | 57371 |
| MAP3K20 | 11182 | 34277 | 57372 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| MAP3K20 | 11183 | 34278 | 57373 |
| MAP3K21 | 11184 | 34279 | 57374 |
| MAP3K3 | 11185 | 34280 | 57375 |
| MAP3K4 | 11186 | 34281 | 57376 |
| MAP3K5 | 11187 | 34282 | 57377 |
| MAP3K6 | 11188 | 34283 | 57378 |
| MAP3K7 | 11189 | 34284 | 57379 |
| MAP3K7 | 11190 | 34285 | 57380 |
| MAP3K7CL | 11191 | 34286 | 57381 |
| MAP3K7CL | 11192 | 34287 | 57382 |
| MAP3K7CL | 11193 | 34288 | 57383 |
| MAP3K8 | 11194 | 34289 | 57384 |
| MAP3K9 | 11195 | 34290 | 57385 |
| MAP4 | 11196 | 34291 | 57386 |
| MAP4 | 11197 | 34292 | 57387 |
| MAP4 | 11198 | 34293 | 57388 |
| MAP4K1 | 11199 | 34294 | 57389 |
| MAP4K1 | 11200 | 34295 | 57390 |
| MAP4K2 | 11201 | 34296 | 57391 |
| MAP4K3 | 11202 | 34297 | 57392 |
| MAP4K4 | 11203 | 34298 | 57393 |
| MAP4K5 | 11204 | 34299 | 57394 |
| MAP6 | 11205 | 34300 | 57395 |
| MAP6 | 11206 | 34301 | 57396 |
| MAP6D1 | 11207 | 34302 | 57397 |
| MAP7 | 11208 | 34303 | 57398 |
| MAP7D1 | 11209 | 34304 | 57399 |
| MAP7D2 | 11210 | 34305 | 57400 |
| MAP7D3 | 11211 | 34306 | 57401 |
| MAP9 | 11212 | 34307 | 57402 |
| MAPK1 | 11213 | 34308 | 57403 |
| MAPK10 | 11214 | 34309 | 57404 |
| MAPK10 | 11215 | 34310 | 57405 |
| MAPK11 | 11216 | 34311 | 57406 |
| MAPK12 | 11217 | 34312 | 57407 |
| MAPK13 | 11218 | 34313 | 57408 |
| MAPK14 | 11219 | 34314 | 57409 |
| MAPK14 | 11220 | 34315 | 57410 |
| MAPK14 | 11221 | 34316 | 57411 |
| MAPK15 | 11222 | 34317 | 57412 |
| MAPK1IP1L | 11223 | 34318 | 57413 |
| MAPK3 | 11224 | 34319 | 57414 |
| MAPK3 | 11225 | 34320 | 57415 |
| MAPK4 | 11226 | 34321 | 57416 |
| MAPK4 | 11227 | 34322 | 57417 |
| MAPK6 | 11228 | 34323 | 57418 |
| MAPK7 | 11229 | 34324 | 57419 |
| MAPK8 | 11230 | 34325 | 57420 |
| MAPK8 | 11231 | 34326 | 57421 |
| MAPK8IP1 | 11232 | 34327 | 57422 |
| MAPK8IP2 | 11233 | 34328 | 57423 |
| MAPK8IP3 | 11234 | 34329 | 57424 |
| MAPK9 | 11235 | 34330 | 57425 |
| MAPK9 | 11236 | 34331 | 57426 |
| MAPK9 | 11237 | 34332 | 57427 |
| MAPK9 | 11238 | 34333 | 57428 |
| MAPKAP1 | 11239 | 34334 | 57429 |
| MAPKAP1 | 11240 | 34335 | 57430 |
| MAPKAPK2 | 11241 | 34336 | 57431 |
| MAPKAPK2 | 11242 | 34337 | 57432 |
| MAPKAPK3 | 11243 | 34338 | 57433 |
| MAPKAPK5 | 11244 | 34339 | 57434 |
| MAPKBP1 | 11245 | 34340 | 57435 |
| MAPRE1 | 11246 | 34341 | 57436 |
| MAPRE2 | 11247 | 34342 | 57437 |
| MAPRE3 | 11248 | 34343 | 57438 |
| MAPT | 11249 | 34344 | 57439 |
| MARC1 | 11250 | 34345 | 57440 |
| MARC2 | 11251 | 34346 | 57441 |
| MARC2 | 11252 | 34347 | 57442 |
| MARCH1 | 11253 | 34348 | 57443 |
| MARCH10 | 11254 | 34349 | 57444 |
| MARCH10 | 11255 | 34350 | 57445 |
| MARCH11 | 11256 | 34351 | 57446 |
| MARCH2 | 11257 | 34352 | 57447 |
| MARCH3 | 11258 | 34353 | 57448 |
| MARCH4 | 11259 | 34354 | 57449 |
| MARCH5 | 11260 | 34355 | 57450 |
| MARCH6 | 11261 | 34356 | 57451 |
| MARCH7 | 11262 | 34357 | 57452 |
| MARCH8 | 11263 | 34358 | 57453 |
| MARCH9 | 11264 | 34359 | 57454 |
| MARCKS | 11265 | 34360 | 57455 |
| MARCKSL1 | 11266 | 34361 | 57456 |
| MARCO | 11267 | 34362 | 57457 |
| MARF1 | 11268 | 34363 | 57458 |
| MARK1 | 11269 | 34364 | 57459 |
| MARK1 | 11270 | 34365 | 57460 |
| MARK2 | 11271 | 34366 | 57461 |
| MARK3 | 11272 | 34367 | 57462 |
| MARK4 | 11273 | 34368 | 57463 |
| MARK4 | 11274 | 34369 | 57464 |
| MARS | 11275 | 34370 | 57465 |
| MARS2 | 11276 | 34371 | 57466 |
| MARVELD1 | 11277 | 34372 | 57467 |
| MARVELD2 | 11278 | 34373 | 57468 |
| MARVELD3 | 11279 | 34374 | 57469 |
| MARVELD3 | 11280 | 34375 | 57470 |
| MAS1 | 11281 | 34376 | 57471 |
| MAS1L | 11282 | 34377 | 57472 |
| MASP1 | 11283 | 34378 | 57473 |
| MASP1 | 11284 | 34379 | 57474 |
| MASP1 | 11285 | 34380 | 57475 |
| MASP2 | 11286 | 34381 | 57476 |
| MASP2 | 11287 | 34382 | 57477 |
| MAST1 | 11288 | 34383 | 57478 |
| MAST2 | 11289 | 34384 | 57479 |
| MAST3 | 11290 | 34385 | 57480 |
| MAST4 | 11291 | 34386 | 57481 |
| MAST4 | 11292 | 34387 | 57482 |
| MASTL | 11293 | 34388 | 57483 |
| MAT1A | 11294 | 34389 | 57484 |
| MAT2A | 11295 | 34390 | 57485 |
| MAT2B | 11296 | 34391 | 57486 |
| MATK | 11297 | 34392 | 57487 |
| MATN1 | 11298 | 34393 | 57488 |
| MATN2 | 11299 | 34394 | 57489 |
| MATN3 | 11300 | 34395 | 57490 |
| MATN4 | 11301 | 34396 | 57491 |
| MATR3 | 11302 | 34397 | 57492 |
| MAU2 | 11303 | 34398 | 57493 |
| MAVS | 11304 | 34399 | 57494 |
| MAX | 11305 | 34400 | 57495 |
| MAX | 11306 | 34401 | 57496 |
| MAX | 11307 | 34402 | 57497 |
| MAX | 11308 | 34403 | 57498 |
| MAZ | 11309 | 34404 | 57499 |
| MAZ | 11310 | 34405 | 57500 |
| MB | 11311 | 34406 | 57501 |
| MB21D1 | 11312 | 34407 | 57502 |
| MB21D2 | 11313 | 34408 | 57503 |
| MBD1 | 11314 | 34409 | 57504 |
| MBD1 | 11315 | 34410 | 57505 |
| MBD1 | 11316 | 34411 | 57506 |
| MBD1 | 11317 | 34412 | 57507 |
| MBD1 | 11318 | 34413 | 57508 |
| MBD2 | 11319 | 34414 | 57509 |
| MBD2 | 11320 | 34415 | 57510 |
| MBD3 | 11321 | 34416 | 57511 |
| MBD3L1 | 11322 | 34417 | 57512 |
| MBD3L2 | 11323 | 34418 | 57513 |
| MBD3L4 | 11324 | 34419 | 57514 |
| MBD3L5 | 11325 | 34420 | 57515 |
| MBD4 | 11326 | 34421 | 57516 |
| MBD4 | 11327 | 34422 | 57517 |
| MBD4 | 11328 | 34423 | 57518 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| MBD5 | 11329 | 34424 | 57519 |
| MBD6 | 11330 | 34425 | 57520 |
| MBIP | 11331 | 34426 | 57521 |
| MBIP | 11332 | 34427 | 57522 |
| MBL2 | 11333 | 34428 | 57523 |
| MBLAC1 | 11334 | 34429 | 57524 |
| MBLAC2 | 11335 | 34430 | 57525 |
| MBNL1 | 11336 | 34431 | 57526 |
| MBNL1 | 11337 | 34432 | 57527 |
| MBNL2 | 11338 | 34433 | 57528 |
| MBNL2 | 11339 | 34434 | 57529 |
| MBNL3 | 11340 | 34435 | 57530 |
| MBOAT1 | 11341 | 34436 | 57531 |
| MBOAT2 | 11342 | 34437 | 57532 |
| MBOAT4 | 11343 | 34438 | 57533 |
| MBOAT7 | 11344 | 34439 | 57534 |
| MBOAT7 | 11345 | 34440 | 57535 |
| MBP | 11346 | 34441 | 57536 |
| MBP | 11347 | 34442 | 57537 |
| MBTD1 | 11348 | 34443 | 57538 |
| MBTPS1 | 11349 | 34444 | 57539 |
| MBTPS2 | 11350 | 34445 | 57540 |
| MC1R | 11351 | 34446 | 57541 |
| MC2R | 11352 | 34447 | 57542 |
| MC3R | 11353 | 34448 | 57543 |
| MC4R | 11354 | 34449 | 57544 |
| MC5R | 11355 | 34450 | 57545 |
| MCAM | 11356 | 34451 | 57546 |
| MCAT | 11357 | 34452 | 57547 |
| MCAT | 11358 | 34453 | 57548 |
| MCC | 11359 | 34454 | 57549 |
| MCCC1 | 11360 | 34455 | 57550 |
| MCCC2 | 11361 | 34456 | 57551 |
| MCCD1 | 11362 | 34457 | 57552 |
| MCEE | 11363 | 34458 | 57553 |
| MCEMP1 | 11364 | 34459 | 57554 |
| MCF2 | 11365 | 34460 | 57555 |
| MCF2L | 11366 | 34461 | 57556 |
| MCF2L | 11367 | 34462 | 57557 |
| MCF2L2 | 11368 | 34463 | 57558 |
| MCFD2 | 11369 | 34464 | 57559 |
| MCFD2 | 11370 | 34465 | 57560 |
| MCHR1 | 11371 | 34466 | 57561 |
| MCHR2 | 11372 | 34467 | 57562 |
| MCIDAS | 11373 | 34468 | 57563 |
| MCL1 | 11374 | 34469 | 57564 |
| MCM10 | 11375 | 34470 | 57565 |
| MCM2 | 11376 | 34471 | 57566 |
| MCM3 | 11377 | 34472 | 57567 |
| MCM3AP | 11378 | 34473 | 57568 |
| MCM4 | 11379 | 34474 | 57569 |
| MCM5 | 11380 | 34475 | 57570 |
| MCM6 | 11381 | 34476 | 57571 |
| MCM7 | 11382 | 34477 | 57572 |
| MCM8 | 11383 | 34478 | 57573 |
| MCM9 | 11384 | 34479 | 57574 |
| MCM9 | 11385 | 34480 | 57575 |
| MCMBP | 11386 | 34481 | 57576 |
| MCMDC2 | 11387 | 34482 | 57577 |
| MCMDC2 | 11388 | 34483 | 57578 |
| MCMDC2 | 11389 | 34484 | 57579 |
| MCOLN1 | 11390 | 34485 | 57580 |
| MCOLN2 | 11391 | 34486 | 57581 |
| MCOLN3 | 11392 | 34487 | 57582 |
| MCPH1 | 11393 | 34488 | 57583 |
| MCPH1 | 11394 | 34489 | 57584 |
| MCPH1 | 11395 | 34490 | 57585 |
| MCRIP1 | 11396 | 34491 | 57586 |
| MCRIP2 | 11397 | 34492 | 57587 |
| MCRS1 | 11398 | 34493 | 57588 |
| MCTP1 | 11399 | 34494 | 57589 |
| MCTP2 | 11400 | 34495 | 57590 |
| MCTP2 | 11401 | 34496 | 57591 |
| MCTS1 | 11402 | 34497 | 57592 |
| MCU | 11403 | 34498 | 57593 |
| MCUB | 11404 | 34499 | 57594 |
| MCUR1 | 11405 | 34500 | 57595 |
| MDC1 | 11406 | 34501 | 57596 |
| MDFI | 11407 | 34502 | 57597 |
| MDFIC | 11408 | 34503 | 57598 |
| MDFIC | 11409 | 34504 | 57599 |
| MDGA1 | 11410 | 34505 | 57600 |
| MDGA2 | 11411 | 34506 | 57601 |
| MDH1 | 11412 | 34507 | 57602 |
| MDH1B | 11413 | 34508 | 57603 |
| MDH2 | 11414 | 34509 | 57604 |
| MDK | 11415 | 34510 | 57605 |
| MDM1 | 11416 | 34511 | 57606 |
| MDM1 | 11417 | 34512 | 57607 |
| MDM1 | 11418 | 34513 | 57608 |
| MDM2 | 11419 | 34514 | 57609 |
| MDM4 | 11420 | 34515 | 57610 |
| MDM4 | 11421 | 34516 | 57611 |
| MDM4 | 11422 | 34517 | 57612 |
| MDN1 | 11423 | 34518 | 57613 |
| MDP1 | 11424 | 34519 | 57614 |
| MDP1 | 11425 | 34520 | 57615 |
| MDP1 | 11426 | 34521 | 57616 |
| MDS2 | 11427 | 34522 | 57617 |
| ME1 | 11428 | 34523 | 57618 |
| ME2 | 11429 | 34524 | 57619 |
| ME2 | 11430 | 34525 | 57620 |
| ME3 | 11431 | 34526 | 57621 |
| MEA1 | 11432 | 34527 | 57622 |
| MEAF6 | 11433 | 34528 | 57623 |
| MEAF6 | 11434 | 34529 | 57624 |
| MEAF6 | 11435 | 34530 | 57625 |
| MECOM | 11436 | 34531 | 57626 |
| MECP2 | 11437 | 34532 | 57627 |
| MECR | 11438 | 34533 | 57628 |
| MED1 | 11439 | 34534 | 57629 |
| MED10 | 11440 | 34535 | 57630 |
| MED11 | 11441 | 34536 | 57631 |
| MED11 | 11442 | 34537 | 57632 |
| MED12 | 11443 | 34538 | 57633 |
| MED12L | 11444 | 34539 | 57634 |
| MED13 | 11445 | 34540 | 57635 |
| MED13L | 11446 | 34541 | 57636 |
| MED14 | 11447 | 34542 | 57637 |
| MED14OS | 11448 | 34543 | 57638 |
| MED15 | 11449 | 34544 | 57639 |
| MED16 | 11450 | 34545 | 57640 |
| MED17 | 11451 | 34546 | 57641 |
| MED18 | 11452 | 34547 | 57642 |
| MED19 | 11453 | 34548 | 57643 |
| MED19 | 11454 | 34549 | 57644 |
| MED20 | 11455 | 34550 | 57645 |
| MED20 | 11456 | 34551 | 57646 |
| MED21 | 11457 | 34552 | 57647 |
| MED22 | 11458 | 34553 | 57648 |
| MED22 | 11459 | 34554 | 57649 |
| MED23 | 11460 | 34555 | 57650 |
| MED23 | 11461 | 34556 | 57651 |
| MED23 | 11462 | 34557 | 57652 |
| MED24 | 11463 | 34558 | 57653 |
| MED25 | 11464 | 34559 | 57654 |
| MED26 | 11465 | 34560 | 57655 |
| MED27 | 11466 | 34561 | 57656 |
| MED27 | 11467 | 34562 | 57657 |
| MED28 | 11468 | 34563 | 57658 |
| MED29 | 11469 | 34564 | 57659 |
| MED29 | 11470 | 34565 | 57660 |
| MED30 | 11471 | 34566 | 57661 |
| MED31 | 11472 | 34567 | 57662 |
| MED4 | 11473 | 34568 | 57663 |
| MED6 | 11474 | 34569 | 57664 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| MED6 | 11475 | 34570 | 57665 |
| MED7 | 11476 | 34571 | 57666 |
| MED8 | 11477 | 34572 | 57667 |
| MED8 | 11478 | 34573 | 57668 |
| MED9 | 11479 | 34574 | 57669 |
| MEDAG | 11480 | 34575 | 57670 |
| MEF2A | 11481 | 34576 | 57671 |
| MEF2B | 11482 | 34577 | 57672 |
| MEF2C | 11483 | 34578 | 57673 |
| MEF2D | 11484 | 34579 | 57674 |
| MEFV | 11485 | 34580 | 57675 |
| MEFV | 11486 | 34581 | 57676 |
| MEGF10 | 11487 | 34582 | 57677 |
| MEGF10 | 11488 | 34583 | 57678 |
| MEGF11 | 11489 | 34584 | 57679 |
| MEGF6 | 11490 | 34585 | 57680 |
| MEGF8 | 11491 | 34586 | 57681 |
| MEGF9 | 11492 | 34587 | 57682 |
| MEI1 | 11493 | 34588 | 57683 |
| MEI4 | 11494 | 34589 | 57684 |
| MEIG1 | 11495 | 34590 | 57685 |
| MEIKIN | 11496 | 34591 | 57686 |
| MEIOB | 11497 | 34592 | 57687 |
| MEIOC | 11498 | 34593 | 57688 |
| MEIS1 | 11499 | 34594 | 57689 |
| MEIS2 | 11500 | 34595 | 57690 |
| MEIS2 | 11501 | 34596 | 57691 |
| MEIS3 | 11502 | 34597 | 57692 |
| MELK | 11503 | 34598 | 57693 |
| MELTF | 11504 | 34599 | 57694 |
| MELTF | 11505 | 34600 | 57695 |
| MEMO1 | 11506 | 34601 | 57696 |
| MEN1 | 11507 | 34602 | 57697 |
| MEOX1 | 11508 | 34603 | 57698 |
| MEOX1 | 11509 | 34604 | 57699 |
| MEOX2 | 11510 | 34605 | 57700 |
| MEP1A | 11511 | 34606 | 57701 |
| MEP1B | 11512 | 34607 | 57702 |
| MEPCE | 11513 | 34608 | 57703 |
| MEPE | 11514 | 34609 | 57704 |
| MERTK | 11515 | 34610 | 57705 |
| MESD | 11516 | 34611 | 57706 |
| MESP1 | 11517 | 34612 | 57707 |
| MESP2 | 11518 | 34613 | 57708 |
| MEST | 11519 | 34614 | 57709 |
| MET | 11520 | 34615 | 57710 |
| MET | 11521 | 34616 | 57711 |
| METAP1 | 11522 | 34617 | 57712 |
| METAP1D | 11523 | 34618 | 57713 |
| METAP2 | 11524 | 34619 | 57714 |
| METRN | 11525 | 34620 | 57715 |
| METRNL | 11526 | 34621 | 57716 |
| METTL1 | 11527 | 34622 | 57717 |
| METTL1 | 11528 | 34623 | 57718 |
| METTL11B | 11529 | 34624 | 57719 |
| METTL12 | 11530 | 34625 | 57720 |
| METTL13 | 11531 | 34626 | 57721 |
| METTL14 | 11532 | 34627 | 57722 |
| METTL15 | 11533 | 34628 | 57723 |
| METTL15 | 11534 | 34629 | 57724 |
| METTL15 | 11535 | 34630 | 57725 |
| METTL16 | 11536 | 34631 | 57726 |
| METTL17 | 11537 | 34632 | 57727 |
| METTL17 | 11538 | 34633 | 57728 |
| METTL18 | 11539 | 34634 | 57729 |
| METTL21A | 11540 | 34635 | 57730 |
| METTL21A | 11541 | 34636 | 57731 |
| METTL21A | 11542 | 34637 | 57732 |
| METTL21C | 11543 | 34638 | 57733 |
| METTL22 | 11544 | 34639 | 57734 |
| METTL23 | 11545 | 34640 | 57735 |
| METTL24 | 11546 | 34641 | 57736 |
| METTL25 | 11547 | 34642 | 57737 |
| METTL26 | 11548 | 34643 | 57738 |
| METTL26 | 11549 | 34644 | 57739 |
| METTL27 | 11550 | 34645 | 57740 |
| METTL2A | 11551 | 34646 | 57741 |
| METTL2B | 11552 | 34647 | 57742 |
| METTL3 | 11553 | 34648 | 57743 |
| METTL4 | 11554 | 34649 | 57744 |
| METTL4 | 11555 | 34650 | 57745 |
| METTL5 | 11556 | 34651 | 57746 |
| METTL6 | 11557 | 34652 | 57747 |
| METTL6 | 11558 | 34653 | 57748 |
| METTL6 | 11559 | 34654 | 57749 |
| METTL6 | 11560 | 34655 | 57750 |
| METTL7A | 11561 | 34656 | 57751 |
| METTL7B | 11562 | 34657 | 57752 |
| METTL8 | 11563 | 34658 | 57753 |
| METTL8 | 11564 | 34659 | 57754 |
| METTL9 | 11565 | 34660 | 57755 |
| MEX3A | 11566 | 34661 | 57756 |
| MEX3B | 11567 | 34662 | 57757 |
| MEX3C | 11568 | 34663 | 57758 |
| MEX3D | 11569 | 34664 | 57759 |
| MEX3D | 11570 | 34665 | 57760 |
| MFAP1 | 11571 | 34666 | 57761 |
| MFAP2 | 11572 | 34667 | 57762 |
| MFAP3 | 11573 | 34668 | 57763 |
| MFAP3L | 11574 | 34669 | 57764 |
| MFAP4 | 11575 | 34670 | 57765 |
| MFAP5 | 11576 | 34671 | 57766 |
| MFF | 11577 | 34672 | 57767 |
| MFGE8 | 11578 | 34673 | 57768 |
| MFHAS1 | 11579 | 34674 | 57769 |
| MFN1 | 11580 | 34675 | 57770 |
| MFN2 | 11581 | 34676 | 57771 |
| MFNG | 11582 | 34677 | 57772 |
| MFSD1 | 11583 | 34678 | 57773 |
| MFSD10 | 11584 | 34679 | 57774 |
| MFSD11 | 11585 | 34680 | 57775 |
| MFSD12 | 11586 | 34681 | 57776 |
| MFSD13A | 11587 | 34682 | 57777 |
| MFSD14A | 11588 | 34683 | 57778 |
| MFSD14B | 11589 | 34684 | 57779 |
| MFSD2A | 11590 | 34685 | 57780 |
| MFSD2B | 11591 | 34686 | 57781 |
| MFSD3 | 11592 | 34687 | 57782 |
| MFSD4A | 11593 | 34688 | 57783 |
| MFSD4B | 11594 | 34689 | 57784 |
| MFSD5 | 11595 | 34690 | 57785 |
| MFSD6 | 11596 | 34691 | 57786 |
| MFSD6L | 11597 | 34692 | 57787 |
| MFSD7 | 11598 | 34693 | 57788 |
| MFSD8 | 11599 | 34694 | 57789 |
| MFSD9 | 11600 | 34695 | 57790 |
| MGA | 11601 | 34696 | 57791 |
| MGAM | 11602 | 34697 | 57792 |
| MGAM2 | 11603 | 34698 | 57793 |
| MGARP | 11604 | 34699 | 57794 |
| MGAT1 | 11605 | 34700 | 57795 |
| MGAT2 | 11606 | 34701 | 57796 |
| MGAT3 | 11607 | 34702 | 57797 |
| MGAT4A | 11608 | 34703 | 57798 |
| MGAT4A | 11609 | 34704 | 57799 |
| MGAT4B | 11610 | 34705 | 57800 |
| MGAT4C | 11611 | 34706 | 57801 |
| MGAT4D | 11612 | 34707 | 57802 |
| MGAT5 | 11613 | 34708 | 57803 |
| MGAT5B | 11614 | 34709 | 57804 |
| MGEA5 | 11615 | 34710 | 57805 |
| MGLL | 11616 | 34711 | 57806 |
| MGME1 | 11617 | 34712 | 57807 |
| MGME1 | 11618 | 34713 | 57808 |
| MGMT | 11619 | 34714 | 57809 |
| MGP | 11620 | 34715 | 57810 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| MGRN1 | 11621 | 34716 | 57811 |
| MGRN1 | 11622 | 34717 | 57812 |
| MGST1 | 11623 | 34718 | 57813 |
| MGST1 | 11624 | 34719 | 57814 |
| MGST1 | 11625 | 34720 | 57815 |
| MGST2 | 11626 | 34721 | 57816 |
| MGST2 | 11627 | 34722 | 57817 |
| MGST3 | 11628 | 34723 | 57818 |
| MIA | 11629 | 34724 | 57819 |
| MIA2 | 11630 | 34725 | 57820 |
| MIA2 | 11631 | 34726 | 57821 |
| MIA2 | 11632 | 34727 | 57822 |
| MIA3 | 11633 | 34728 | 57823 |
| MIB1 | 11634 | 34729 | 57824 |
| MIB2 | 11635 | 34730 | 57825 |
| MIB2 | 11636 | 34731 | 57826 |
| MICA | 11637 | 34732 | 57827 |
| MICA | 11638 | 34733 | 57828 |
| MICAL1 | 11639 | 34734 | 57829 |
| MICAL2 | 11640 | 34735 | 57830 |
| MICAL2 | 11641 | 34736 | 57831 |
| MICAL2 | 11642 | 34737 | 57832 |
| MICAL3 | 11643 | 34738 | 57833 |
| MICAL3 | 11644 | 34739 | 57834 |
| MICAL3 | 11645 | 34740 | 57835 |
| MICALCL | 11646 | 34741 | 57836 |
| MICALL1 | 11647 | 34742 | 57837 |
| MICALL2 | 11648 | 34743 | 57838 |
| MICB | 11649 | 34744 | 57839 |
| MICU1 | 11650 | 34745 | 57840 |
| MICU2 | 11651 | 34746 | 57841 |
| MICU3 | 11652 | 34747 | 57842 |
| MID1 | 11653 | 34748 | 57843 |
| MID1 | 11654 | 34749 | 57844 |
| MID1 | 11655 | 34750 | 57845 |
| MID1IP1 | 11656 | 34751 | 57846 |
| MID2 | 11657 | 34752 | 57847 |
| MIDN | 11658 | 34753 | 57848 |
| MIEF1 | 11659 | 34754 | 57849 |
| MIEF1 | 11660 | 34755 | 57850 |
| MIEF2 | 11661 | 34756 | 57851 |
| MIEF2 | 11662 | 34757 | 57852 |
| MIEN1 | 11663 | 34758 | 57853 |
| MIEN1 | 11664 | 34759 | 57854 |
| MIER1 | 11665 | 34760 | 57855 |
| MIER1 | 11666 | 34761 | 57856 |
| MIER1 | 11667 | 34762 | 57857 |
| MIER2 | 11668 | 34763 | 57858 |
| MIER3 | 11669 | 34764 | 57859 |
| MIF | 11670 | 34765 | 57860 |
| MIF4GD | 11671 | 34766 | 57861 |
| MIGA1 | 11672 | 34767 | 57862 |
| MIGA2 | 11673 | 34768 | 57863 |
| MIIP | 11674 | 34769 | 57864 |
| MILR1 | 11675 | 34770 | 57865 |
| MINDY1 | 11676 | 34771 | 57866 |
| MINDY2 | 11677 | 34772 | 57867 |
| MINDY3 | 11678 | 34773 | 57868 |
| MINDY4 | 11679 | 34774 | 57869 |
| MINDY4B | 11680 | 34775 | 57870 |
| MINK1 | 11681 | 34776 | 57871 |
| MINOS1 | 11682 | 34777 | 57872 |
| MINOS1 | 11683 | 34778 | 57873 |
| MINOS1 | 11684 | 34779 | 57874 |
| MINPP1 | 11685 | 34780 | 57875 |
| MINPP1 | 11686 | 34781 | 57876 |
| MIOS | 11687 | 34782 | 57877 |
| MIOX | 11688 | 34783 | 57878 |
| MIP | 11689 | 34784 | 57879 |
| MIPEP | 11690 | 34785 | 57880 |
| MIPOL1 | 11691 | 34786 | 57881 |
| MIR1-1HG | 11692 | 34787 | 57882 |
| MIS12 | 11693 | 34788 | 57883 |
| MIS18A | 11694 | 34789 | 57884 |
| MIS18BP1 | 11695 | 34790 | 57885 |
| MISP | 11696 | 34791 | 57886 |
| MISP3 | 11697 | 34792 | 57887 |
| MITD1 | 11698 | 34793 | 57888 |
| MITD1 | 11699 | 34794 | 57889 |
| MITF | 11700 | 34795 | 57890 |
| MITF | 11701 | 34796 | 57891 |
| MIXL1 | 11702 | 34797 | 57892 |
| MKI67 | 11703 | 34798 | 57893 |
| MKKS | 11704 | 34799 | 57894 |
| MKL1 | 11705 | 34800 | 57895 |
| MKL1 | 11706 | 34801 | 57896 |
| MKL2 | 11707 | 34802 | 57897 |
| MKLN1 | 11708 | 34803 | 57898 |
| MKNK1 | 11709 | 34804 | 57899 |
| MKNK1 | 11710 | 34805 | 57900 |
| MKNK2 | 11711 | 34806 | 57901 |
| MKNK2 | 11712 | 34807 | 57902 |
| MKRN1 | 11713 | 34808 | 57903 |
| MKRN1 | 11714 | 34809 | 57904 |
| MKRN2 | 11715 | 34810 | 57905 |
| MKRN2OS | 11716 | 34811 | 57906 |
| MKRN3 | 11717 | 34812 | 57907 |
| MKS1 | 11718 | 34813 | 57908 |
| MKS1 | 11719 | 34814 | 57909 |
| MKS1 | 11720 | 34815 | 57910 |
| MKX | 11721 | 34816 | 57911 |
| MLANA | 11722 | 34817 | 57912 |
| MLC1 | 11723 | 34818 | 57913 |
| MLEC | 11724 | 34819 | 57914 |
| MLF1 | 11725 | 34820 | 57915 |
| MLF2 | 11726 | 34821 | 57916 |
| MLH1 | 11727 | 34822 | 57917 |
| MLH3 | 11728 | 34823 | 57918 |
| MLIP | 11729 | 34824 | 57919 |
| MLIP | 11730 | 34825 | 57920 |
| MLKL | 11731 | 34826 | 57921 |
| MLLT1 | 11732 | 34827 | 57922 |
| MLLT10 | 11733 | 34828 | 57923 |
| MLLT10 | 11734 | 34829 | 57924 |
| MLLT10 | 11735 | 34830 | 57925 |
| MLLT11 | 11736 | 34831 | 57926 |
| MLLT3 | 11737 | 34832 | 57927 |
| MLLT6 | 11738 | 34833 | 57928 |
| MLN | 11739 | 34834 | 57929 |
| MLNR | 11740 | 34835 | 57930 |
| MLPH | 11741 | 34836 | 57931 |
| MLST8 | 11742 | 34837 | 57932 |
| MLX | 11743 | 34838 | 57933 |
| MLXIP | 11744 | 34839 | 57934 |
| MLXIPL | 11745 | 34840 | 57935 |
| MLYCD | 11746 | 34841 | 57936 |
| MMAA | 11747 | 34842 | 57937 |
| MMAB | 11748 | 34843 | 57938 |
| MMACHC | 11749 | 34844 | 57939 |
| MMADHC | 11750 | 34845 | 57940 |
| MMD | 11751 | 34846 | 57941 |
| MMD2 | 11752 | 34847 | 57942 |
| MMD2 | 11753 | 34848 | 57943 |
| MME | 11754 | 34849 | 57944 |
| MMEL1 | 11755 | 34850 | 57945 |
| MMGT1 | 11756 | 34851 | 57946 |
| MMP1 | 11757 | 34852 | 57947 |
| MMP10 | 11758 | 34853 | 57948 |
| MMP11 | 11759 | 34854 | 57949 |
| MMP12 | 11760 | 34855 | 57950 |
| MMP13 | 11761 | 34856 | 57951 |
| MMP14 | 11762 | 34857 | 57952 |
| MMP15 | 11763 | 34858 | 57953 |
| MMP16 | 11764 | 34859 | 57954 |
| MMP17 | 11765 | 34860 | 57955 |
| MMP19 | 11766 | 34861 | 57956 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| MMP19 | 11767 | 34862 | 57957 |
| MMP2 | 11768 | 34863 | 57958 |
| MMP20 | 11769 | 34864 | 57959 |
| MMP21 | 11770 | 34865 | 57960 |
| MMP23B | 11771 | 34866 | 57961 |
| MMP24 | 11772 | 34867 | 57962 |
| MMP25 | 11773 | 34868 | 57963 |
| MMP26 | 11774 | 34869 | 57964 |
| MMP27 | 11775 | 34870 | 57965 |
| MMP28 | 11776 | 34871 | 57966 |
| MMP28 | 11777 | 34872 | 57967 |
| MMP28 | 11778 | 34873 | 57968 |
| MMP3 | 11779 | 34874 | 57969 |
| MMP7 | 11780 | 34875 | 57970 |
| MMP8 | 11781 | 34876 | 57971 |
| MMP9 | 11782 | 34877 | 57972 |
| MMRN1 | 11783 | 34878 | 57973 |
| MMRN2 | 11784 | 34879 | 57974 |
| MMS19 | 11785 | 34880 | 57975 |
| MMS22L | 11786 | 34881 | 57976 |
| MN1 | 11787 | 34882 | 57977 |
| MNAT1 | 11788 | 34883 | 57978 |
| MND1 | 11789 | 34884 | 57979 |
| MND1 | 11790 | 34885 | 57980 |
| MNDA | 11791 | 34886 | 57981 |
| MNS1 | 11792 | 34887 | 57982 |
| MNT | 11793 | 34888 | 57983 |
| MNX1 | 11794 | 34889 | 57984 |
| MOAP1 | 11795 | 34890 | 57985 |
| MOB1A | 11796 | 34891 | 57986 |
| MOB1A | 11797 | 34892 | 57987 |
| MOB1B | 11798 | 34893 | 57988 |
| MOB1B | 11799 | 34894 | 57989 |
| MOB2 | 11800 | 34895 | 57990 |
| MOB2 | 11801 | 34896 | 57991 |
| MOB3A | 11802 | 34897 | 57992 |
| MOB3B | 11803 | 34898 | 57993 |
| MOB3C | 11804 | 34899 | 57994 |
| MOB4 | 11805 | 34900 | 57995 |
| MOBP | 11805 | 34901 | 57996 |
| MOBP | 11807 | 34902 | 57997 |
| MOBP | 11808 | 34903 | 57998 |
| MOCOS | 11809 | 34904 | 57999 |
| MOCS1 | 11810 | 34905 | 58000 |
| MOCS2 | 11811 | 34906 | 58001 |
| MOCS3 | 11812 | 34907 | 58002 |
| MOG | 11813 | 34908 | 58003 |
| MOG | 11814 | 34909 | 58004 |
| MOG | 11815 | 34910 | 58005 |
| MOGAT1 | 11816 | 34911 | 58006 |
| MOGAT2 | 11817 | 34912 | 58007 |
| MOGAT3 | 11818 | 34913 | 58008 |
| MOGAT3 | 11819 | 34914 | 58009 |
| MOGS | 11820 | 34915 | 58010 |
| MOK | 11821 | 34916 | 58011 |
| MON1A | 11822 | 34917 | 58012 |
| MON1B | 11823 | 34918 | 58013 |
| MON2 | 11824 | 34919 | 58014 |
| MON2 | 11825 | 34920 | 58015 |
| MORC1 | 11826 | 34921 | 58016 |
| MORC2 | 11827 | 34922 | 58017 |
| MORC3 | 11828 | 34923 | 58018 |
| MORC4 | 11829 | 34924 | 58019 |
| MORC4 | 11830 | 34925 | 58020 |
| MORF4L1 | 11831 | 34926 | 58021 |
| MORF4L2 | 11832 | 34927 | 58022 |
| MORN1 | 11833 | 34928 | 58023 |
| MORN1 | 11834 | 34929 | 58024 |
| MORN2 | 11835 | 34930 | 58025 |
| MORN3 | 11836 | 34931 | 58026 |
| MORN4 | 11837 | 34932 | 58027 |
| MORN5 | 11838 | 34933 | 58028 |
| MORN5 | 11839 | 34934 | 58029 |
| MOS | 11840 | 34935 | 58030 |
| MOSPD1 | 11841 | 34936 | 58031 |
| MOSPD2 | 11842 | 34937 | 58032 |
| MOSPD2 | 11843 | 34938 | 58033 |
| MOSPD3 | 11844 | 34939 | 58034 |
| MOV10 | 11845 | 34940 | 58035 |
| MOV10L1 | 11846 | 34941 | 58036 |
| MOV10L1 | 11847 | 34942 | 58037 |
| MOXD1 | 11848 | 34943 | 58038 |
| MPC1 | 11849 | 34944 | 58039 |
| MPC1L | 11850 | 34945 | 58040 |
| MPC2 | 11851 | 34946 | 58041 |
| MPDU1 | 11852 | 34947 | 58042 |
| MPDU1 | 11853 | 34948 | 58043 |
| MPDZ | 11854 | 34949 | 58044 |
| MPEG1 | 11855 | 34950 | 58045 |
| MPG | 11856 | 34951 | 58046 |
| MPHOSPH10 | 11857 | 34952 | 58047 |
| MPHOSPH6 | 11858 | 34953 | 58048 |
| MPHOSPH8 | 11859 | 34954 | 58049 |
| MPHOSPH9 | 11860 | 34955 | 58050 |
| MPI | 11861 | 34956 | 58051 |
| MPI | 11862 | 34957 | 58052 |
| MPIG6B | 11863 | 34958 | 58053 |
| MPIG6B | 11864 | 34959 | 58054 |
| MPIG6B | 11865 | 34960 | 58055 |
| MPL | 11866 | 34961 | 58056 |
| MPLKIP | 11867 | 34962 | 58057 |
| MPND | 11868 | 34963 | 58058 |
| MPO | 11869 | 34964 | 58059 |
| MPP1 | 11870 | 34965 | 58060 |
| MPP2 | 11871 | 34966 | 58061 |
| MPP3 | 11872 | 34967 | 58062 |
| MPP4 | 11873 | 34968 | 58063 |
| MPP5 | 11874 | 34969 | 58064 |
| MPP6 | 11875 | 34970 | 58065 |
| MPP7 | 11876 | 34971 | 58066 |
| MPPE1 | 11877 | 34972 | 58067 |
| MPPED1 | 11878 | 34973 | 58068 |
| MPPED2 | 11879 | 34974 | 58069 |
| MPPED2 | 11880 | 34975 | 58070 |
| MPRIP | 11881 | 34976 | 58071 |
| MPRIP | 11882 | 34977 | 58072 |
| MPST | 11883 | 34978 | 58073 |
| MPV17 | 11884 | 34979 | 58074 |
| MPV17L | 11885 | 34980 | 58075 |
| MPV17L | 11886 | 34981 | 58076 |
| MPV17L2 | 11887 | 34982 | 58077 |
| MPZ | 11888 | 34983 | 58078 |
| MPZL1 | 11889 | 34984 | 58079 |
| MPZL1 | 11890 | 34985 | 58080 |
| MPZL1 | 11891 | 34986 | 58081 |
| MPZL2 | 11892 | 34987 | 58082 |
| MPZL3 | 11893 | 34988 | 58083 |
| MR1 | 11894 | 34989 | 58084 |
| MRAP | 11895 | 34990 | 58085 |
| MRAP | 11896 | 34991 | 58086 |
| MRAP2 | 11897 | 34992 | 58087 |
| MRAS | 11898 | 34993 | 58088 |
| MRC1 | 11899 | 34994 | 58089 |
| MRC2 | 11900 | 34995 | 58090 |
| MRE11 | 11901 | 34996 | 58091 |
| MREG | 11902 | 34997 | 58092 |
| MRFAP1 | 11903 | 34998 | 58093 |
| MRFAP1 | 11904 | 34999 | 58094 |
| MRFAP1L1 | 11905 | 35000 | 58095 |
| MRGBP | 11906 | 35001 | 58096 |
| MRGPRD | 11907 | 35002 | 58097 |
| MRGPRE | 11908 | 35003 | 58098 |
| MRGPRF | 11909 | 35004 | 58099 |
| MRGPRG | 11910 | 35005 | 58100 |
| MRGPRX2 | 11911 | 35006 | 58101 |
| MRGPRX3 | 11912 | 35007 | 58102 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| MRGPRX4 | 11913 | 35008 | 58103 |
| MRI1 | 11914 | 35009 | 58104 |
| MRLN | 11915 | 35010 | 58105 |
| MRLN | 11916 | 35011 | 58106 |
| MRM1 | 11917 | 35012 | 58107 |
| MRM2 | 11918 | 35013 | 58108 |
| MRM3 | 11919 | 35014 | 58109 |
| MRNIP | 11920 | 35015 | 58110 |
| MRO | 11921 | 35016 | 58111 |
| MROH1 | 11922 | 35017 | 58112 |
| MROH1 | 11923 | 35018 | 58113 |
| MROH2A | 11924 | 35019 | 58114 |
| MROH2B | 11925 | 35020 | 58115 |
| MROH5 | 11926 | 35021 | 58116 |
| MROH6 | 11927 | 35022 | 58117 |
| MROH7 | 11928 | 35023 | 58118 |
| MROH8 | 11929 | 35024 | 58119 |
| MROH8 | 11930 | 35025 | 58120 |
| MROH9 | 11931 | 35026 | 58121 |
| MROH9 | 11932 | 35027 | 58122 |
| MRPL1 | 11933 | 35028 | 58123 |
| MRPL10 | 11934 | 35029 | 58124 |
| MRPL11 | 11935 | 35030 | 58125 |
| MRPL11 | 11936 | 35031 | 58126 |
| MRPL12 | 11937 | 35032 | 58127 |
| MRPL13 | 11938 | 35033 | 58128 |
| MRPL14 | 11939 | 35034 | 58129 |
| MRPL15 | 11940 | 35035 | 58130 |
| MRPL16 | 11941 | 35036 | 58131 |
| MRPL17 | 11942 | 35037 | 58132 |
| MRPL18 | 11943 | 35038 | 58133 |
| MRPL19 | 11944 | 35039 | 58134 |
| MRPL2 | 11945 | 35040 | 58135 |
| MRPL2 | 11946 | 35041 | 58136 |
| MRPL20 | 11947 | 35042 | 58137 |
| MRPL20 | 11948 | 35043 | 58138 |
| MRPL21 | 11949 | 35044 | 58139 |
| MRPL22 | 11950 | 35045 | 58140 |
| MRPL23 | 11951 | 35046 | 58141 |
| MRPL24 | 11952 | 35047 | 58142 |
| MRPL27 | 11953 | 35048 | 58143 |
| MRPL28 | 11954 | 35049 | 58144 |
| MRPL3 | 11955 | 35050 | 58145 |
| MRPL30 | 11956 | 35051 | 58146 |
| MRPL32 | 11957 | 35052 | 58147 |
| MRPL33 | 11958 | 35053 | 58148 |
| MRPL33 | 11959 | 35054 | 58149 |
| MRPL34 | 11960 | 35055 | 58150 |
| MRPL35 | 11961 | 35056 | 58151 |
| MRPL35 | 11962 | 35057 | 58152 |
| MRPL36 | 11963 | 35058 | 58153 |
| MRPL37 | 11964 | 35059 | 58154 |
| MRPL37 | 11965 | 35060 | 58155 |
| MRPL38 | 11966 | 35061 | 58156 |
| MRPL39 | 11967 | 35062 | 58157 |
| MRPL39 | 11968 | 35063 | 58158 |
| MRPL4 | 11969 | 35064 | 58159 |
| MRPL4 | 11970 | 35065 | 58160 |
| MRPL40 | 11971 | 35066 | 58161 |
| MRPL41 | 11972 | 35067 | 58162 |
| MRPL42 | 11973 | 35068 | 58163 |
| MRPL43 | 11974 | 35069 | 58164 |
| MRPL43 | 11975 | 35070 | 58165 |
| MRPL43 | 11976 | 35071 | 58166 |
| MRPL43 | 11977 | 35072 | 58167 |
| MRPL43 | 11978 | 35073 | 58168 |
| MRPL44 | 11979 | 35074 | 58169 |
| MRPL45 | 11980 | 35075 | 58170 |
| MRPL46 | 11981 | 35076 | 58171 |
| MRPL47 | 11982 | 35077 | 58172 |
| MRPL48 | 11983 | 35078 | 58173 |
| MRPL49 | 11984 | 35079 | 58174 |
| MRPL50 | 11985 | 35080 | 58175 |
| MRPL51 | 11986 | 35081 | 58176 |
| MRPL52 | 11987 | 35082 | 58177 |
| MRPL52 | 11988 | 35083 | 58178 |
| MRPL53 | 11989 | 35084 | 58179 |
| MRPL54 | 11990 | 35085 | 58180 |
| MRPL55 | 11991 | 35086 | 58181 |
| MRPL57 | 11992 | 35087 | 58182 |
| MRPL58 | 11993 | 35088 | 58183 |
| MRPL58 | 11994 | 35089 | 58184 |
| MRPL9 | 11995 | 35090 | 58185 |
| MRPS10 | 11996 | 35091 | 58186 |
| MRPS11 | 11997 | 35092 | 58187 |
| MRPS11 | 11998 | 35093 | 58188 |
| MRPS11 | 11999 | 35094 | 58189 |
| MRPS12 | 12000 | 35095 | 58190 |
| MRPS14 | 12001 | 35096 | 58191 |
| MRPS15 | 12002 | 35097 | 58192 |
| MRPS16 | 12003 | 35098 | 58193 |
| MRPS17 | 12004 | 35099 | 58194 |
| MRPS18A | 12005 | 35100 | 58195 |
| MRPS18A | 12006 | 35101 | 58196 |
| MRPS18B | 12007 | 35102 | 58197 |
| MRPS18C | 12008 | 35103 | 58198 |
| MRPS18C | 12009 | 35104 | 58199 |
| MRPS18C | 12010 | 35105 | 58200 |
| MRPS2 | 12011 | 35106 | 58201 |
| MRPS21 | 12012 | 35107 | 58202 |
| MRPS22 | 12013 | 35108 | 58203 |
| MRPS23 | 12014 | 35109 | 58204 |
| MRPS25 | 12015 | 35110 | 58205 |
| MRPS26 | 12016 | 35111 | 58206 |
| MRPS27 | 12017 | 35112 | 58207 |
| MRPS28 | 12018 | 35113 | 58208 |
| MRPS30 | 12019 | 35114 | 58209 |
| MRPS31 | 12020 | 35115 | 58210 |
| MRPS33 | 12021 | 35116 | 58211 |
| MRPS34 | 12022 | 35117 | 58212 |
| MRPS35 | 12023 | 35118 | 58213 |
| MRPS35 | 12024 | 35119 | 58214 |
| MRPS36 | 12025 | 35120 | 58215 |
| MRPS5 | 12026 | 35121 | 58216 |
| MRPS6 | 12027 | 35122 | 58217 |
| MRPS7 | 12028 | 35123 | 58218 |
| MRPS9 | 12029 | 35124 | 58219 |
| MRRF | 12030 | 35125 | 58220 |
| MRRF | 12031 | 35126 | 58221 |
| MRRF | 12032 | 35127 | 58222 |
| MRS2 | 12033 | 35128 | 58223 |
| MRS2 | 12034 | 35129 | 58224 |
| MRTO4 | 12035 | 35130 | 58225 |
| MRVI1 | 12036 | 35131 | 58226 |
| MS4A1 | 12037 | 35132 | 58227 |
| MS4A10 | 12038 | 35133 | 58228 |
| MS4A12 | 12039 | 35134 | 58229 |
| MS4A13 | 12040 | 35135 | 58230 |
| MS4A14 | 12041 | 35136 | 58231 |
| MS4A15 | 12042 | 35137 | 58232 |
| MS4A15 | 12043 | 35138 | 58233 |
| MS4A18 | 12044 | 35139 | 58234 |
| MS4A2 | 12045 | 35140 | 58235 |
| MS4A3 | 12046 | 35141 | 58236 |
| MS4A4A | 12047 | 35142 | 58237 |
| MS4A4E | 12048 | 35143 | 58238 |
| MS4A5 | 12049 | 35144 | 58239 |
| MS4A6A | 12050 | 35145 | 58240 |
| MS4A6A | 12051 | 35146 | 58241 |
| MS4A6A | 12052 | 35147 | 58242 |
| MS4A6E | 12053 | 35148 | 58243 |
| MS4A7 | 12054 | 35149 | 58244 |
| MS4A8 | 12055 | 35150 | 58245 |
| MSANTD1 | 12056 | 35151 | 58246 |
| MSANTD2 | 12057 | 35152 | 58247 |
| MSANTD3 | 12058 | 35153 | 58248 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| MSANTD3 | 12059 | 35154 | 58249 |
| MSANTD4 | 12060 | 35155 | 58250 |
| MSC | 12061 | 35156 | 58251 |
| MSGN1 | 12062 | 35157 | 58252 |
| MSH2 | 12063 | 35158 | 58253 |
| MSH3 | 12064 | 35159 | 58254 |
| MSH4 | 12065 | 35160 | 58255 |
| MSH5 | 12066 | 35161 | 58256 |
| MSH6 | 12067 | 35162 | 58257 |
| MSI1 | 12068 | 35163 | 58258 |
| MSI2 | 12069 | 35164 | 58259 |
| MSI2 | 12070 | 35165 | 58260 |
| MSL1 | 12071 | 35166 | 58261 |
| MSL2 | 12072 | 35167 | 58262 |
| MSL3 | 12073 | 35168 | 58263 |
| MSL3 | 12074 | 35169 | 58264 |
| MSLN | 12075 | 35170 | 58265 |
| MSMB | 12076 | 35171 | 58266 |
| MSMO1 | 12077 | 35172 | 58267 |
| MSMP | 12078 | 35173 | 58268 |
| MSN | 12079 | 35174 | 58269 |
| MSR1 | 12080 | 35175 | 58270 |
| MSR1 | 12081 | 35176 | 58271 |
| MSRA | 12082 | 35177 | 58272 |
| MSRB1 | 12083 | 35178 | 58273 |
| MSRB2 | 12084 | 35179 | 58274 |
| MSRB3 | 12085 | 35180 | 58275 |
| MSS51 | 12086 | 35181 | 58276 |
| MST1L | 12087 | 35182 | 58277 |
| MST1R | 12088 | 35183 | 58278 |
| MSTN | 12089 | 35184 | 58279 |
| MSTO1 | 12090 | 35185 | 58280 |
| MSTO1 | 12091 | 35186 | 58281 |
| MSX1 | 12092 | 35187 | 58282 |
| MSX2 | 12093 | 35188 | 58283 |
| MT1A | 12094 | 35189 | 58284 |
| MT1B | 12095 | 35190 | 58285 |
| MT1E | 12096 | 35191 | 58286 |
| MT1F | 12097 | 35192 | 58287 |
| MT1F | 12098 | 35193 | 58288 |
| MT1G | 12099 | 35194 | 58289 |
| MT1HL1 | 12100 | 35195 | 58290 |
| MT1M | 12101 | 35196 | 58291 |
| MT1X | 12102 | 35197 | 58292 |
| MT2A | 12103 | 35198 | 58293 |
| MT3 | 12104 | 35199 | 58294 |
| MT4 | 12105 | 35200 | 58295 |
| MTA1 | 12106 | 35201 | 58296 |
| MTA1 | 12107 | 35202 | 58297 |
| MTA2 | 12108 | 35203 | 58298 |
| MTA3 | 12109 | 35204 | 58299 |
| MTA3 | 12110 | 35205 | 58300 |
| MTAP | 12111 | 35206 | 58301 |
| MTBP | 12112 | 35207 | 58302 |
| MTCH1 | 12113 | 35208 | 58303 |
| MTCH2 | 12114 | 35209 | 58304 |
| MTCL1 | 12115 | 35210 | 58305 |
| MTCP1 | 12116 | 35211 | 58306 |
| MTDH | 12117 | 35212 | 58307 |
| MTERF1 | 12118 | 35213 | 58308 |
| MTERF2 | 12119 | 35214 | 58309 |
| MTERF3 | 12120 | 35215 | 58310 |
| MTERF3 | 12121 | 35216 | 58311 |
| MTERF4 | 12122 | 35217 | 58312 |
| MTERF4 | 12123 | 35218 | 58313 |
| MTF1 | 12124 | 35219 | 58314 |
| MTF2 | 12125 | 35220 | 58315 |
| MTFMT | 12126 | 35221 | 58316 |
| MTFP1 | 12127 | 35222 | 58317 |
| MTFP1 | 12128 | 35223 | 58318 |
| MTFR1 | 12129 | 35224 | 58319 |
| MTFR1 | 12130 | 35225 | 58320 |
| MTFR1L | 12131 | 35226 | 58321 |
| MTFR1L | 12132 | 35227 | 58322 |
| MTFR2 | 12133 | 35228 | 58323 |
| MTG1 | 12134 | 35229 | 58324 |
| MTG2 | 12135 | 35230 | 58325 |
| MTHFD1 | 12136 | 35231 | 58326 |
| MTHFD1L | 12137 | 35232 | 58327 |
| MTHFD1L | 12138 | 35233 | 58328 |
| MTHFD2 | 12139 | 35234 | 58329 |
| MTHFD2L | 12140 | 35235 | 58330 |
| MTHFD2L | 12141 | 35236 | 58331 |
| MTHFD2L | 12142 | 35237 | 58332 |
| MTHFD2L | 12143 | 35238 | 58333 |
| MTHFR | 12144 | 35239 | 58334 |
| MTHFSD | 12145 | 35240 | 58335 |
| MTIF2 | 12146 | 35241 | 58336 |
| MTIF3 | 12147 | 35242 | 58337 |
| MTM1 | 12148 | 35243 | 58338 |
| MTMR1 | 12149 | 35244 | 58339 |
| MTMR1 | 12150 | 35245 | 58340 |
| MTMR10 | 12151 | 35246 | 58341 |
| MTMR11 | 12152 | 35247 | 58342 |
| MTMR11 | 12153 | 35248 | 58343 |
| MTMR12 | 12154 | 35249 | 58344 |
| MTMR14 | 12155 | 35250 | 58345 |
| MTMR2 | 12156 | 35251 | 58346 |
| MTMR3 | 12157 | 35252 | 58347 |
| MTMR4 | 12158 | 35253 | 58348 |
| MTMR6 | 12159 | 35254 | 58349 |
| MTMR7 | 12160 | 35255 | 58350 |
| MTMR8 | 12161 | 35256 | 58351 |
| MTMR9 | 12162 | 35257 | 58352 |
| MTNR1A | 12163 | 35258 | 58353 |
| MTNR1B | 12164 | 35259 | 58354 |
| MTO1 | 12165 | 35260 | 58355 |
| MTOR | 12166 | 35261 | 58356 |
| MTPAP | 12167 | 35262 | 58357 |
| MTR | 12168 | 35263 | 58358 |
| MTRF1 | 12169 | 35264 | 58359 |
| MTRF1L | 12170 | 35265 | 58360 |
| MTRF1L | 12171 | 35266 | 58361 |
| MTRF1L | 12172 | 35267 | 58362 |
| MTRNR2L1 | 12173 | 35268 | 58363 |
| MTRNR2L10 | 12174 | 35269 | 58364 |
| MTRNR2L2 | 12175 | 35270 | 58365 |
| MTRNR2L3 | 12176 | 35271 | 58366 |
| MTRNR2L4 | 12177 | 35272 | 58367 |
| MTRNR2L5 | 12178 | 35273 | 58368 |
| MTRNR2L6 | 12179 | 35274 | 58369 |
| MTRNR2L7 | 12180 | 35275 | 58370 |
| MTRNR2L8 | 12181 | 35276 | 58371 |
| MTRNR2L9 | 12182 | 35277 | 58372 |
| MTRR | 12183 | 35278 | 58373 |
| MTSS1 | 12184 | 35279 | 58374 |
| MTSS1L | 12185 | 35280 | 58375 |
| MTTP | 12186 | 35281 | 58376 |
| MTURN | 12187 | 35282 | 58377 |
| MTUS1 | 12188 | 35283 | 58378 |
| MTUS2 | 12189 | 35284 | 58379 |
| MTX1 | 12190 | 35285 | 58380 |
| MTX2 | 12191 | 35286 | 58381 |
| MTX2 | 12192 | 35287 | 58382 |
| MTX3 | 12193 | 35288 | 58383 |
| MTX3 | 12194 | 35289 | 58384 |
| MUC1 | 12195 | 35290 | 58385 |
| MUC1 | 12196 | 35291 | 58386 |
| MUC12 | 12197 | 35292 | 58387 |
| MUC13 | 12198 | 35293 | 58388 |
| MUC15 | 12199 | 35294 | 58389 |
| MUC16 | 12200 | 35295 | 58390 |
| MUC17 | 12201 | 35296 | 58391 |
| MUC19 | 12202 | 35297 | 58392 |
| MUC2 | 12203 | 35298 | 58393 |
| MUC20 | 12204 | 35299 | 58394 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| MUC21 | 12205 | 35300 | 58395 |
| MUC22 | 12206 | 35301 | 58396 |
| MUC3A | 12207 | 35302 | 58397 |
| MUC4 | 12208 | 35303 | 58398 |
| MUC5AC | 12209 | 35304 | 58399 |
| MUC5B | 12210 | 35305 | 58400 |
| MUC6 | 12211 | 35306 | 58401 |
| MUC7 | 12212 | 35307 | 58402 |
| MUCL1 | 12213 | 35308 | 58403 |
| MUL1 | 12214 | 35309 | 58404 |
| MUM1 | 12215 | 35310 | 58405 |
| MUM1L1 | 12216 | 35311 | 58406 |
| MUS81 | 12217 | 35312 | 58407 |
| MUSK | 12218 | 35313 | 58408 |
| MUSTN1 | 12219 | 35314 | 58409 |
| MUT | 12220 | 35315 | 58410 |
| MUTYH | 12221 | 35316 | 58411 |
| MVB12A | 12222 | 35317 | 58412 |
| MVB12B | 12223 | 35318 | 58413 |
| MVB12B | 12224 | 35319 | 58414 |
| MVD | 12225 | 35320 | 58415 |
| MVK | 12226 | 35321 | 58416 |
| MVP | 12227 | 35322 | 58417 |
| MX1 | 12228 | 35323 | 58418 |
| MX1 | 12229 | 35324 | 58419 |
| MX2 | 12230 | 35325 | 58420 |
| MXD1 | 12231 | 35326 | 58421 |
| MXD3 | 12232 | 35327 | 58422 |
| MXD3 | 12233 | 35328 | 58423 |
| MXD4 | 12234 | 35329 | 58424 |
| MXI1 | 12235 | 35330 | 58425 |
| MXRA5 | 12236 | 35331 | 58426 |
| MXRA7 | 12237 | 35332 | 58427 |
| MXRA7 | 12238 | 35333 | 58428 |
| MXRA7 | 12239 | 35334 | 58429 |
| MXRA8 | 12240 | 35335 | 58430 |
| MXRA8 | 12241 | 35336 | 58431 |
| MYADM | 12242 | 35337 | 58432 |
| MYADML2 | 12243 | 35338 | 58433 |
| MYB | 12244 | 35339 | 58434 |
| MYBBP1A | 12245 | 35340 | 58435 |
| MYBBP1A | 12246 | 35341 | 58436 |
| MYBL1 | 12247 | 35342 | 58437 |
| MYBL2 | 12248 | 35343 | 58438 |
| MYBPC1 | 12249 | 35344 | 58439 |
| MYBPC1 | 12250 | 35345 | 58440 |
| MYBPC1 | 12251 | 35346 | 58441 |
| MYBPC1 | 12252 | 35347 | 58442 |
| MYBPC2 | 12253 | 35348 | 58443 |
| MYBPC3 | 12254 | 35349 | 58444 |
| MYBPH | 12255 | 35350 | 58445 |
| MYBPHL | 12256 | 35351 | 58446 |
| MYC | 12257 | 35352 | 58447 |
| MYCBP | 12258 | 35353 | 58448 |
| MYCBP2 | 12259 | 35354 | 58449 |
| MYCBPAP | 12260 | 35355 | 58450 |
| MYCL | 12261 | 35356 | 58451 |
| MYCL | 12262 | 35357 | 58452 |
| MYCN | 12263 | 35358 | 58453 |
| MYCNOS | 12264 | 35359 | 58454 |
| MYCT1 | 12265 | 35360 | 58455 |
| MYD88 | 12266 | 35361 | 58456 |
| MYD88 | 12267 | 35362 | 58457 |
| MYDGF | 12268 | 35363 | 58458 |
| MYEF2 | 12269 | 35364 | 58459 |
| MYEOV | 12270 | 35365 | 58460 |
| MYF5 | 12271 | 35366 | 58461 |
| MYF6 | 12272 | 35367 | 58462 |
| MYH1 | 12273 | 35368 | 58463 |
| MYH10 | 12274 | 35369 | 58464 |
| MYH11 | 12275 | 35370 | 58465 |
| MYH11 | 12276 | 35371 | 58466 |
| MYH13 | 12277 | 35372 | 58467 |
| MYH14 | 12278 | 35373 | 58468 |
| MYH15 | 12279 | 35374 | 58469 |
| MYH2 | 12280 | 35375 | 58470 |
| MYH3 | 12281 | 35376 | 58471 |
| MYH4 | 12282 | 35377 | 58472 |
| MYH6 | 12283 | 35378 | 58473 |
| MYH7 | 12284 | 35379 | 58474 |
| MYH7B | 12285 | 35380 | 58475 |
| MYH8 | 12286 | 35381 | 58476 |
| MYH9 | 12287 | 35382 | 58477 |
| MYL1 | 12288 | 35383 | 58478 |
| MYL10 | 12289 | 35384 | 58479 |
| MYL12A | 12290 | 35385 | 58480 |
| MYL2 | 12291 | 35386 | 58481 |
| MYL3 | 12292 | 35387 | 58482 |
| MYL4 | 12293 | 35388 | 58483 |
| MYL5 | 12294 | 35389 | 58484 |
| MYL6 | 12295 | 35390 | 58485 |
| MYL6 | 12296 | 35391 | 58486 |
| MYL6B | 12297 | 35392 | 58487 |
| MYL7 | 12298 | 35393 | 58488 |
| MYL9 | 12299 | 35394 | 58489 |
| MYL9 | 12300 | 35395 | 58490 |
| MYLIP | 12301 | 35396 | 58491 |
| MYLK | 12302 | 35397 | 58492 |
| MYLK2 | 12303 | 35398 | 58493 |
| MYLK3 | 12304 | 35399 | 58494 |
| MYLK4 | 12305 | 35400 | 58495 |
| MYLPF | 12306 | 35401 | 58496 |
| MYMK | 12307 | 35402 | 58497 |
| MYMX | 12308 | 35403 | 58498 |
| MYNN | 12309 | 35404 | 58499 |
| MYO10 | 12310 | 35405 | 58500 |
| MYO15A | 12311 | 35406 | 58501 |
| MYO15B | 12312 | 35407 | 58502 |
| MYO16 | 12313 | 35408 | 58503 |
| MYO18A | 12314 | 35409 | 58504 |
| MYO18B | 12315 | 35410 | 58505 |
| MYO19 | 12316 | 35411 | 58506 |
| MYO19 | 12317 | 35412 | 58507 |
| MYO1A | 12318 | 35413 | 58508 |
| MYO1B | 12319 | 35414 | 58509 |
| MYO1C | 12320 | 35415 | 58510 |
| MYO1D | 12321 | 35416 | 58511 |
| MYO1D | 12322 | 35417 | 58512 |
| MYO1D | 12323 | 35418 | 58513 |
| MYO1E | 12324 | 35419 | 58514 |
| MYO1F | 12325 | 35420 | 58515 |
| MYO1G | 12326 | 35421 | 58516 |
| MYO1H | 12327 | 35422 | 58517 |
| MYO3A | 12328 | 35423 | 58518 |
| MYO3B | 12329 | 35424 | 58519 |
| MYO5A | 12330 | 35425 | 58520 |
| MYO5B | 12331 | 35426 | 58521 |
| MYO5C | 12332 | 35427 | 58522 |
| MYO6 | 12333 | 35428 | 58523 |
| MYO7A | 12334 | 35429 | 58524 |
| MYO7A | 12335 | 35430 | 58525 |
| MYO7B | 12336 | 35431 | 58526 |
| MYO9A | 12337 | 35432 | 58527 |
| MYO9B | 12338 | 35433 | 58528 |
| MYO9B | 12339 | 35434 | 58529 |
| MYOC | 12340 | 35435 | 58530 |
| MYOCD | 12341 | 35436 | 58531 |
| MYOD1 | 12342 | 35437 | 58532 |
| MYOF | 12343 | 35438 | 58533 |
| MYOG | 12344 | 35439 | 58534 |
| MYOM1 | 12345 | 35440 | 58535 |
| MYOM2 | 12346 | 35441 | 58536 |
| MYOM3 | 12347 | 35442 | 58537 |
| MYORG | 12348 | 35443 | 58538 |
| MYOT | 12349 | 35444 | 58539 |
| MYOZ1 | 12350 | 35445 | 58540 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| MYOZ2 | 12351 | 35446 | 58541 |
| MYOZ3 | 12352 | 35447 | 58542 |
| MYPN | 12353 | 35448 | 58543 |
| MYPOP | 12354 | 35449 | 58544 |
| MYRF | 12355 | 35450 | 58545 |
| MYRFL | 12356 | 35451 | 58546 |
| MYRIP | 12357 | 35452 | 58547 |
| MYSM1 | 12358 | 35453 | 58548 |
| MYT1 | 12359 | 35454 | 58549 |
| MYT1L | 12360 | 35455 | 58550 |
| MYT1L | 12361 | 35456 | 58551 |
| MYT1L | 12362 | 35457 | 58552 |
| MYZAP | 12363 | 35458 | 58553 |
| MZB1 | 12364 | 35459 | 58554 |
| MZF1 | 12365 | 35460 | 58555 |
| MZF1 | 12366 | 35461 | 58556 |
| MZT1 | 12367 | 35462 | 58557 |
| MZT2A | 12368 | 35463 | 58558 |
| MZT2B | 12369 | 35464 | 58559 |
| MZT2B | 12370 | 35465 | 58560 |
| N4BP1 | 12371 | 35466 | 58561 |
| N4BP2 | 12372 | 35467 | 58562 |
| N4BP2L1 | 12373 | 35468 | 58563 |
| N4BP2L1 | 12374 | 35469 | 58564 |
| N4BP2L1 | 12375 | 35470 | 58565 |
| N4BP2L1 | 12376 | 35471 | 58566 |
| N4BP2L1 | 12377 | 35472 | 58567 |
| N4BP2L2 | 12378 | 35473 | 58568 |
| N4BP2L2 | 12379 | 35474 | 58569 |
| N4BP3 | 12380 | 35475 | 58570 |
| N6AMT1 | 12381 | 35476 | 58571 |
| NAA10 | 12382 | 35477 | 58572 |
| NAA11 | 12383 | 35478 | 58573 |
| NAA15 | 12384 | 35479 | 58574 |
| NAA16 | 12385 | 35480 | 58575 |
| NAA16 | 12386 | 35481 | 58576 |
| NAA16 | 12387 | 35482 | 58577 |
| NAA20 | 12388 | 35483 | 58578 |
| NAA20 | 12389 | 35484 | 58579 |
| NAA25 | 12390 | 35485 | 58580 |
| NAA30 | 12391 | 35486 | 58581 |
| NAA35 | 12392 | 35487 | 58582 |
| NAA38 | 12393 | 35488 | 58583 |
| NAA40 | 12394 | 35489 | 58584 |
| NAA50 | 12395 | 35490 | 58585 |
| NAA60 | 12396 | 35491 | 58586 |
| NAA60 | 12397 | 35492 | 58587 |
| NAA60 | 12398 | 35493 | 58588 |
| NAAA | 12399 | 35494 | 58589 |
| NAAA | 12400 | 35495 | 58590 |
| NAALAD2 | 12401 | 35496 | 58591 |
| NAALADL1 | 12402 | 35497 | 58592 |
| NAALADL2 | 12403 | 35498 | 58593 |
| NAB1 | 12404 | 35499 | 58594 |
| NAB2 | 12405 | 35500 | 58595 |
| NABP1 | 12406 | 35501 | 58596 |
| NABP2 | 12407 | 35502 | 58597 |
| NACA | 12408 | 35503 | 58598 |
| NACA | 12409 | 35504 | 58599 |
| NACA2 | 12410 | 35505 | 58600 |
| NACAD | 12411 | 35506 | 58601 |
| NACC1 | 12412 | 35507 | 58602 |
| NACC2 | 12413 | 35508 | 58603 |
| NADK | 12414 | 35509 | 58604 |
| NADK2 | 12415 | 35510 | 58605 |
| NADSYN1 | 12416 | 35511 | 58606 |
| NAE1 | 12417 | 35512 | 58607 |
| NAF1 | 12418 | 35513 | 58608 |
| NAF1 | 12419 | 35514 | 58609 |
| NAGA | 12420 | 35515 | 58610 |
| NAGK | 12421 | 35516 | 58611 |
| NAGLU | 12422 | 35517 | 58612 |
| NAGPA | 12423 | 35518 | 58613 |
| NAGS | 12424 | 35519 | 58614 |
| NAIF1 | 12425 | 35520 | 58615 |
| NAIP | 12426 | 35521 | 58616 |
| NALCN | 12427 | 35522 | 58617 |
| NAMPT | 12428 | 35523 | 58618 |
| NANOG | 12429 | 35524 | 58619 |
| NANOGNB | 12430 | 35525 | 58620 |
| NANOS1 | 12431 | 35526 | 58621 |
| NANOS2 | 12432 | 35527 | 58622 |
| NANOS3 | 12433 | 35528 | 58623 |
| NANP | 12434 | 35529 | 58624 |
| NANS | 12435 | 35530 | 58625 |
| NAP1L1 | 12436 | 35531 | 58626 |
| NAP1L1 | 12437 | 35532 | 58627 |
| NAP1L2 | 12438 | 35533 | 58628 |
| NAP1L3 | 12439 | 35534 | 58629 |
| NAP1L4 | 12440 | 35535 | 58630 |
| NAP1L5 | 12441 | 35536 | 58631 |
| NAPA | 12442 | 35537 | 58632 |
| NAPB | 12443 | 35538 | 58633 |
| NAPEPLD | 12444 | 35539 | 58634 |
| NAPG | 12445 | 35540 | 58635 |
| NAPRT | 12446 | 35541 | 58636 |
| NAPSA | 12447 | 35542 | 58637 |
| NARF | 12448 | 35543 | 58638 |
| NARFL | 12449 | 35544 | 58639 |
| NARS | 12450 | 35545 | 58640 |
| NARS2 | 12451 | 35546 | 58641 |
| NASP | 12452 | 35547 | 58642 |
| NAT1 | 12453 | 35548 | 58643 |
| NAT10 | 12454 | 35549 | 58644 |
| NAT14 | 12455 | 35550 | 58645 |
| NAT16 | 12456 | 35551 | 58646 |
| NAT2 | 12457 | 35552 | 58647 |
| NAT6 | 12458 | 35553 | 58648 |
| NAT8 | 12459 | 35554 | 58649 |
| NAT8B | 12460 | 35555 | 58650 |
| NAT8L | 12461 | 35556 | 58651 |
| NAT9 | 12462 | 35557 | 58652 |
| NAT9 | 12463 | 35558 | 58653 |
| NATD1 | 12464 | 35559 | 58654 |
| NAV1 | 12465 | 35560 | 58655 |
| NAV2 | 12466 | 35561 | 58656 |
| NAV3 | 12467 | 35562 | 58657 |
| NAXD | 12468 | 35563 | 58658 |
| NAXE | 12469 | 35564 | 58659 |
| NBAS | 12470 | 35565 | 58660 |
| NBDY | 12471 | 35566 | 58661 |
| NBEA | 12472 | 35567 | 58662 |
| NBEAL1 | 12473 | 35568 | 58663 |
| NBEAL2 | 12474 | 35569 | 58664 |
| NBL1 | 12475 | 35570 | 58665 |
| NBN | 12476 | 35571 | 58666 |
| NBPF1 | 12477 | 35572 | 58667 |
| NBPF10 | 12478 | 35573 | 58668 |
| NBPF11 | 12479 | 35574 | 58669 |
| NBPF14 | 12480 | 35575 | 58670 |
| NBPF15 | 12481 | 35576 | 58671 |
| NBPF19 | 12482 | 35577 | 58672 |
| NBPF20 | 12483 | 35578 | 58673 |
| NBPF3 | 12484 | 35579 | 58674 |
| NBPF4 | 12485 | 35580 | 58675 |
| NBPF6 | 12486 | 35581 | 58676 |
| NBPF7 | 12487 | 35582 | 58677 |
| NBPF9 | 12488 | 35583 | 58678 |
| NBR1 | 12489 | 35584 | 58679 |
| NBR1 | 12490 | 35585 | 58680 |
| NBR1 | 12491 | 35586 | 58681 |
| NCALD | 12492 | 35587 | 58682 |
| NCAM1 | 12493 | 35588 | 58683 |
| NCAM1 | 12494 | 35589 | 58684 |
| NCAM2 | 12495 | 35590 | 58685 |
| NCAM2 | 12496 | 35591 | 58686 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| NCAM2 | 12497 | 35592 | 58687 |
| NCAM2 | 12498 | 35593 | 58688 |
| NCAM2 | 12499 | 35594 | 58689 |
| NCAN | 12500 | 35595 | 58690 |
| NCAPD2 | 12501 | 35596 | 58691 |
| NCAPD3 | 12502 | 35597 | 58692 |
| NCAPG | 12503 | 35598 | 58693 |
| NCAPG2 | 12504 | 35599 | 58694 |
| NCAPG2 | 12505 | 35600 | 58695 |
| NCAPH | 12506 | 35601 | 58696 |
| NCAPH2 | 12507 | 35602 | 58697 |
| NCAPH2 | 12508 | 35603 | 58698 |
| NCBP1 | 12509 | 35604 | 58699 |
| NCBP2 | 12510 | 35605 | 58700 |
| NCBP2L | 12511 | 35606 | 58701 |
| NCBP3 | 12512 | 35607 | 58702 |
| NCCRP1 | 12513 | 35608 | 58703 |
| NCDN | 12514 | 35609 | 58704 |
| NCEH1 | 12515 | 35610 | 58705 |
| NCF1 | 12516 | 35611 | 58706 |
| NCF2 | 12517 | 35612 | 58707 |
| NCF4 | 12518 | 35613 | 58708 |
| NCF4 | 12519 | 35614 | 58709 |
| NCK1 | 12520 | 35615 | 58710 |
| NCK2 | 12521 | 35616 | 58711 |
| NCK2 | 12522 | 35617 | 58712 |
| NCKAP1 | 12523 | 35618 | 58713 |
| NCKAP1L | 12524 | 35619 | 58714 |
| NCKAP5 | 12525 | 35620 | 58715 |
| NCKAP5L | 12526 | 35621 | 58716 |
| NCKIPSD | 12527 | 35622 | 58717 |
| NCL | 12528 | 35623 | 58718 |
| NCLN | 12529 | 35624 | 58719 |
| NCMAP | 12530 | 35625 | 58720 |
| NCOA1 | 12531 | 35626 | 58721 |
| NCOA1 | 12532 | 35627 | 58722 |
| NCOA2 | 12533 | 35628 | 58723 |
| NCOA3 | 12534 | 35629 | 58724 |
| NCOA4 | 12535 | 35630 | 58725 |
| NCOA4 | 12536 | 35631 | 58726 |
| NCOA5 | 12537 | 35632 | 58727 |
| NCOA5 | 12538 | 35633 | 58728 |
| NCOA6 | 12539 | 35634 | 58729 |
| NCOA7 | 12540 | 35635 | 58730 |
| NCOR1 | 12541 | 35636 | 58731 |
| NCOR1 | 12542 | 35637 | 58732 |
| NCOR2 | 12543 | 35638 | 58733 |
| NCR1 | 12544 | 35639 | 58734 |
| NCR2 | 12545 | 35640 | 58735 |
| NCR2 | 12546 | 35641 | 58736 |
| NCR3 | 12547 | 35642 | 58737 |
| NCR3 | 12548 | 35643 | 58738 |
| NCR3 | 12549 | 35644 | 58739 |
| NCR3LG1 | 12550 | 35645 | 58740 |
| NCS1 | 12551 | 35646 | 58741 |
| NCSTN | 12552 | 35647 | 58742 |
| NDC1 | 12553 | 35648 | 58743 |
| NDC80 | 12554 | 35649 | 58744 |
| NDE1 | 12555 | 35650 | 58745 |
| NDEL1 | 12556 | 35651 | 58746 |
| NDEL1 | 12557 | 35652 | 58747 |
| NDEL1 | 12558 | 35653 | 58748 |
| NDFIP1 | 12559 | 35654 | 58749 |
| NDFIP2 | 12560 | 35655 | 58750 |
| NDN | 12561 | 35656 | 58751 |
| NDNF | 12562 | 35657 | 58752 |
| NDOR1 | 12563 | 35658 | 58753 |
| NDOR1 | 12564 | 35659 | 58754 |
| NDP | 12565 | 35660 | 58755 |
| NDRG1 | 12566 | 35661 | 58756 |
| NDRG2 | 12567 | 35662 | 58757 |
| NDRG3 | 12568 | 35663 | 58758 |
| NDRG4 | 12569 | 35664 | 58759 |
| NDST1 | 12570 | 35665 | 58760 |
| NDST2 | 12571 | 35666 | 58761 |
| NDST2 | 12572 | 35667 | 58762 |
| NDST3 | 12573 | 35668 | 58763 |
| NDST4 | 12574 | 35669 | 58764 |
| NDUFA1 | 12575 | 35670 | 58765 |
| NDUFA10 | 12576 | 35671 | 58766 |
| NDUFA10 | 12577 | 35672 | 58767 |
| NDUFA10 | 12578 | 35673 | 58768 |
| NDUFA11 | 12579 | 35674 | 58769 |
| NDUFA11 | 12580 | 35675 | 58770 |
| NDUFA12 | 12581 | 35676 | 58771 |
| NDUFA12 | 12582 | 35677 | 58772 |
| NDUFA13 | 12583 | 35678 | 58773 |
| NDUFA2 | 12584 | 35679 | 58774 |
| NDUFA2 | 12585 | 35680 | 58775 |
| NDUFA3 | 12586 | 35681 | 58776 |
| NDUFA4 | 12587 | 35682 | 58777 |
| NDUFA4L2 | 12588 | 35683 | 58778 |
| NDUFA5 | 12589 | 35684 | 58779 |
| NDUFA6 | 12590 | 35685 | 58780 |
| NDUFA7 | 12591 | 35686 | 58781 |
| NDUFA8 | 12592 | 35687 | 58782 |
| NDUFA8 | 12593 | 35688 | 58783 |
| NDUFA9 | 12594 | 35689 | 58784 |
| NDUFAB1 | 12595 | 35690 | 58785 |
| NDUFAF1 | 12596 | 35691 | 58786 |
| NDUFAF2 | 12597 | 35692 | 58787 |
| NDUFAF3 | 12598 | 35693 | 58788 |
| NDUFAF4 | 12599 | 35694 | 58789 |
| NDUFAF5 | 12600 | 35695 | 58790 |
| NDUFAF5 | 12601 | 35696 | 58791 |
| NDUFAF6 | 12602 | 35697 | 58792 |
| NDUFAF7 | 12603 | 35698 | 58793 |
| NDUFAF8 | 12604 | 35699 | 58794 |
| NDUFAF8 | 12605 | 35700 | 58795 |
| NDUFAF8 | 12606 | 35701 | 58796 |
| NDUFB1 | 12607 | 35702 | 58797 |
| NDUFB10 | 12608 | 35703 | 58798 |
| NDUFB11 | 12609 | 35704 | 58799 |
| NDUFB2 | 12610 | 35705 | 58800 |
| NDUFB3 | 12611 | 35706 | 58801 |
| NDUFB4 | 12612 | 35707 | 58802 |
| NDUFB4 | 12613 | 35708 | 58803 |
| NDUFB5 | 12614 | 35709 | 58804 |
| NDUFB5 | 12615 | 35710 | 58805 |
| NDUFB6 | 12616 | 35711 | 58806 |
| NDUFB7 | 12617 | 35712 | 58807 |
| NDUFB8 | 12618 | 35713 | 58808 |
| NDUFB8 | 12619 | 35714 | 58809 |
| NDUFB9 | 12620 | 35715 | 58810 |
| NDUFC1 | 12621 | 35716 | 58811 |
| NDUFC1 | 12622 | 35717 | 58812 |
| NDUFC2 | 12623 | 35718 | 58813 |
| NDUFC2 | 12624 | 35719 | 58814 |
| NDUFC2-KCTD14 | 12625 | 35720 | 58815 |
| NDUFS1 | 12626 | 35721 | 58816 |
| NDUFS2 | 12627 | 35722 | 58817 |
| NDUFS2 | 12628 | 35723 | 58818 |
| NDUFS3 | 12629 | 35724 | 58819 |
| NDUFS4 | 12630 | 35725 | 58820 |
| NDUFS4 | 12631 | 35726 | 58821 |
| NDUFS5 | 12632 | 35727 | 58822 |
| NDUFS6 | 12633 | 35728 | 58823 |
| NDUFS7 | 12634 | 35729 | 58824 |
| NDUFS8 | 12635 | 35730 | 58825 |
| NDUFV1 | 12636 | 35731 | 58826 |
| NDUFV2 | 12637 | 35732 | 58827 |
| NDUFV3 | 12638 | 35733 | 58828 |
| NEB | 12639 | 35734 | 58829 |
| NEBL | 12640 | 35735 | 58830 |
| NEBL | 12641 | 35736 | 58831 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| NECAB1 | 12642 | 35737 | 58832 |
| NECAB2 | 12643 | 35738 | 58833 |
| NECAB3 | 12644 | 35739 | 58834 |
| NECAP1 | 12645 | 35740 | 58835 |
| NECAP2 | 12646 | 35741 | 58836 |
| NECAP2 | 12647 | 35742 | 58837 |
| NECTIN1 | 12648 | 35743 | 58838 |
| NECTIN1 | 12649 | 35744 | 58839 |
| NECTIN1 | 12650 | 35745 | 58840 |
| NECTIN2 | 12651 | 35746 | 58841 |
| NECTIN2 | 12652 | 35747 | 58842 |
| NECTIN3 | 12653 | 35748 | 58843 |
| NECTIN3 | 12654 | 35749 | 58844 |
| NECTIN3 | 12655 | 35750 | 58845 |
| NECTIN4 | 12656 | 35751 | 58846 |
| NEDD1 | 12657 | 35752 | 58847 |
| NEDD4 | 12658 | 35753 | 58848 |
| NEDD4L | 12659 | 35754 | 58849 |
| NEDD8 | 12660 | 35755 | 58850 |
| NEDD9 | 12661 | 35756 | 58851 |
| NEDD9 | 12662 | 35757 | 58852 |
| NEFH | 12663 | 35758 | 58853 |
| NEFL | 12664 | 35759 | 58854 |
| NEFM | 12665 | 35760 | 58855 |
| NEGR1 | 12666 | 35761 | 58856 |
| NEIL1 | 12667 | 35762 | 58857 |
| NEIL1 | 12668 | 35763 | 58858 |
| NEIL2 | 12669 | 35764 | 58859 |
| NEIL3 | 12670 | 35765 | 58860 |
| NEK1 | 12671 | 35766 | 58861 |
| NEK10 | 12672 | 35767 | 58862 |
| NEK10 | 12673 | 35768 | 58863 |
| NEK11 | 12674 | 35769 | 58864 |
| NEK11 | 12675 | 35770 | 58865 |
| NEK11 | 12676 | 35771 | 58866 |
| NEK11 | 12677 | 35772 | 58867 |
| NEK2 | 12678 | 35773 | 58868 |
| NEK2 | 12679 | 35774 | 58869 |
| NEK2 | 12680 | 35775 | 58870 |
| NEK3 | 12681 | 35776 | 58871 |
| NEK4 | 12682 | 35777 | 58872 |
| NEK4 | 12683 | 35778 | 58873 |
| NEK5 | 12684 | 35779 | 58874 |
| NEK6 | 12685 | 35780 | 58875 |
| NEK7 | 12686 | 35781 | 58876 |
| NEK8 | 12687 | 35782 | 58877 |
| NEK9 | 12688 | 35783 | 58878 |
| NELFA | 12689 | 35784 | 58879 |
| NELFB | 12690 | 35785 | 58880 |
| NELFCD | 12691 | 35786 | 58881 |
| NELFE | 12692 | 35787 | 58882 |
| NELL1 | 12693 | 35788 | 58883 |
| NELL2 | 12694 | 35789 | 58884 |
| NEMF | 12695 | 35790 | 58885 |
| NEMP1 | 12696 | 35791 | 58886 |
| NEMP2 | 12697 | 35792 | 58887 |
| NENF | 12698 | 35793 | 58888 |
| NEO1 | 12699 | 35794 | 58889 |
| NEPRO | 12700 | 35795 | 58890 |
| NES | 12701 | 35796 | 58891 |
| NET1 | 12702 | 35797 | 58892 |
| NETO1 | 12703 | 35798 | 58893 |
| NETO1 | 12704 | 35799 | 58894 |
| NETO2 | 12705 | 35800 | 58895 |
| NEU1 | 12706 | 35801 | 58896 |
| NEU2 | 12707 | 35802 | 58897 |
| NEU3 | 12708 | 35803 | 58898 |
| NEU4 | 12709 | 35804 | 58899 |
| NEURL1 | 12710 | 35805 | 58900 |
| NEURL1B | 12711 | 35806 | 58901 |
| NEURL2 | 12712 | 35807 | 58902 |
| NEURL2 | 12713 | 35808 | 58903 |
| NEURL3 | 12714 | 35809 | 58904 |
| NEURL3 | 12715 | 35810 | 58905 |
| NEURL4 | 12716 | 35811 | 58906 |
| NEUROD1 | 12717 | 35812 | 58907 |
| NEUROD2 | 12718 | 35813 | 58908 |
| NEUROD4 | 12719 | 35814 | 58909 |
| NEUROD6 | 12720 | 35815 | 58910 |
| NEUROG1 | 12721 | 35816 | 58911 |
| NEUROG2 | 12722 | 35817 | 58912 |
| NEUROG3 | 12723 | 35818 | 58913 |
| NEXMIF | 12724 | 35819 | 58914 |
| NEXN | 12725 | 35820 | 58915 |
| NF1 | 12726 | 35821 | 58916 |
| NF1 | 12727 | 35822 | 58917 |
| NF2 | 12728 | 35823 | 58918 |
| NF2 | 12729 | 35824 | 58919 |
| NFAM1 | 12730 | 35825 | 58920 |
| NFASC | 12731 | 35826 | 58921 |
| NFASC | 12732 | 35827 | 58922 |
| NFAT5 | 12733 | 35828 | 58923 |
| NFATC1 | 12734 | 35829 | 58924 |
| NFATC1 | 12735 | 35830 | 58925 |
| NFATC1 | 12736 | 35831 | 58926 |
| NFATC2 | 12737 | 35832 | 58927 |
| NFATC2 | 12738 | 35833 | 58928 |
| NFATC2IP | 12739 | 35834 | 58929 |
| NFATC3 | 12740 | 35835 | 58930 |
| NFATC3 | 12741 | 35836 | 58931 |
| NFATC3 | 12742 | 35837 | 58932 |
| NFATC4 | 12743 | 35838 | 58933 |
| NFATC4 | 12744 | 35839 | 58934 |
| NFE2 | 12745 | 35840 | 58935 |
| NFE2L1 | 12746 | 35841 | 58936 |
| NFE2L2 | 12747 | 35842 | 58937 |
| NFE2L3 | 12748 | 35843 | 58938 |
| NFE4 | 12749 | 35844 | 58939 |
| NFIA | 12750 | 35845 | 58940 |
| NFIA | 12751 | 35846 | 58941 |
| NFIB | 12752 | 35847 | 58942 |
| NFIB | 12753 | 35848 | 58943 |
| NFIC | 12754 | 35849 | 58944 |
| NFIC | 12755 | 35850 | 58945 |
| NFIL3 | 12756 | 35851 | 58946 |
| NFIX | 12757 | 35852 | 58947 |
| NFIX | 12758 | 35853 | 58948 |
| NFKB1 | 12759 | 35854 | 58949 |
| NFKB2 | 12760 | 35855 | 58950 |
| NFKBIA | 12761 | 35856 | 58951 |
| NFKBIB | 12762 | 35857 | 58952 |
| NFKBID | 12763 | 35858 | 58953 |
| NFKBIE | 12764 | 35859 | 58954 |
| NFKBIL1 | 12765 | 35860 | 58955 |
| NFKBIZ | 12766 | 35861 | 58956 |
| NFRKB | 12767 | 35862 | 58957 |
| NFS1 | 12768 | 35863 | 58958 |
| NFU1 | 12769 | 35864 | 58959 |
| NFX1 | 12770 | 35865 | 58960 |
| NFX1 | 12771 | 35866 | 58961 |
| NFXL1 | 12772 | 35867 | 58962 |
| NFYA | 12773 | 35868 | 58963 |
| NFYB | 12774 | 35869 | 58964 |
| NFYC | 12775 | 35870 | 58965 |
| NGB | 12776 | 35871 | 58966 |
| NGDN | 12777 | 35872 | 58967 |
| NGEF | 12778 | 35873 | 58968 |
| NGF | 12779 | 35874 | 58969 |
| NGFR | 12780 | 35875 | 58970 |
| NGLY1 | 12781 | 35876 | 58971 |
| NGLY1 | 12782 | 35877 | 58972 |
| NGRN | 12783 | 35878 | 58973 |
| NHEJ1 | 12784 | 35879 | 58974 |
| NHLH1 | 12785 | 35880 | 58975 |
| NHLH2 | 12786 | 35881 | 58976 |
| NHLRC1 | 12787 | 35882 | 58977 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| NHLRC2 | 12788 | 35883 | 58978 |
| NHLRC3 | 12789 | 35884 | 58979 |
| NHLRC4 | 12790 | 35885 | 58980 |
| NHP2 | 12791 | 35886 | 58981 |
| NHP2 | 12792 | 35887 | 58982 |
| NHS | 12793 | 35888 | 58983 |
| NHSL1 | 12794 | 35889 | 58984 |
| NHSL2 | 12795 | 35890 | 58985 |
| NICN1 | 12796 | 35891 | 58986 |
| NID1 | 12797 | 35892 | 58987 |
| NID2 | 12798 | 35893 | 58988 |
| NIF3L1 | 12799 | 35894 | 58989 |
| NIF3L1 | 12800 | 35895 | 58990 |
| NIFK | 12801 | 35896 | 58991 |
| NIM1K | 12802 | 35897 | 58992 |
| NIN | 12803 | 35898 | 58993 |
| NIN | 12804 | 35899 | 58994 |
| NIN | 12805 | 35900 | 58995 |
| NINJ1 | 12806 | 35901 | 58996 |
| NINJ2 | 12807 | 35902 | 58997 |
| NINL | 12808 | 35903 | 58998 |
| NIP7 | 12809 | 35904 | 58999 |
| NIPA1 | 12810 | 35905 | 59000 |
| NIPA2 | 12811 | 35906 | 59001 |
| NIPAL1 | 12812 | 35907 | 59002 |
| NIPAL2 | 12813 | 35908 | 59003 |
| NIPAL2 | 12814 | 35909 | 59004 |
| NIPAL3 | 12815 | 35910 | 59005 |
| NIPAL3 | 12816 | 35911 | 59006 |
| NIPAL3 | 12817 | 35912 | 59007 |
| NIPAL4 | 12818 | 35913 | 59008 |
| NIPBL | 12819 | 35914 | 59009 |
| NIPBL | 12820 | 35915 | 59010 |
| NIPSNAP1 | 12821 | 35916 | 59011 |
| NIPSNAP2 | 12822 | 35917 | 59012 |
| NIPSNAP3A | 12823 | 35918 | 59013 |
| NIPSNAP3B | 12824 | 35919 | 59014 |
| NISCH | 12825 | 35920 | 59015 |
| NISCH | 12826 | 35921 | 59016 |
| NISCH | 12827 | 35922 | 59017 |
| NIT1 | 12828 | 35923 | 59018 |
| NIT1 | 12829 | 35924 | 59019 |
| NIT2 | 12830 | 35925 | 59020 |
| NKAIN1 | 12831 | 35926 | 59021 |
| NKAIN2 | 12832 | 35927 | 59022 |
| NKAIN3 | 12833 | 35928 | 59023 |
| NKAIN4 | 12834 | 35929 | 59024 |
| NKAP | 12835 | 35930 | 59025 |
| NKAPL | 12836 | 35931 | 59026 |
| NKD1 | 12837 | 35932 | 59027 |
| NKD2 | 12838 | 35933 | 59028 |
| NKD2 | 12839 | 35934 | 59029 |
| NKG7 | 12840 | 35935 | 59030 |
| NKIRAS1 | 12841 | 35936 | 59031 |
| NKIRAS2 | 12842 | 35937 | 59032 |
| NKIRAS2 | 12843 | 35938 | 59033 |
| NKPD1 | 12844 | 35939 | 59034 |
| NKRF | 12845 | 35940 | 59035 |
| NKTR | 12846 | 35941 | 59036 |
| NKX1-1 | 12847 | 35942 | 59037 |
| NKX1-2 | 12848 | 35943 | 59038 |
| NKX2-1 | 12849 | 35944 | 59039 |
| NKX2-2 | 12850 | 35945 | 59040 |
| NKX2-3 | 12851 | 35946 | 59041 |
| NKX2-4 | 12852 | 35947 | 59042 |
| NKX2-5 | 12853 | 35948 | 59043 |
| NKX2-5 | 12854 | 35949 | 59044 |
| NKX2-5 | 12855 | 35950 | 59045 |
| NKX2-6 | 12856 | 35951 | 59046 |
| NKX2-8 | 12857 | 35952 | 59047 |
| NKX3-1 | 12858 | 35953 | 59048 |
| NKX3-2 | 12859 | 35954 | 59049 |
| NKX6-1 | 12860 | 35955 | 59050 |
| NKX6-2 | 12861 | 35956 | 59051 |
| NKX6-3 | 12862 | 35957 | 59052 |
| NLE1 | 12863 | 35958 | 59053 |
| NLGN1 | 12864 | 35959 | 59054 |
| NLGN2 | 12865 | 35960 | 59055 |
| NLGN3 | 12866 | 35961 | 59056 |
| NLGN4X | 12867 | 35962 | 59057 |
| NLGN4Y | 12868 | 35963 | 59058 |
| NLGN4Y | 12869 | 35964 | 59059 |
| NLK | 12870 | 35965 | 59060 |
| NLN | 12871 | 35966 | 59061 |
| NLRC3 | 12872 | 35967 | 59062 |
| NLRC4 | 12873 | 35968 | 59063 |
| NLRC5 | 12874 | 35969 | 59064 |
| NLRP1 | 12875 | 35970 | 59065 |
| NLRP1 | 12876 | 35971 | 59066 |
| NLRP10 | 12877 | 35972 | 59067 |
| NLRP11 | 12878 | 35973 | 59068 |
| NLRP12 | 12879 | 35974 | 59069 |
| NLRP13 | 12880 | 35975 | 59070 |
| NLRP13 | 12881 | 35976 | 59071 |
| NLRP14 | 12882 | 35977 | 59072 |
| NLRP2 | 12883 | 35978 | 59073 |
| NLRP2B | 12884 | 35979 | 59074 |
| NLRP3 | 12885 | 35980 | 59075 |
| NLRP4 | 12886 | 35981 | 59076 |
| NLRP5 | 12887 | 35982 | 59077 |
| NLRP6 | 12888 | 35983 | 59078 |
| NLRP7 | 12889 | 35984 | 59079 |
| NLRP8 | 12890 | 35985 | 59080 |
| NLRP9 | 12891 | 35986 | 59081 |
| NLRX1 | 12892 | 35987 | 59082 |
| NMB | 12893 | 35988 | 59083 |
| NMB | 12894 | 35989 | 59084 |
| NMBR | 12895 | 35990 | 59085 |
| NMD3 | 12896 | 35991 | 59086 |
| NMD3 | 12897 | 35992 | 59087 |
| NME1 | 12898 | 35993 | 59088 |
| NME1- NME2 | 12899 | 35994 | 59089 |
| NME2 | 12900 | 35995 | 59090 |
| NME3 | 12901 | 35996 | 59091 |
| NME4 | 12902 | 35997 | 59092 |
| NME4 | 12903 | 35998 | 59093 |
| NME4 | 12904 | 35999 | 59094 |
| NME5 | 12905 | 36000 | 59095 |
| NME6 | 12906 | 36001 | 59096 |
| NME6 | 12907 | 36002 | 59097 |
| NME7 | 12908 | 36003 | 59098 |
| NME8 | 12909 | 36004 | 59099 |
| NME9 | 12910 | 36005 | 59100 |
| NME9 | 12911 | 36006 | 59101 |
| NMI | 12912 | 36007 | 59102 |
| NMNAT1 | 12913 | 36008 | 59103 |
| NMNAT1 | 12914 | 36009 | 59104 |
| NMNAT2 | 12915 | 36010 | 59105 |
| NMNAT3 | 12916 | 36011 | 59106 |
| NMRAL1 | 12917 | 36012 | 59107 |
| NMRAL1 | 12918 | 36013 | 59108 |
| NMRK1 | 12919 | 36014 | 59109 |
| NMRK2 | 12920 | 36015 | 59110 |
| NMS | 12921 | 36016 | 59111 |
| NMT1 | 12922 | 36017 | 59112 |
| NMT2 | 12923 | 36018 | 59113 |
| NMU | 12924 | 36019 | 59114 |
| NMUR1 | 12925 | 36020 | 59115 |
| NMUR2 | 12926 | 36021 | 59116 |
| NNAT | 12927 | 36022 | 59117 |
| NNAT | 12928 | 36023 | 59118 |
| NNAT | 12929 | 36024 | 59119 |
| NNMT | 12930 | 36025 | 59120 |
| NNT | 12931 | 36026 | 59121 |
| NOA1 | 12932 | 36027 | 59122 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| NOB1 | 12933 | 36028 | 59123 |
| NOBOX | 12934 | 36029 | 59124 |
| NOC2L | 12935 | 36030 | 59125 |
| NOC3L | 12936 | 36031 | 59126 |
| NOC4L | 12937 | 36032 | 59127 |
| NOCT | 12938 | 36033 | 59128 |
| NOD1 | 12939 | 36034 | 59129 |
| NOD2 | 12940 | 36035 | 59130 |
| NODAL | 12941 | 36036 | 59131 |
| NOG | 12942 | 36037 | 59132 |
| NOL10 | 12943 | 36038 | 59133 |
| NOL11 | 12944 | 36039 | 59134 |
| NOL12 | 12945 | 36040 | 59135 |
| NOL3 | 12946 | 36041 | 59136 |
| NOL3 | 12947 | 36042 | 59137 |
| NOL4 | 12948 | 36043 | 59138 |
| NOL4 | 12949 | 36044 | 59139 |
| NOL4L | 12950 | 36045 | 59140 |
| NOL4L | 12951 | 36046 | 59141 |
| NOL6 | 12952 | 36047 | 59142 |
| NOL7 | 12953 | 36048 | 59143 |
| NOL8 | 12954 | 36049 | 59144 |
| NOL9 | 12955 | 36050 | 59145 |
| NOLC1 | 12956 | 36051 | 59146 |
| NOM1 | 12957 | 36052 | 59147 |
| NOMO1 | 12958 | 36053 | 59148 |
| NOMO2 | 12959 | 36054 | 59149 |
| NOMO2 | 12960 | 36055 | 59150 |
| NONO | 12961 | 36056 | 59151 |
| NOP10 | 12962 | 36057 | 59152 |
| NOP14 | 12963 | 36058 | 59153 |
| NOP14 | 12964 | 36059 | 59154 |
| NOP16 | 12965 | 36060 | 59155 |
| NOP16 | 12966 | 36061 | 59156 |
| NOP16 | 12967 | 36062 | 59157 |
| NOP2 | 12968 | 36063 | 59158 |
| NOP2 | 12969 | 36064 | 59159 |
| NOP53 | 12970 | 36065 | 59160 |
| NOP56 | 12971 | 36066 | 59161 |
| NOP58 | 12972 | 36067 | 59162 |
| NOP9 | 12973 | 36068 | 59163 |
| NOP9 | 12974 | 36069 | 59164 |
| NOS1 | 12975 | 36070 | 59155 |
| NOS1AP | 12976 | 36071 | 59155 |
| NOS2 | 12977 | 36072 | 59157 |
| NOS3 | 12978 | 36073 | 59158 |
| NOS3 | 12979 | 36074 | 59159 |
| NOS3 | 12980 | 36075 | 59170 |
| NOS3 | 12981 | 36076 | 59171 |
| NOSIP | 12982 | 36077 | 59172 |
| NOSTRIN | 12983 | 36078 | 59173 |
| NOTCH1 | 12984 | 36079 | 59174 |
| NOTCH2 | 12985 | 36080 | 59175 |
| NOTCH2 | 12986 | 36081 | 59175 |
| NOTCH2NL | 12987 | 36082 | 59177 |
| NOTCH3 | 12988 | 36083 | 59178 |
| NOTCH4 | 12989 | 36084 | 59179 |
| NOTO | 12990 | 36085 | 59180 |
| NOTUM | 12991 | 36086 | 59181 |
| NOV | 12992 | 36087 | 59182 |
| NOVA1 | 12993 | 36088 | 59183 |
| NOVA1 | 12994 | 36089 | 59184 |
| NOVA2 | 12995 | 36090 | 59185 |
| NOX1 | 12996 | 36091 | 59185 |
| NOX3 | 12997 | 36092 | 59187 |
| NOX4 | 12998 | 36093 | 59188 |
| NOX5 | 12999 | 36094 | 59189 |
| NOXA1 | 13000 | 36095 | 59190 |
| NOXO1 | 13001 | 36096 | 59191 |
| NOXRED1 | 13002 | 36097 | 59192 |
| NPAP1 | 13003 | 36098 | 59193 |
| NPAS1 | 13004 | 36099 | 59194 |
| NPAS1 | 13005 | 36100 | 59195 |
| NPAS2 | 13006 | 36101 | 59195 |
| NPAS3 | 13007 | 36102 | 59197 |
| NPAS4 | 13008 | 36103 | 59198 |
| NPAT | 13009 | 36104 | 59199 |
| NPB | 13010 | 36105 | 59200 |
| NPBWR1 | 13011 | 36106 | 59201 |
| NPBWR2 | 13012 | 36107 | 59202 |
| NPC1 | 13013 | 36108 | 59203 |
| NPC1L1 | 13014 | 36109 | 59204 |
| NPC1L1 | 13015 | 36110 | 59205 |
| NPC2 | 13016 | 36111 | 59205 |
| NPDC1 | 13017 | 36112 | 59207 |
| NPEPL1 | 13018 | 35113 | 59208 |
| NPEPPS | 13019 | 36114 | 59209 |
| NPFF | 13020 | 36115 | 59210 |
| NPFFR1 | 13021 | 36116 | 59211 |
| NPFFR2 | 13022 | 36117 | 59212 |
| NPHP1 | 13023 | 36118 | 59213 |
| NPHP3 | 13024 | 36119 | 59214 |
| NPHP4 | 13025 | 36120 | 59215 |
| NPHS1 | 13026 | 36121 | 59216 |
| NPHS2 | 13027 | 36122 | 59217 |
| NPIPA2 | 13028 | 36123 | 59218 |
| NPIPA5 | 13029 | 36124 | 59219 |
| NPIPA7 | 13030 | 36125 | 59220 |
| NPIPB11 | 13031 | 36126 | 59221 |
| NPIPB15 | 13032 | 36127 | 59222 |
| NPIPB3 | 13033 | 36128 | 59223 |
| NPIPB8 | 13034 | 36129 | 59224 |
| NPL | 13035 | 36130 | 59225 |
| NPL | 13036 | 35131 | 59226 |
| NPL | 13037 | 35132 | 59227 |
| NPLOC4 | 13038 | 35133 | 59228 |
| NPM1 | 13039 | 35134 | 59229 |
| NPM1 | 13040 | 35135 | 59230 |
| NPM2 | 13041 | 36136 | 59231 |
| NPM2 | 13042 | 36137 | 59232 |
| NPM3 | 13043 | 36138 | 59233 |
| NPNT | 13044 | 36139 | 59234 |
| NPPA | 13045 | 36140 | 59235 |
| NPPB | 13046 | 36141 | 59236 |
| NPPC | 13047 | 36142 | 59237 |
| NPR1 | 13048 | 36143 | 59238 |
| NPR2 | 13049 | 36144 | 59239 |
| NPR3 | 13050 | 36145 | 59240 |
| NPRL2 | 13051 | 36146 | 59241 |
| NPRL3 | 13052 | 36147 | 59242 |
| NPS | 13053 | 36148 | 59243 |
| NPSR1 | 13054 | 36149 | 59244 |
| NPSR1 | 13055 | 36150 | 59245 |
| NPSR1 | 13056 | 36151 | 59246 |
| NPTN | 13057 | 36152 | 59247 |
| NPTX1 | 13058 | 36153 | 59248 |
| NPTX2 | 13059 | 36154 | 59249 |
| NPTXR | 13060 | 36155 | 59250 |
| NPVF | 13061 | 36156 | 59251 |
| NPW | 13062 | 36157 | 59252 |
| NPY | 13063 | 36158 | 59253 |
| NPY1R | 13064 | 36159 | 59254 |
| NPY2R | 13065 | 36160 | 59255 |
| NPY4R2 | 13066 | 36161 | 59256 |
| NPY5R | 13067 | 36162 | 59257 |
| NQO1 | 13068 | 36163 | 59258 |
| NQO2 | 13069 | 36164 | 59259 |
| NR0B1 | 13070 | 36165 | 59260 |
| NR0B2 | 13071 | 36166 | 59261 |
| NR1D1 | 13072 | 36167 | 59262 |
| NR1D2 | 13073 | 36168 | 59263 |
| NR1H2 | 13074 | 36169 | 59264 |
| NR1H3 | 13075 | 36170 | 59265 |
| NR1H4 | 13076 | 36171 | 59266 |
| NR1I2 | 13077 | 36172 | 59267 |
| NR1I3 | 13078 | 36173 | 59268 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| NR1I3 | 13079 | 36174 | 59269 |
| NR2C1 | 13080 | 36175 | 59270 |
| NR2C1 | 13081 | 36176 | 59271 |
| NR2C1 | 13082 | 36177 | 59272 |
| NR2C2 | 13083 | 36178 | 59273 |
| NR2C2AP | 13084 | 36179 | 59274 |
| NR2C2AP | 13085 | 36180 | 59275 |
| NR2E1 | 13086 | 36181 | 59276 |
| NR2E3 | 13087 | 36182 | 59277 |
| NR2E3 | 13088 | 36183 | 59278 |
| NR2F1 | 13089 | 36184 | 59279 |
| NR2F2 | 13090 | 36185 | 59280 |
| NR2F6 | 13091 | 36186 | 59281 |
| NR3C1 | 13092 | 36187 | 59282 |
| NR3C1 | 13093 | 36188 | 59283 |
| NR3C1 | 13094 | 36189 | 59284 |
| NR3C2 | 13095 | 36190 | 59285 |
| NR4A1 | 13096 | 36191 | 59286 |
| NR4A2 | 13097 | 36192 | 59287 |
| NR4A3 | 13098 | 36193 | 59288 |
| NR4A3 | 13099 | 36194 | 59289 |
| NR5A1 | 13100 | 36195 | 59290 |
| NR5A2 | 13101 | 36196 | 59291 |
| NR6A1 | 13102 | 36197 | 59292 |
| NRAP | 13103 | 36198 | 59293 |
| NRARP | 13104 | 36199 | 59294 |
| NRAS | 13105 | 36200 | 59295 |
| NRBF2 | 13106 | 36201 | 59296 |
| NRBP1 | 13107 | 36202 | 59297 |
| NRBP2 | 13108 | 36203 | 59298 |
| NRCAM | 13109 | 36204 | 59299 |
| NRDC | 13110 | 36205 | 59300 |
| NRDE2 | 13111 | 36206 | 59301 |
| NREP | 13112 | 36207 | 59302 |
| NRF1 | 13113 | 36208 | 59303 |
| NRG1 | 13114 | 36209 | 59304 |
| NRG1 | 13115 | 36210 | 59305 |
| NRG1 | 13116 | 36211 | 59306 |
| NRG1 | 13117 | 36212 | 59307 |
| NRG1 | 13118 | 36213 | 59308 |
| NRG2 | 13119 | 36214 | 59309 |
| NRG3 | 13120 | 36215 | 59310 |
| NRG4 | 13121 | 36216 | 59311 |
| NRGN | 13122 | 36217 | 59312 |
| NRIP1 | 13123 | 36218 | 59313 |
| NRIP2 | 13124 | 36219 | 59314 |
| NRIP3 | 13125 | 36220 | 59315 |
| NRK | 13126 | 36221 | 59316 |
| NRL | 13127 | 36222 | 59317 |
| NRM | 13128 | 36223 | 59318 |
| NRM | 13129 | 36224 | 59319 |
| NRM | 13130 | 36225 | 59320 |
| NRN1 | 13131 | 36226 | 59321 |
| NRN1L | 13132 | 36227 | 59322 |
| NRN1L | 13133 | 36228 | 59323 |
| NRP1 | 13134 | 36229 | 59324 |
| NRP1 | 13135 | 36230 | 59325 |
| NRP2 | 13136 | 36231 | 59326 |
| NRP2 | 13137 | 36232 | 59327 |
| NRP2 | 13138 | 36233 | 59328 |
| NRROS | 13139 | 36234 | 59329 |
| NRSN1 | 13140 | 36235 | 59330 |
| NRSN2 | 13141 | 36236 | 59331 |
| NRTN | 13142 | 36237 | 59332 |
| NRXN1 | 13143 | 36238 | 59333 |
| NRXN1 | 13144 | 36239 | 59334 |
| NRXN1 | 13145 | 36240 | 59335 |
| NRXN1 | 13146 | 36241 | 59336 |
| NRXN2 | 13147 | 36242 | 59337 |
| NRXN3 | 13148 | 36243 | 59338 |
| NSA2 | 13149 | 36244 | 59339 |
| NSD1 | 13150 | 36245 | 59340 |
| NSD2 | 13151 | 36246 | 59341 |
| NSD2 | 13152 | 36247 | 59342 |
| NSD2 | 13153 | 36248 | 59343 |
| NSD3 | 13154 | 36249 | 59344 |
| NSD3 | 13155 | 36250 | 59345 |
| NSDHL | 13156 | 36251 | 59346 |
| NSF | 13157 | 36252 | 59347 |
| NSFL1C | 13158 | 36253 | 59348 |
| NSG1 | 13159 | 36254 | 59349 |
| NSG2 | 13160 | 36255 | 59350 |
| NSL1 | 13161 | 36256 | 59351 |
| NSL1 | 13162 | 36257 | 59352 |
| NSL1 | 13163 | 36258 | 59353 |
| NSL1 | 13164 | 36259 | 59354 |
| NSMAF | 13165 | 36260 | 59355 |
| NSMCE1 | 13166 | 36261 | 59356 |
| NSMCE2 | 13167 | 36262 | 59357 |
| NSMCE2 | 13168 | 36263 | 59358 |
| NSMCE3 | 13169 | 36264 | 59359 |
| NSMCE4A | 13170 | 36265 | 59360 |
| NSMF | 13171 | 36266 | 59361 |
| NSRP1 | 13172 | 36267 | 59362 |
| NSUN2 | 13173 | 36268 | 59363 |
| NSUN3 | 13174 | 36269 | 59364 |
| NSUN4 | 13175 | 36270 | 59365 |
| NSUN5 | 13176 | 36271 | 59366 |
| NSUN5 | 13177 | 36272 | 59367 |
| NSUN5 | 13178 | 36273 | 59368 |
| NSUN6 | 13179 | 36274 | 59369 |
| NSUN7 | 13180 | 36275 | 59370 |
| NSUN7 | 13181 | 36276 | 59371 |
| NT5C | 13182 | 36277 | 59372 |
| NT5C1A | 13183 | 36278 | 59373 |
| NT5C1B | 13184 | 36279 | 59374 |
| NT5C1B-RDH14 | 13185 | 36280 | 59375 |
| NT5C2 | 13186 | 36281 | 59376 |
| NT5C3A | 13187 | 36282 | 59377 |
| NT5C3B | 13188 | 36283 | 59378 |
| NT5DC1 | 13189 | 36284 | 59379 |
| NT5DC2 | 13190 | 36285 | 59380 |
| NT5DC3 | 13191 | 36286 | 59381 |
| NT5DC4 | 13192 | 36287 | 59382 |
| NT5E | 13193 | 36288 | 59383 |
| NT5M | 13194 | 36289 | 59384 |
| NTAN1 | 13195 | 36290 | 59385 |
| NTF3 | 13196 | 36291 | 59386 |
| NTF4 | 13197 | 36292 | 59387 |
| NTHL1 | 13198 | 36293 | 59388 |
| NTM | 13199 | 36294 | 59389 |
| NTM | 13200 | 36295 | 59390 |
| NTMT1 | 13201 | 36296 | 59391 |
| NTMT1 | 13202 | 36297 | 59392 |
| NTN1 | 13203 | 36298 | 59393 |
| NTN3 | 13204 | 36299 | 59394 |
| NTN4 | 13205 | 36300 | 59395 |
| NTN5 | 13206 | 36301 | 59396 |
| NTNG1 | 13207 | 36302 | 59397 |
| NTNG2 | 13208 | 36303 | 59398 |
| NTPCR | 13209 | 36304 | 59399 |
| NTPCR | 13210 | 36305 | 59400 |
| NTRK1 | 13211 | 36306 | 59401 |
| NTRK2 | 13212 | 36307 | 59402 |
| NTRK2 | 13213 | 36308 | 59403 |
| NTRK2 | 13214 | 36309 | 59404 |
| NTRK3 | 13215 | 36310 | 59405 |
| NTRK3 | 13216 | 36311 | 59406 |
| NTRK3 | 13217 | 36312 | 59407 |
| NTS | 13218 | 36313 | 59408 |
| NTSR1 | 13219 | 36314 | 59409 |
| NTSR2 | 13220 | 36315 | 59410 |
| NUAK1 | 13221 | 36316 | 59411 |
| NUAK2 | 13222 | 36317 | 59412 |
| NUB1 | 13223 | 36318 | 59413 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| NUBP1 | 13224 | 36319 | 59414 |
| NUBP1 | 13225 | 36320 | 59415 |
| NUBP2 | 13226 | 36321 | 59416 |
| NUBP2 | 13227 | 36322 | 59417 |
| NUBPL | 13228 | 36323 | 59418 |
| NUCB1 | 13229 | 36324 | 59419 |
| NUCB2 | 13230 | 36325 | 59420 |
| NUCKS1 | 13231 | 36326 | 59421 |
| NUDC | 13232 | 36327 | 59422 |
| NUDCD1 | 13233 | 36328 | 59423 |
| NUDCD2 | 13234 | 36329 | 59424 |
| NUDCD3 | 13235 | 36330 | 59425 |
| NUDT1 | 13236 | 36331 | 59426 |
| NUDT10 | 13237 | 36332 | 59427 |
| NUDT11 | 13238 | 36333 | 59428 |
| NUDT12 | 13239 | 36334 | 59429 |
| NUDT13 | 13240 | 36335 | 59430 |
| NUDT13 | 13241 | 36336 | 59431 |
| NUDT14 | 13242 | 36337 | 59432 |
| NUDT14 | 13243 | 36338 | 59433 |
| NUDT15 | 13244 | 36339 | 59434 |
| NUDT15 | 13245 | 36340 | 59435 |
| NUDT16 | 13246 | 36341 | 59436 |
| NUDT16 | 13247 | 36342 | 59437 |
| NUDT16 | 13248 | 36343 | 59438 |
| NUDT16L1 | 13249 | 36344 | 59439 |
| NUDT16L1 | 13250 | 36345 | 59440 |
| NUDT17 | 13251 | 36346 | 59441 |
| NUDT18 | 13252 | 36347 | 59442 |
| NUDT19 | 13253 | 36348 | 59443 |
| NUDT2 | 13254 | 36349 | 59444 |
| NUDT21 | 13255 | 36350 | 59445 |
| NUDT22 | 13256 | 36351 | 59446 |
| NUDT3 | 13257 | 36352 | 59447 |
| NUDT4 | 13258 | 36353 | 59448 |
| NUDT5 | 13259 | 36354 | 59449 |
| NUDT6 | 13260 | 36355 | 59450 |
| NUDT7 | 13261 | 36356 | 59451 |
| NUDT8 | 13262 | 36357 | 59452 |
| NUDT8 | 13263 | 36358 | 59453 |
| NUDT9 | 13264 | 36359 | 59454 |
| NUF2 | 13265 | 36360 | 59455 |
| NUFIP1 | 13266 | 36361 | 59456 |
| NUFIP2 | 13267 | 36362 | 59457 |
| NUGGC | 13268 | 36363 | 59458 |
| NUMA1 | 13269 | 36364 | 59459 |
| NUMB | 13270 | 36365 | 59460 |
| NUMBL | 13271 | 36366 | 59461 |
| NUP107 | 13272 | 36367 | 59462 |
| NUP133 | 13273 | 36368 | 59463 |
| NUP153 | 13274 | 36369 | 59464 |
| NUP155 | 13275 | 36370 | 59465 |
| NUP160 | 13276 | 36371 | 59466 |
| NUP160 | 13277 | 36372 | 59467 |
| NUP188 | 13278 | 36373 | 59468 |
| NUP205 | 13279 | 36374 | 59469 |
| NUP210 | 13280 | 36375 | 59470 |
| NUP210L | 13281 | 36376 | 59471 |
| NUP214 | 13282 | 36377 | 59472 |
| NUP35 | 13283 | 36378 | 59473 |
| NUP37 | 13284 | 36379 | 59474 |
| NUP43 | 13285 | 36380 | 59475 |
| NUP50 | 13286 | 36381 | 59476 |
| NUP54 | 13287 | 36382 | 59477 |
| NUP58 | 13288 | 36383 | 59478 |
| NUP62 | 13289 | 36384 | 59479 |
| NUP62CL | 13290 | 36385 | 59480 |
| NUP85 | 13291 | 36386 | 59481 |
| NUP88 | 13292 | 36387 | 59482 |
| NUP93 | 13293 | 36388 | 59483 |
| NUP98 | 13294 | 36389 | 59484 |
| NUP98 | 13295 | 36390 | 59485 |
| NUPL2 | 13296 | 36391 | 59486 |
| NUPR1 | 13297 | 36392 | 59487 |
| NUPR2 | 13298 | 36393 | 59488 |
| NUS1 | 13299 | 36394 | 59489 |
| NUSAP1 | 13300 | 36395 | 59490 |
| NUTF2 | 13301 | 36396 | 59491 |
| NUTM1 | 13302 | 36397 | 59492 |
| NUTM2B | 13303 | 36398 | 59493 |
| NUTM2D | 13304 | 36399 | 59494 |
| NUTM2G | 13305 | 36400 | 59495 |
| NUTM2G | 13306 | 36401 | 59496 |
| NVL | 13307 | 36402 | 59497 |
| NWD1 | 13308 | 36403 | 59498 |
| NWD1 | 13309 | 36404 | 59499 |
| NWD2 | 13310 | 36405 | 59500 |
| NXF1 | 13311 | 36406 | 59501 |
| NXF1 | 13312 | 36407 | 59502 |
| NXF2 | 13313 | 36408 | 59503 |
| NXF3 | 13314 | 36409 | 59504 |
| NXF5 | 13315 | 36410 | 59505 |
| NXN | 13316 | 36411 | 59506 |
| NXNL1 | 13317 | 36412 | 59507 |
| NXNL2 | 13318 | 36413 | 59508 |
| NXNL2 | 13319 | 36414 | 59509 |
| NXPE1 | 13320 | 36415 | 59510 |
| NXPE2 | 13321 | 36416 | 59511 |
| NXPE3 | 13322 | 36417 | 59512 |
| NXPE4 | 13323 | 36418 | 59513 |
| NXPH1 | 13324 | 36419 | 59514 |
| NXPH2 | 13325 | 36420 | 59515 |
| NXPH3 | 13326 | 36421 | 59516 |
| NXPH4 | 13327 | 36422 | 59517 |
| NXT1 | 13328 | 36423 | 59518 |
| NXT2 | 13329 | 36424 | 59519 |
| NYAP1 | 13330 | 36425 | 59520 |
| NYAP2 | 13331 | 36426 | 59521 |
| NYNRIN | 13332 | 36427 | 59522 |
| NYX | 13333 | 36428 | 59523 |
| OAF | 13334 | 36429 | 59524 |
| OARD1 | 13335 | 36430 | 59525 |
| OARD1 | 13336 | 36431 | 59526 |
| OARD1 | 13337 | 36432 | 59527 |
| OAS1 | 13338 | 36433 | 59528 |
| OAS1 | 13339 | 36434 | 59529 |
| OAS1 | 13340 | 36435 | 59530 |
| OAS1 | 13341 | 36436 | 59531 |
| OAS2 | 13342 | 36437 | 59532 |
| OAS2 | 13343 | 36438 | 59533 |
| OAS2 | 13344 | 36439 | 59534 |
| OAS3 | 13345 | 36440 | 59535 |
| OASL | 13346 | 36441 | 59536 |
| OASL | 13347 | 36442 | 59537 |
| OAT | 13348 | 36443 | 59538 |
| OAZ1 | 13349 | 36444 | 59539 |
| OAZ2 | 13350 | 36445 | 59540 |
| OAZ3 | 13351 | 36446 | 59541 |
| OBP2A | 13352 | 36447 | 59542 |
| OBP2A | 13353 | 36448 | 59543 |
| OBP2B | 13354 | 36449 | 59544 |
| OBSCN | 13355 | 36450 | 59545 |
| OBSCN | 13356 | 36451 | 59546 |
| OBSL1 | 13357 | 36452 | 59547 |
| OBSL1 | 13358 | 36453 | 59548 |
| OBSL1 | 13359 | 36454 | 59549 |
| OC90 | 13360 | 36455 | 59550 |
| OCA2 | 13361 | 36456 | 59551 |
| OCEL1 | 13362 | 36457 | 59552 |
| OCIAD1 | 13363 | 36458 | 59553 |
| OCIAD1 | 13364 | 36459 | 59554 |
| OCIAD1 | 13365 | 36460 | 59555 |
| OCIAD2 | 13366 | 36461 | 59556 |
| OCIAD2 | 13367 | 36462 | 59557 |
| OCLM | 13368 | 36463 | 59558 |
| OCLN | 13369 | 36464 | 59559 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| OCM2 | 13370 | 36465 | 59560 |
| OCRL | 13371 | 36466 | 59561 |
| OCSTAMP | 13372 | 36467 | 59562 |
| ODAM | 13373 | 36468 | 59563 |
| ODAPH | 13374 | 36469 | 59564 |
| ODC1 | 13375 | 36470 | 59565 |
| ODF1 | 13376 | 36471 | 59566 |
| ODF2 | 13377 | 36472 | 59567 |
| ODF2 | 13378 | 36473 | 59568 |
| ODF2L | 13379 | 36474 | 59569 |
| ODF2L | 13380 | 36475 | 59570 |
| ODF3 | 13381 | 36476 | 59571 |
| ODF3B | 13382 | 36477 | 59572 |
| ODF3L1 | 13383 | 36478 | 59573 |
| ODF3L2 | 13384 | 36479 | 59574 |
| ODF4 | 13385 | 36480 | 59575 |
| OFD1 | 13386 | 36481 | 59576 |
| OGDH | 13387 | 36482 | 59577 |
| OGDH | 13388 | 36483 | 59578 |
| OGDHL | 13389 | 36484 | 59579 |
| OGFOD1 | 13390 | 36485 | 59580 |
| OGFOD2 | 13391 | 36486 | 59581 |
| OGFOD3 | 13392 | 36487 | 59582 |
| OGFOD3 | 13393 | 36488 | 59583 |
| OGFR | 13394 | 36489 | 59584 |
| OGFRL1 | 13395 | 36490 | 59585 |
| OGG1 | 13396 | 36491 | 59586 |
| OGG1 | 13397 | 36492 | 59587 |
| OGG1 | 13398 | 36493 | 59588 |
| OGG1 | 13399 | 36494 | 59589 |
| OGG1 | 13400 | 36495 | 59590 |
| OGG1 | 13401 | 36496 | 59591 |
| OGN | 13402 | 36497 | 59592 |
| OGT | 13403 | 36498 | 59593 |
| OIP5 | 13404 | 36499 | 59594 |
| OIT3 | 13405 | 36500 | 59595 |
| OLA1 | 13406 | 36501 | 59596 |
| OLAH | 13407 | 36502 | 59597 |
| OLFM1 | 13408 | 36503 | 59598 |
| OLFM1 | 13409 | 36504 | 59599 |
| OLFM2 | 13410 | 36505 | 59600 |
| OLFM3 | 13411 | 36506 | 59601 |
| OLFM4 | 13412 | 36507 | 59602 |
| OLFML1 | 13413 | 36508 | 59603 |
| OLFML2A | 13414 | 36509 | 59604 |
| OLFML2B | 13415 | 36510 | 59605 |
| OLFML3 | 13416 | 36511 | 59606 |
| OLIG1 | 13417 | 36512 | 59607 |
| OLIG2 | 13418 | 36513 | 59608 |
| OLIG3 | 13419 | 36514 | 59609 |
| OLR1 | 13420 | 36515 | 59610 |
| OLR1 | 13421 | 36516 | 59611 |
| OLR1 | 13422 | 36517 | 59612 |
| OMA1 | 13423 | 36518 | 59613 |
| OMD | 13424 | 36519 | 59614 |
| OMG | 13425 | 36520 | 59615 |
| OMP | 13426 | 36521 | 59616 |
| ONECUT1 | 13427 | 36522 | 59617 |
| ONECUT2 | 13428 | 36523 | 59618 |
| ONECUT3 | 13429 | 36524 | 59619 |
| OOEP | 13430 | 36525 | 59620 |
| OOSP2 | 13431 | 36526 | 59621 |
| OPA1 | 13432 | 36527 | 59622 |
| OPA3 | 13433 | 36528 | 59623 |
| OPA3 | 13434 | 36529 | 59624 |
| OPALIN | 13435 | 36530 | 59625 |
| OPALIN | 13436 | 36531 | 59626 |
| OPCML | 13437 | 36532 | 59627 |
| OPHN1 | 13438 | 36533 | 59628 |
| OPLAH | 13439 | 36534 | 59629 |
| OPN1LW | 13440 | 36535 | 59630 |
| OPN1SW | 13441 | 36536 | 59631 |
| OPN3 | 13442 | 36537 | 59632 |
| OPN4 | 13443 | 36538 | 59633 |
| OPN5 | 13444 | 36539 | 59634 |
| OPRD1 | 13445 | 36540 | 59635 |
| OPRK1 | 13446 | 36541 | 59636 |
| OPRL1 | 13447 | 36542 | 59637 |
| OPRM1 | 13448 | 36543 | 59638 |
| OPRM1 | 13449 | 36544 | 59639 |
| OPRM1 | 13450 | 36545 | 59640 |
| OPRM1 | 13451 | 36546 | 59641 |
| OPRM1 | 13452 | 36547 | 59642 |
| OPRM1 | 13453 | 36548 | 59643 |
| OPRM1 | 13454 | 36549 | 59644 |
| OPRM1 | 13455 | 36550 | 59645 |
| OPRM1 | 13456 | 36551 | 59646 |
| OPRM1 | 13457 | 36552 | 59647 |
| OPRM1 | 13458 | 36553 | 59648 |
| OPRPN | 13459 | 36554 | 59649 |
| OPRPN | 13460 | 36555 | 59650 |
| OPTC | 13461 | 36556 | 59651 |
| OPTN | 13462 | 36557 | 59652 |
| OR10A2 | 13463 | 36558 | 59653 |
| OR10A3 | 13464 | 36559 | 59654 |
| OR10A4 | 13465 | 36560 | 59655 |
| OR10A6 | 13466 | 36561 | 59656 |
| OR10A7 | 13467 | 36562 | 59657 |
| OR10AC1 | 13468 | 36563 | 59658 |
| OR10AD1 | 13469 | 36564 | 59659 |
| OR10AG1 | 13470 | 36565 | 59660 |
| OR10C1 | 13471 | 36566 | 59661 |
| OR10G2 | 13472 | 36567 | 59662 |
| OR10G3 | 13473 | 36568 | 59663 |
| OR10G4 | 13474 | 36569 | 59664 |
| OR10G7 | 13475 | 36570 | 59665 |
| OR10G8 | 13476 | 36571 | 59666 |
| OR10G9 | 13477 | 36572 | 59667 |
| OR10H1 | 13478 | 36573 | 59668 |
| OR10H2 | 13479 | 36574 | 59669 |
| OR10H3 | 13480 | 36575 | 59670 |
| OR10H4 | 13481 | 36576 | 59671 |
| OR10H5 | 13482 | 36577 | 59672 |
| OR10J1 | 13483 | 36578 | 59673 |
| OR10J3 | 13484 | 36579 | 59674 |
| OR10J4 | 13485 | 36580 | 59675 |
| OR10J5 | 13486 | 36581 | 59676 |
| OR10K1 | 13487 | 36582 | 59677 |
| OR10K2 | 13488 | 36583 | 59678 |
| OR10P1 | 13489 | 36584 | 59679 |
| OR10Q1 | 13490 | 36585 | 59680 |
| OR10R2 | 13491 | 36586 | 59681 |
| OR10S1 | 13492 | 36587 | 59682 |
| OR10T2 | 13493 | 36588 | 59683 |
| OR10V1 | 13494 | 36589 | 59684 |
| OR10W1 | 13495 | 36590 | 59685 |
| OR10X1 | 13496 | 36591 | 59686 |
| OR10Z1 | 13497 | 36592 | 59687 |
| OR11A1 | 13498 | 36593 | 59688 |
| OR11G2 | 13499 | 36594 | 59689 |
| OR11H1 | 13500 | 36595 | 59690 |
| OR11H12 | 13501 | 36596 | 59691 |
| OR11H2 | 13502 | 36597 | 59692 |
| OR11H4 | 13503 | 36598 | 59693 |
| OR11H6 | 13504 | 36599 | 59694 |
| OR11H7 | 13505 | 36600 | 59695 |
| OR11L1 | 13506 | 36601 | 59696 |
| OR12D1 | 13507 | 36602 | 59697 |
| OR12D2 | 13508 | 36603 | 59698 |
| OR12D3 | 13509 | 36604 | 59699 |
| OR13A1 | 13510 | 36605 | 59700 |
| OR13C2 | 13511 | 36606 | 59701 |
| OR13C3 | 13512 | 36607 | 59702 |
| OR13C4 | 13513 | 36608 | 59703 |
| OR13C5 | 13514 | 36609 | 59704 |
| OR13C8 | 13515 | 36610 | 59705 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| OR13C9 | 13516 | 36611 | 59706 |
| OR13D1 | 13517 | 36612 | 59707 |
| OR13F1 | 13518 | 36613 | 59708 |
| OR13G1 | 13519 | 36614 | 59709 |
| OR13H1 | 13520 | 36615 | 59710 |
| OR13J1 | 13521 | 36616 | 59711 |
| OR14A16 | 13522 | 36617 | 59712 |
| OR14C36 | 13523 | 36618 | 59713 |
| OR14I1 | 13524 | 36619 | 59714 |
| OR14J1 | 13525 | 36620 | 59715 |
| OR1A1 | 13526 | 36621 | 59716 |
| OR1A2 | 13527 | 36622 | 59717 |
| OR1B1 | 13528 | 36623 | 59718 |
| OR1C1 | 13529 | 36624 | 59719 |
| OR1D2 | 13530 | 36625 | 59720 |
| OR1D5 | 13531 | 36626 | 59721 |
| OR1E1 | 13532 | 36627 | 59722 |
| OR1E2 | 13533 | 36628 | 59723 |
| OR1E3 | 13534 | 36629 | 59724 |
| OR1F1 | 13535 | 36630 | 59725 |
| OR1G1 | 13536 | 36631 | 59726 |
| OR1I1 | 13537 | 36632 | 59727 |
| OR1J1 | 13538 | 36633 | 59728 |
| OR1J2 | 13539 | 36634 | 59729 |
| OR1J4 | 13540 | 36635 | 59730 |
| OR1K1 | 13541 | 36636 | 59731 |
| OR1L1 | 13542 | 36637 | 59732 |
| OR1L3 | 13543 | 36638 | 59733 |
| OR1L4 | 13544 | 36639 | 59734 |
| OR1L6 | 13545 | 36640 | 59735 |
| OR1L8 | 13546 | 36641 | 59736 |
| OR1M1 | 13547 | 36642 | 59737 |
| OR1N1 | 13548 | 36643 | 59738 |
| OR1N2 | 13549 | 36644 | 59739 |
| OR1Q1 | 13550 | 36645 | 59740 |
| OR1S1 | 13551 | 36646 | 59741 |
| OR2A12 | 13552 | 36647 | 59742 |
| OR2A14 | 13553 | 36648 | 59743 |
| OR2A2 | 13554 | 36649 | 59744 |
| OR2A25 | 13555 | 36650 | 59745 |
| OR2A42 | 13556 | 36651 | 59746 |
| OR2A5 | 13557 | 36652 | 59747 |
| OR2A7 | 13558 | 36653 | 59748 |
| OR2AE1 | 13559 | 36654 | 59749 |
| OR2AG1 | 13560 | 36655 | 59750 |
| OR2AG2 | 13561 | 36656 | 59751 |
| OR2AK2 | 13562 | 36657 | 59752 |
| OR2AP1 | 13563 | 36658 | 59753 |
| OR2AT4 | 13564 | 36659 | 59754 |
| OR2B11 | 13565 | 36660 | 59755 |
| OR2B2 | 13566 | 36661 | 59756 |
| OR2B3 | 13567 | 36662 | 59757 |
| OR2B6 | 13568 | 36663 | 59758 |
| OR2C1 | 13569 | 36664 | 59759 |
| OR2C3 | 13570 | 36665 | 59760 |
| OR2D2 | 13571 | 36666 | 59761 |
| OR2D3 | 13572 | 36667 | 59762 |
| OR2F1 | 13573 | 36668 | 59763 |
| OR2F2 | 13574 | 36669 | 59764 |
| OR2G2 | 13575 | 36670 | 59765 |
| OR2G3 | 13576 | 36671 | 59766 |
| OR2G6 | 13577 | 36672 | 59767 |
| OR2H1 | 13578 | 36673 | 59768 |
| OR2H2 | 13579 | 36674 | 59769 |
| OR2J1 | 13580 | 36675 | 59770 |
| OR2J2 | 13581 | 36676 | 59771 |
| OR2J3 | 13582 | 36677 | 59772 |
| OR2K2 | 13583 | 36678 | 59773 |
| OR2L13 | 13584 | 36679 | 59774 |
| OR2L2 | 13585 | 36680 | 59775 |
| OR2L3 | 13586 | 36681 | 59776 |
| OR2L5 | 13587 | 36682 | 59777 |
| OR2L8 | 13588 | 36683 | 59778 |
| OR2M2 | 13589 | 36684 | 59779 |
| OR2M3 | 13590 | 36685 | 59780 |
| OR2M4 | 13591 | 36686 | 59781 |
| OR2M5 | 13592 | 36687 | 59782 |
| OR2S2 | 13593 | 36688 | 59783 |
| OR2T1 | 13594 | 36689 | 59784 |
| OR2T10 | 13595 | 36690 | 59785 |
| OR2T11 | 13596 | 36691 | 59786 |
| OR2T12 | 13597 | 36692 | 59787 |
| OR2T2 | 13598 | 36693 | 59788 |
| OR2T27 | 13599 | 36694 | 59789 |
| OR2T29 | 13600 | 36695 | 59790 |
| OR2T3 | 13601 | 36696 | 59791 |
| OR2T4 | 13602 | 36697 | 59792 |
| OR2T6 | 13603 | 36698 | 59793 |
| OR2T8 | 13604 | 36699 | 59794 |
| OR2V2 | 13605 | 36700 | 59795 |
| OR2W1 | 13606 | 36701 | 59796 |
| OR2W3 | 13607 | 36702 | 59797 |
| OR2W5 | 13608 | 36703 | 59798 |
| OR2Y1 | 13609 | 36704 | 59799 |
| OR2Z1 | 13610 | 36705 | 59800 |
| OR3A1 | 13611 | 36706 | 59801 |
| OR3A2 | 13612 | 36707 | 59802 |
| OR3A3 | 13613 | 36708 | 59803 |
| OR4A15 | 13614 | 36709 | 59804 |
| OR4A16 | 13615 | 36710 | 59805 |
| OR4A47 | 13616 | 36711 | 59806 |
| OR4A5 | 13617 | 36712 | 59807 |
| OR4B1 | 13618 | 36713 | 59808 |
| OR4C11 | 13619 | 36714 | 59809 |
| OR4C12 | 13620 | 36715 | 59810 |
| OR4C13 | 13621 | 36716 | 59811 |
| OR4C15 | 13622 | 36717 | 59812 |
| OR4C16 | 13623 | 36718 | 59813 |
| OR4C3 | 13624 | 36719 | 59814 |
| OR4C45 | 13625 | 36720 | 59815 |
| OR4C46 | 13626 | 36721 | 59816 |
| OR4C5 | 13627 | 36722 | 59817 |
| OR4C6 | 13628 | 36723 | 59818 |
| OR4D1 | 13629 | 36724 | 59819 |
| OR4D10 | 13630 | 36725 | 59820 |
| OR4D11 | 13631 | 36726 | 59821 |
| OR4D2 | 13632 | 36727 | 59822 |
| OR4D5 | 13633 | 36728 | 59823 |
| OR4D6 | 13634 | 36729 | 59824 |
| OR4D9 | 13635 | 36730 | 59825 |
| OR4E1 | 13636 | 36731 | 59826 |
| OR4E2 | 13637 | 36732 | 59827 |
| OR4F15 | 13638 | 36733 | 59828 |
| OR4F17 | 13639 | 36734 | 59829 |
| OR4F21 | 13640 | 36735 | 59830 |
| OR4F29 | 13641 | 36736 | 59831 |
| OR4F4 | 13642 | 36737 | 59832 |
| OR4F6 | 13643 | 36738 | 59833 |
| OR4K1 | 13644 | 36739 | 59834 |
| OR4K13 | 13645 | 36740 | 59835 |
| OR4K14 | 13646 | 36741 | 59836 |
| OR4K15 | 13647 | 36742 | 59837 |
| OR4K17 | 13648 | 36743 | 59838 |
| OR4K2 | 13649 | 36744 | 59839 |
| OR4K3 | 13650 | 36745 | 59840 |
| OR4K5 | 13651 | 36746 | 59841 |
| OR4L1 | 13652 | 36747 | 59842 |
| OR4M1 | 13653 | 36748 | 59843 |
| OR4M2 | 13654 | 36749 | 59844 |
| OR4N2 | 13655 | 36750 | 59845 |
| OR4N4 | 13656 | 36751 | 59846 |
| OR4N5 | 13657 | 36752 | 59847 |
| OR4P4 | 13658 | 36753 | 59848 |
| OR4Q2 | 13659 | 36754 | 59849 |
| OR4Q3 | 13660 | 36755 | 59850 |
| OR4S1 | 13661 | 36756 | 59851 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| OR4S2 | 13662 | 36757 | 59852 |
| OR4X1 | 13663 | 36758 | 59853 |
| OR4X2 | 13664 | 36759 | 59854 |
| OR51A2 | 13665 | 36760 | 59855 |
| OR51A4 | 13666 | 36761 | 59856 |
| OR51A7 | 13667 | 36762 | 59857 |
| OR51B2 | 13668 | 36763 | 59858 |
| OR51B4 | 13669 | 36764 | 59859 |
| OR51B5 | 13670 | 36765 | 59860 |
| OR51B6 | 13671 | 36766 | 59861 |
| OR51D1 | 13672 | 36767 | 59862 |
| OR51E1 | 13673 | 36768 | 59863 |
| OR51E2 | 13674 | 36769 | 59864 |
| OR51F1 | 13675 | 36770 | 59865 |
| OR51F2 | 13676 | 36771 | 59866 |
| OR51G1 | 13677 | 36772 | 59867 |
| OR51G2 | 13678 | 36773 | 59868 |
| OR51H1 | 13679 | 36774 | 59869 |
| OR51I1 | 13680 | 36775 | 59870 |
| OR51I2 | 13681 | 36776 | 59871 |
| OR51J1 | 13682 | 36777 | 59872 |
| OR51L1 | 13683 | 36778 | 59873 |
| OR51M1 | 13684 | 36779 | 59874 |
| OR51Q1 | 13685 | 36780 | 59875 |
| OR51S1 | 13686 | 36781 | 59876 |
| OR51T1 | 13687 | 36782 | 59877 |
| OR51V1 | 13688 | 36783 | 59878 |
| OR52A1 | 13689 | 36784 | 59879 |
| OR52A5 | 13690 | 36785 | 59880 |
| OR52B2 | 13691 | 36786 | 59881 |
| OR52B4 | 13692 | 36787 | 59882 |
| OR52B6 | 13693 | 36788 | 59883 |
| OR52D1 | 13694 | 36789 | 59884 |
| OR52E1 | 13695 | 36790 | 59885 |
| OR52E2 | 13696 | 36791 | 59886 |
| OR52E4 | 13697 | 36792 | 59887 |
| OR52E6 | 13698 | 36793 | 59888 |
| OR52E8 | 13699 | 36794 | 59889 |
| OR52H1 | 13700 | 36795 | 59890 |
| OR52I1 | 13701 | 36796 | 59891 |
| OR52I2 | 13702 | 36797 | 59892 |
| OR52J3 | 13703 | 36798 | 59893 |
| OR52K1 | 13704 | 36799 | 59894 |
| OR52K2 | 13705 | 36800 | 59895 |
| OR52L1 | 13706 | 36801 | 59896 |
| OR52M1 | 13707 | 36802 | 59897 |
| OR52N1 | 13708 | 36803 | 59898 |
| OR52N2 | 13709 | 36804 | 59899 |
| OR52N4 | 13710 | 36805 | 59900 |
| OR52N5 | 13711 | 36806 | 59901 |
| OR52R1 | 13712 | 36807 | 59902 |
| OR52W1 | 13713 | 36808 | 59903 |
| OR52Z1 | 13714 | 36809 | 59904 |
| OR56A1 | 13715 | 36810 | 59905 |
| OR56A3 | 13716 | 36811 | 59906 |
| OR56A4 | 13717 | 36812 | 59907 |
| OR56A5 | 13718 | 36813 | 59908 |
| OR56B1 | 13719 | 36814 | 59909 |
| OR56B4 | 13720 | 36815 | 59910 |
| OR5A1 | 13721 | 36816 | 59911 |
| OR5A2 | 13722 | 36817 | 59912 |
| OR5AC2 | 13723 | 36818 | 59913 |
| OR5AK2 | 13724 | 36819 | 59914 |
| OR5AL1 | 13725 | 36820 | 59915 |
| OR5AN1 | 13726 | 36821 | 59916 |
| OR5AP2 | 13727 | 36822 | 59917 |
| OR5AR1 | 13728 | 36823 | 59918 |
| OR5AS1 | 13729 | 36824 | 59919 |
| OR5AU1 | 13730 | 36825 | 59920 |
| OR5B12 | 13731 | 36826 | 59921 |
| OR5B17 | 13732 | 36827 | 59922 |
| OR5B2 | 13733 | 36828 | 59923 |
| OR5B21 | 13734 | 36829 | 59924 |
| OR5B3 | 13735 | 36830 | 59925 |
| OR5C1 | 13736 | 36831 | 59926 |
| OR5D13 | 13737 | 36832 | 59927 |
| OR5D14 | 13738 | 36833 | 59928 |
| OR5D16 | 13739 | 36834 | 59929 |
| OR5D18 | 13740 | 36835 | 59930 |
| OR5F1 | 13741 | 36836 | 59931 |
| OR5H15 | 13742 | 36837 | 59932 |
| OR5H2 | 13743 | 36838 | 59933 |
| OR5H6 | 13744 | 36839 | 59934 |
| OR5I1 | 13745 | 36840 | 59935 |
| OR5J2 | 13746 | 36841 | 59936 |
| OR5K1 | 13747 | 36842 | 59937 |
| OR5K2 | 13748 | 36843 | 59938 |
| OR5K3 | 13749 | 36844 | 59939 |
| OR5K4 | 13750 | 36845 | 59940 |
| OR5L1 | 13751 | 36846 | 59941 |
| OR5L2 | 13752 | 36847 | 59942 |
| OR5M1 | 13753 | 36848 | 59943 |
| OR5M10 | 13754 | 36849 | 59944 |
| OR5M11 | 13755 | 36850 | 59945 |
| OR5M3 | 13756 | 36851 | 59946 |
| OR5M8 | 13757 | 36852 | 59947 |
| OR5M9 | 13758 | 36853 | 59948 |
| OR5P2 | 13759 | 36854 | 59949 |
| OR5R1 | 13760 | 36855 | 59950 |
| OR5T1 | 13761 | 36856 | 59951 |
| OR5T2 | 13762 | 36857 | 59952 |
| OR5T3 | 13763 | 36858 | 59953 |
| OR5V1 | 13764 | 36859 | 59954 |
| OR5W2 | 13765 | 36860 | 59955 |
| OR6A2 | 13766 | 36861 | 59956 |
| OR6B1 | 13767 | 36862 | 59957 |
| OR6B2 | 13768 | 36863 | 59958 |
| OR6B3 | 13769 | 36864 | 59959 |
| OR6C1 | 13770 | 36865 | 59960 |
| OR6C2 | 13771 | 36866 | 59961 |
| OR6C3 | 13772 | 36867 | 59962 |
| OR6C4 | 13773 | 36868 | 59963 |
| OR6C6 | 13774 | 36869 | 59964 |
| OR6C65 | 13775 | 36870 | 59965 |
| OR6C68 | 13776 | 36871 | 59966 |
| OR6C70 | 13777 | 36872 | 59967 |
| OR6C74 | 13778 | 36873 | 59968 |
| OR6C75 | 13779 | 36874 | 59969 |
| OR6C76 | 13780 | 36875 | 59970 |
| OR6F1 | 13781 | 36876 | 59971 |
| OR6J1 | 13782 | 36877 | 59972 |
| OR6K2 | 13783 | 36878 | 59973 |
| OR6K3 | 13784 | 36879 | 59974 |
| OR6K6 | 13785 | 36880 | 59975 |
| OR6M1 | 13786 | 36881 | 59976 |
| OR6N1 | 13787 | 36882 | 59977 |
| OR6N2 | 13788 | 36883 | 59978 |
| OR6P1 | 13789 | 36884 | 59979 |
| OR6Q1 | 13790 | 36885 | 59980 |
| OR6S1 | 13791 | 36886 | 59981 |
| OR6T1 | 13792 | 36887 | 59982 |
| OR6V1 | 13793 | 36888 | 59983 |
| OR6X1 | 13794 | 36889 | 59984 |
| OR6Y1 | 13795 | 36890 | 59985 |
| OR7A10 | 13796 | 36891 | 59986 |
| OR7A17 | 13797 | 36892 | 59987 |
| OR7A5 | 13798 | 36893 | 59988 |
| OR7C1 | 13799 | 36894 | 59989 |
| OR7C2 | 13800 | 36895 | 59990 |
| OR7D2 | 13801 | 36896 | 59991 |
| OR7D4 | 13802 | 36897 | 59992 |
| OR7E24 | 13803 | 36898 | 59993 |
| OR7G1 | 13804 | 36899 | 59994 |
| OR7G2 | 13805 | 36900 | 59995 |
| OR7G3 | 13806 | 36901 | 59996 |
| OR8A1 | 13807 | 36902 | 59997 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| OR8B12 | 13808 | 36903 | 59998 |
| OR8B3 | 13809 | 36904 | 59999 |
| OR8B4 | 13810 | 36905 | 60000 |
| OR8B8 | 13811 | 36906 | 60001 |
| OR8D1 | 13812 | 36907 | 60002 |
| OR8D2 | 13813 | 36908 | 60003 |
| OR8D4 | 13814 | 36909 | 60004 |
| OR8G1 | 13815 | 36910 | 60005 |
| OR8G2P | 13816 | 36911 | 60006 |
| OR8G5 | 13817 | 36912 | 60007 |
| OR8H3 | 13818 | 36913 | 60008 |
| OR8I2 | 13819 | 36914 | 60009 |
| OR8J1 | 13820 | 36915 | 60010 |
| OR8J3 | 13821 | 36916 | 60011 |
| OR8K1 | 13822 | 36917 | 60012 |
| OR8K3 | 13823 | 36918 | 60013 |
| OR8K5 | 13824 | 36919 | 60014 |
| OR8S1 | 13825 | 36920 | 60015 |
| OR8U8 | 13826 | 36921 | 60016 |
| OR8U9 | 13827 | 36922 | 60017 |
| OR9A2 | 13828 | 36923 | 60018 |
| OR9A4 | 13829 | 36924 | 60019 |
| OR9G4 | 13830 | 36925 | 60020 |
| OR9G9 | 13831 | 36926 | 60021 |
| OR9I1 | 13832 | 36927 | 60022 |
| OR9K2 | 13833 | 36928 | 60023 |
| OR9Q1 | 13834 | 36929 | 60024 |
| OR9Q2 | 13835 | 36930 | 60025 |
| ORAI1 | 13836 | 36931 | 60026 |
| ORAI2 | 13837 | 36932 | 60027 |
| ORAI2 | 13838 | 36933 | 60028 |
| ORAI3 | 13839 | 36934 | 60029 |
| ORAOV1 | 13840 | 36935 | 60030 |
| ORC1 | 13841 | 36936 | 60031 |
| ORC2 | 13842 | 36937 | 60032 |
| ORC3 | 13843 | 36938 | 60033 |
| ORC4 | 13844 | 36939 | 60034 |
| ORC5 | 13845 | 36940 | 60035 |
| ORC5 | 13846 | 36941 | 60036 |
| ORC6 | 13847 | 36942 | 60037 |
| ORM2 | 13848 | 36943 | 60038 |
| ORMDL1 | 13849 | 36944 | 60039 |
| ORMDL2 | 13850 | 36945 | 60040 |
| ORMDL3 | 13851 | 36946 | 60041 |
| OS9 | 13852 | 36947 | 60042 |
| OSBP | 13853 | 36948 | 60043 |
| OSBP2 | 13854 | 36949 | 60044 |
| OSBPL10 | 13855 | 36950 | 60045 |
| OSBPL11 | 13856 | 36951 | 60046 |
| OSBPL1A | 13857 | 36952 | 60047 |
| OSBPL2 | 13858 | 36953 | 60048 |
| OSBPL2 | 13859 | 36954 | 60049 |
| OSBPL3 | 13860 | 36955 | 60050 |
| OSBPL5 | 13861 | 36956 | 60051 |
| OSBPL6 | 13862 | 36957 | 60052 |
| OSBPL7 | 13863 | 36958 | 60053 |
| OSBPL8 | 13864 | 36959 | 60054 |
| OSBPL9 | 13865 | 36960 | 60055 |
| OSCAR | 13866 | 36961 | 60056 |
| OSCAR | 13867 | 36962 | 60057 |
| OSCP1 | 13868 | 36963 | 60058 |
| OSCP1 | 13869 | 36964 | 60059 |
| OSER1 | 13870 | 36965 | 60060 |
| OSGEP | 13871 | 36966 | 60061 |
| OSGEPL1 | 13872 | 36967 | 60062 |
| OSGIN1 | 13873 | 36968 | 60063 |
| OSGIN2 | 13874 | 36969 | 60064 |
| OSM | 13875 | 36970 | 60065 |
| OSMR | 13876 | 36971 | 60066 |
| OSMR | 13877 | 36972 | 60067 |
| OSMR | 13878 | 36973 | 60068 |
| OSR1 | 13879 | 36974 | 60069 |
| OSR2 | 13880 | 36975 | 60070 |
| OSR2 | 13881 | 36976 | 60071 |
| OST4 | 13882 | 36977 | 60072 |
| OSTC | 13883 | 36978 | 60073 |
| OSTC | 13884 | 36979 | 60074 |
| OSTC | 13885 | 36980 | 60075 |
| OSTF1 | 13886 | 36981 | 60076 |
| OSTM1 | 13887 | 36982 | 60077 |
| OSTN | 13888 | 36983 | 60078 |
| OTC | 13889 | 36984 | 60079 |
| OTOA | 13890 | 36985 | 60080 |
| OTOF | 13891 | 36986 | 60081 |
| OTOF | 13892 | 36987 | 60082 |
| OTOG | 13893 | 36988 | 60083 |
| OTOGL | 13894 | 36989 | 60084 |
| OTOL1 | 13895 | 36990 | 60085 |
| OTOP1 | 13896 | 36991 | 60086 |
| OTOP2 | 13897 | 36992 | 60087 |
| OTOP3 | 13898 | 36993 | 60088 |
| OTOR | 13899 | 36994 | 60089 |
| OTOS | 13900 | 36995 | 60090 |
| OTP | 13901 | 36996 | 60091 |
| OTUB1 | 13902 | 36997 | 60092 |
| OTUB2 | 13903 | 36998 | 60093 |
| OTUD1 | 13904 | 36999 | 60094 |
| OTUD3 | 13905 | 37000 | 60095 |
| OTUD4 | 13906 | 37001 | 60096 |
| OTUD4 | 13907 | 37002 | 60097 |
| OTUD5 | 13908 | 37003 | 60098 |
| OTUD6A | 13909 | 37004 | 60099 |
| OTUD6B | 13910 | 37005 | 60100 |
| OTUD7A | 13911 | 37006 | 60101 |
| OTUD7A | 13912 | 37007 | 60102 |
| OTUD7B | 13913 | 37008 | 60103 |
| OTULIN | 13914 | 37009 | 60104 |
| OTX1 | 13915 | 37010 | 60105 |
| OTX2 | 13916 | 37011 | 60106 |
| OVCA2 | 13917 | 37012 | 60107 |
| OVCH1 | 13918 | 37013 | 60108 |
| OVCH2 | 13919 | 37014 | 60109 |
| OVGP1 | 13920 | 37015 | 60110 |
| OVOL1 | 13921 | 37016 | 60111 |
| OVOL2 | 13922 | 37017 | 60112 |
| OVOL3 | 13923 | 37018 | 60113 |
| OXA1L | 13924 | 37019 | 60114 |
| OXCT1 | 13925 | 37020 | 60115 |
| OXCT2 | 13926 | 37021 | 60116 |
| OXER1 | 13927 | 37022 | 60117 |
| OXGR1 | 13928 | 37023 | 60118 |
| OXLD1 | 13929 | 37024 | 60119 |
| OXLD1 | 13930 | 37025 | 60120 |
| OXNAD1 | 13931 | 37026 | 60121 |
| OXR1 | 13932 | 37027 | 60122 |
| OXSM | 13933 | 37028 | 60123 |
| OXSR1 | 13934 | 37029 | 60124 |
| OXT | 13935 | 37030 | 60125 |
| OXTR | 13936 | 37031 | 60126 |
| P2RX1 | 13937 | 37032 | 60127 |
| P2RX2 | 13938 | 37033 | 60128 |
| P2RX2 | 13939 | 37034 | 60129 |
| P2RX3 | 13940 | 37035 | 60130 |
| P2RX4 | 13941 | 37036 | 60131 |
| P2RX4 | 13942 | 37037 | 60132 |
| P2RX5 | 13943 | 37038 | 60133 |
| P2RX6 | 13944 | 37039 | 60134 |
| P2RX6 | 13945 | 37040 | 60135 |
| P2RX7 | 13946 | 37041 | 60136 |
| P2RY1 | 13947 | 37042 | 60137 |
| P2RY10 | 13948 | 37043 | 60138 |
| P2RY11 | 13949 | 37044 | 60139 |
| P2RY12 | 13950 | 37045 | 60140 |
| P2RY13 | 13951 | 37046 | 60141 |
| P2RY14 | 13952 | 37047 | 60142 |
| P2RY2 | 13953 | 37048 | 60143 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| P2RY4 | 13954 | 37049 | 60144 |
| P2RY6 | 13955 | 37050 | 60145 |
| P2RY8 | 13956 | 37051 | 60146 |
| P3H1 | 13957 | 37052 | 60147 |
| P3H1 | 13958 | 37053 | 60148 |
| P3H1 | 13959 | 37054 | 60149 |
| P3H2 | 13960 | 37055 | 60150 |
| P3H3 | 13961 | 37056 | 60151 |
| P3H4 | 13962 | 37057 | 60152 |
| P4HA1 | 13963 | 37058 | 60153 |
| P4HA2 | 13964 | 37059 | 60154 |
| P4HA3 | 13965 | 37060 | 60155 |
| P4HA3 | 13966 | 37061 | 60156 |
| P4HB | 13967 | 37062 | 60157 |
| P4HTM | 13968 | 37063 | 60158 |
| PA2G4 | 13969 | 37064 | 60159 |
| PAAF1 | 13970 | 37065 | 60160 |
| PABPC1 | 13971 | 37066 | 60161 |
| PABPC1L | 13972 | 37067 | 60162 |
| PABPC1L2A | 13973 | 37068 | 60163 |
| PABPC3 | 13974 | 37069 | 60164 |
| PABPC4 | 13975 | 37070 | 60165 |
| PABPC4L | 13976 | 37071 | 60166 |
| PABPC5 | 13977 | 37072 | 60167 |
| PABPN1 | 13978 | 37073 | 60168 |
| PABPN1L | 13979 | 37074 | 60169 |
| PABPN1L | 13980 | 37075 | 60170 |
| PACRG | 13981 | 37076 | 60171 |
| PACRGL | 13982 | 37077 | 60172 |
| PACRGL | 13983 | 37078 | 60173 |
| PACS1 | 13984 | 37079 | 60174 |
| PACS2 | 13985 | 37080 | 60175 |
| PACSIN1 | 13986 | 37081 | 60176 |
| PACSIN2 | 13987 | 37082 | 60177 |
| PACSIN3 | 13988 | 37083 | 60178 |
| PADI1 | 13989 | 37084 | 60179 |
| PADI2 | 13990 | 37085 | 60180 |
| PADI3 | 13991 | 37086 | 60181 |
| PADI4 | 13992 | 37087 | 60182 |
| PADI6 | 13993 | 37088 | 60183 |
| PAEP | 13994 | 37089 | 60184 |
| PAEP | 13995 | 37090 | 60185 |
| PAF1 | 13996 | 37091 | 60186 |
| PAF1 | 13997 | 37092 | 60187 |
| PAFAH1B1 | 13998 | 37093 | 60188 |
| PAFAH1B2 | 13999 | 37094 | 60189 |
| PAFAH1B2 | 14000 | 37095 | 60190 |
| PAFAH1B2 | 14001 | 37096 | 60191 |
| PAFAH1B2 | 14002 | 37097 | 60192 |
| PAFAH1B3 | 14003 | 37098 | 60193 |
| PAFAH2 | 14004 | 37099 | 60194 |
| PAG1 | 14005 | 37100 | 60195 |
| PAGE1 | 14006 | 37101 | 60196 |
| PAGE2 | 14007 | 37102 | 60197 |
| PAGE3 | 14008 | 37103 | 60198 |
| PAGE4 | 14009 | 37104 | 60199 |
| PAGE5 | 14010 | 37105 | 60200 |
| PAGR1 | 14011 | 37106 | 60201 |
| PAH | 14012 | 37107 | 60202 |
| PAICS | 14013 | 37108 | 60203 |
| PAIP1 | 14014 | 37109 | 60204 |
| PAIP2 | 14015 | 37110 | 60205 |
| PAIP2B | 14016 | 37111 | 60206 |
| PAK1 | 14017 | 37112 | 60207 |
| PAK1IP1 | 14018 | 37113 | 60208 |
| PAK2 | 14019 | 37114 | 60209 |
| PAK3 | 14020 | 37115 | 60210 |
| PAK4 | 14021 | 37116 | 60211 |
| PAK5 | 14022 | 37117 | 60212 |
| PAK6 | 14023 | 37118 | 60213 |
| PAK6 | 14024 | 37119 | 60214 |
| PALB2 | 14025 | 37120 | 60215 |
| PALD1 | 14026 | 37121 | 60216 |
| PALLD | 14027 | 37122 | 60217 |
| PALLD | 14028 | 37123 | 60218 |
| PALM | 14029 | 37124 | 60219 |
| PALM2 | 14030 | 37125 | 60220 |
| PALM2-AKAP2 | 14031 | 37126 | 60221 |
| PALM3 | 14032 | 37127 | 60222 |
| PALMD | 14033 | 37128 | 60223 |
| PAM | 14034 | 37129 | 60224 |
| PAM16 | 14035 | 37130 | 60225 |
| PAMR1 | 14036 | 37131 | 60226 |
| PAN2 | 14037 | 37132 | 60227 |
| PAN3 | 14038 | 37133 | 60228 |
| PANK1 | 14039 | 37134 | 60229 |
| PANK2 | 14040 | 37135 | 60230 |
| PANK2 | 14041 | 37136 | 60231 |
| PANK3 | 14042 | 37137 | 60232 |
| PANK4 | 14043 | 37138 | 60233 |
| PANO1 | 14044 | 37139 | 60234 |
| PANX1 | 14045 | 37140 | 60235 |
| PANX2 | 14046 | 37141 | 60236 |
| PANX2 | 14047 | 37142 | 60237 |
| PANX3 | 14048 | 37143 | 60238 |
| PAOX | 14049 | 37144 | 60239 |
| PAOX | 14050 | 37145 | 60240 |
| PAOX | 14051 | 37146 | 60241 |
| PAPD4 | 14052 | 37147 | 60242 |
| PAPD5 | 14053 | 37148 | 60243 |
| PAPD7 | 14054 | 37149 | 60244 |
| PAPLN | 14055 | 37150 | 60245 |
| PAPOLA | 14056 | 37151 | 60246 |
| PAPOLA | 14057 | 37152 | 60247 |
| PAPOLA | 14058 | 37153 | 60248 |
| PAPOLB | 14059 | 37154 | 60249 |
| PAPOLG | 14060 | 37155 | 60250 |
| PAPPA | 14061 | 37156 | 60251 |
| PAPPA2 | 14062 | 37157 | 60252 |
| PAPPA2 | 14063 | 37158 | 60253 |
| PAPSS1 | 14064 | 37159 | 60254 |
| PAPSS2 | 14065 | 37160 | 60255 |
| PAQR3 | 14066 | 37161 | 60256 |
| PAQR4 | 14067 | 37162 | 60257 |
| PAQR5 | 14068 | 37163 | 60258 |
| PAQR6 | 14069 | 37164 | 60259 |
| PAQR6 | 14070 | 37165 | 60260 |
| PAQR7 | 14071 | 37166 | 60261 |
| PAQR8 | 14072 | 37167 | 60262 |
| PAQR9 | 14073 | 37168 | 60263 |
| PARD3 | 14074 | 37169 | 60264 |
| PARD3 | 14075 | 37170 | 60265 |
| PARD3B | 14076 | 37171 | 60266 |
| PARD6A | 14077 | 37172 | 60267 |
| PARD6B | 14078 | 37173 | 60268 |
| PARD6G | 14079 | 37174 | 60269 |
| PARG | 14080 | 37175 | 60270 |
| PARK7 | 14081 | 37176 | 60271 |
| PARL | 14082 | 37177 | 60272 |
| PARL | 14083 | 37178 | 60273 |
| PARM1 | 14084 | 37179 | 60274 |
| PARN | 14085 | 37180 | 60275 |
| PARP1 | 14086 | 37181 | 60276 |
| PARP10 | 14087 | 37182 | 60277 |
| PARP11 | 14088 | 37183 | 60278 |
| PARP12 | 14089 | 37184 | 60279 |
| PARP14 | 14090 | 37185 | 60280 |
| PARP15 | 14091 | 37186 | 60281 |
| PARP16 | 14092 | 37187 | 60282 |
| PARP2 | 14093 | 37188 | 60283 |
| PARP3 | 14094 | 37189 | 60284 |
| PARP4 | 14095 | 37190 | 60285 |
| PARP6 | 14096 | 37191 | 60286 |
| PARP8 | 14097 | 37192 | 60287 |
| PARP9 | 14098 | 37193 | 60288 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| PARP9 | 14099 | 37194 | 60289 |
| PARPBP | 14100 | 37195 | 60290 |
| PARPBP | 14101 | 37196 | 60291 |
| PARPBP | 14102 | 37197 | 60292 |
| PARS2 | 14103 | 37198 | 60293 |
| PARVA | 14104 | 37199 | 60294 |
| PARVB | 14105 | 37200 | 60295 |
| PARVG | 14106 | 37201 | 60296 |
| PASD1 | 14107 | 37202 | 60297 |
| PASK | 14108 | 37203 | 60298 |
| PASK | 14109 | 37204 | 60299 |
| PATE1 | 14110 | 37205 | 60300 |
| PATE2 | 14111 | 37206 | 60301 |
| PATE3 | 14112 | 37207 | 60302 |
| PATE4 | 14113 | 37208 | 60303 |
| PATJ | 14114 | 37209 | 60304 |
| PATJ | 14115 | 37210 | 60305 |
| PATL1 | 14116 | 37211 | 60306 |
| PATL2 | 14117 | 37212 | 60307 |
| PATZ1 | 14118 | 37213 | 60308 |
| PATZ1 | 14119 | 37214 | 60309 |
| PATZ1 | 14120 | 37215 | 60310 |
| PAWR | 14121 | 37216 | 60311 |
| PAX1 | 14122 | 37217 | 60312 |
| PAX1 | 14123 | 37218 | 60313 |
| PAX2 | 14124 | 37219 | 60314 |
| PAX2 | 14125 | 37220 | 60315 |
| PAX2 | 14126 | 37221 | 60316 |
| PAX3 | 14127 | 37222 | 60317 |
| PAX3 | 14128 | 37223 | 60318 |
| PAX3 | 14129 | 37224 | 60319 |
| PAX3 | 14130 | 37225 | 60320 |
| PAX3 | 14131 | 37226 | 60321 |
| PAX3 | 14132 | 37227 | 60322 |
| PAX4 | 14133 | 37228 | 60323 |
| PAX5 | 14134 | 37229 | 60324 |
| PAX5 | 14135 | 37230 | 60325 |
| PAX6 | 14136 | 37231 | 60326 |
| PAX6 | 14137 | 37232 | 60327 |
| PAX7 | 14138 | 37233 | 60328 |
| PAX7 | 14139 | 37234 | 60329 |
| PAX8 | 14140 | 37235 | 60330 |
| PAX8 | 14141 | 37236 | 60331 |
| PAX9 | 14142 | 37237 | 60332 |
| PAXBP1 | 14143 | 37238 | 60333 |
| PAXBP1 | 14144 | 37239 | 60334 |
| PAXIP1 | 14145 | 37240 | 60335 |
| PAXX | 14146 | 37241 | 60336 |
| PAXX | 14147 | 37242 | 60337 |
| PBDC1 | 14148 | 37243 | 60338 |
| PBDC1 | 14149 | 37244 | 60339 |
| PBK | 14150 | 37245 | 60340 |
| PBLD | 14151 | 37246 | 60341 |
| PBLD | 14152 | 37247 | 60342 |
| PBOV1 | 14153 | 37248 | 60343 |
| PBRM1 | 14154 | 37249 | 60344 |
| PBX1 | 14155 | 37250 | 60345 |
| PBX1 | 14156 | 37251 | 60346 |
| PBX1 | 14157 | 37252 | 60347 |
| PBX2 | 14158 | 37253 | 60348 |
| PBX3 | 14159 | 37254 | 60349 |
| PBX3 | 14160 | 37255 | 60350 |
| PBX4 | 14161 | 37256 | 60351 |
| PBXIP1 | 14162 | 37257 | 60352 |
| PC | 14163 | 37258 | 60353 |
| PCBD1 | 14164 | 37259 | 60354 |
| PCBD1 | 14165 | 37260 | 60355 |
| PCBD2 | 14166 | 37261 | 60356 |
| PCBP1 | 14167 | 37262 | 60357 |
| PCBP2 | 14168 | 37263 | 60358 |
| PCBP3 | 14169 | 37264 | 60359 |
| PCBP4 | 14170 | 37265 | 60360 |
| PCCA | 14171 | 37266 | 60361 |
| PCCA | 14172 | 37267 | 60362 |
| PCCB | 14173 | 37268 | 60363 |
| PCDH1 | 14174 | 37269 | 60364 |
| PCDH1 | 14175 | 37270 | 60365 |
| PCDH10 | 14176 | 37271 | 60366 |
| PCDH10 | 14177 | 37272 | 60367 |
| PCDH11X | 14178 | 37273 | 60368 |
| PCDH11X | 14179 | 37274 | 60369 |
| PCDH11Y | 14180 | 37275 | 60370 |
| PCDH11Y | 14181 | 37276 | 60371 |
| PCDH12 | 14182 | 37277 | 60372 |
| PCDH15 | 14183 | 37278 | 60373 |
| PCDH15 | 14184 | 37279 | 60374 |
| PCDH15 | 14185 | 37280 | 60375 |
| PCDH15 | 14186 | 37281 | 60376 |
| PCDH17 | 14187 | 37282 | 60377 |
| PCDH18 | 14188 | 37283 | 60378 |
| PCDH19 | 14189 | 37284 | 60379 |
| PCDH20 | 14190 | 37285 | 60380 |
| PCDH7 | 14191 | 37286 | 60381 |
| PCDH7 | 14192 | 37287 | 60382 |
| PCDH7 | 14193 | 37288 | 60383 |
| PCDH8 | 14194 | 37289 | 60384 |
| PCDH9 | 14195 | 37290 | 60385 |
| PCDH9 | 14196 | 37291 | 60386 |
| PCDHA1 | 14197 | 37292 | 60387 |
| PCDHA10 | 14198 | 37293 | 60388 |
| PCDHA11 | 14199 | 37294 | 60389 |
| PCDHA12 | 14200 | 37295 | 60390 |
| PCDHA13 | 14201 | 37296 | 60391 |
| PCDHA2 | 14202 | 37297 | 60392 |
| PCDHA2 | 14203 | 37298 | 60393 |
| PCDHA3 | 14204 | 37299 | 60394 |
| PCDHA4 | 14205 | 37300 | 60395 |
| PCDHA5 | 14206 | 37301 | 60396 |
| PCDHA6 | 14207 | 37302 | 60397 |
| PCDHA7 | 14208 | 37303 | 60398 |
| PCDHA8 | 14209 | 37304 | 60399 |
| PCDHA9 | 14210 | 37305 | 60400 |
| PCDHAC1 | 14211 | 37306 | 60401 |
| PCDHAC1 | 14212 | 37307 | 60402 |
| PCDHAC2 | 14213 | 37308 | 60403 |
| PCDHB1 | 14214 | 37309 | 60404 |
| PCDHB10 | 14215 | 37310 | 60405 |
| PCDHB11 | 14216 | 37311 | 60406 |
| PCDHB12 | 14217 | 37312 | 60407 |
| PCDHB13 | 14218 | 37313 | 60408 |
| PCDHB14 | 14219 | 37314 | 60409 |
| PCDHB15 | 14220 | 37315 | 60410 |
| PCDHB16 | 14221 | 37316 | 60411 |
| PCDHB3 | 14222 | 37317 | 60412 |
| PCDHB4 | 14223 | 37318 | 60413 |
| PCDHB5 | 14224 | 37319 | 60414 |
| PCDHB6 | 14225 | 37320 | 60415 |
| PCDHB7 | 14226 | 37321 | 60416 |
| PCDHB8 | 14227 | 37322 | 60417 |
| PCDHB9 | 14228 | 37323 | 60418 |
| PCDHGA1 | 14229 | 37324 | 60419 |
| PCDHGA10 | 14230 | 37325 | 60420 |
| PCDHGA11 | 14231 | 37326 | 60421 |
| PCDHGA12 | 14232 | 37327 | 60422 |
| PCDHGA2 | 14233 | 37328 | 60423 |
| PCDHGA3 | 14234 | 37329 | 60424 |
| PCDHGA3 | 14235 | 37330 | 60425 |
| PCDHGA4 | 14236 | 37331 | 60426 |
| PCDHGA5 | 14237 | 37332 | 60427 |
| PCDHGA6 | 14238 | 37333 | 60428 |
| PCDHGA7 | 14239 | 37334 | 60429 |
| PCDHGA8 | 14240 | 37335 | 60430 |
| PCDHGA9 | 14241 | 37336 | 60431 |
| PCDHGB1 | 14242 | 37337 | 60432 |
| PCDHGB2 | 14243 | 37338 | 60433 |
| PCDHGB3 | 14244 | 37339 | 60434 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| PCDHGB4 | 14245 | 37340 | 60435 |
| PCDHGB5 | 14246 | 37341 | 60436 |
| PCDHGB6 | 14247 | 37342 | 60437 |
| PCDHGB7 | 14248 | 37343 | 60438 |
| PCDHGC3 | 14249 | 37344 | 60439 |
| PCDHGC4 | 14250 | 37345 | 60440 |
| PCDHGC5 | 14251 | 37346 | 60441 |
| PCED1A | 14252 | 37347 | 60442 |
| PCED1B | 14253 | 37348 | 60443 |
| PCF11 | 14254 | 37349 | 60444 |
| PCGF1 | 14255 | 37350 | 60445 |
| PCGF2 | 14256 | 37351 | 60446 |
| PCGF3 | 14257 | 37352 | 60447 |
| PCGF5 | 14258 | 37353 | 60448 |
| PCGF6 | 14259 | 37354 | 60449 |
| PCID2 | 14260 | 37355 | 60450 |
| PCID2 | 14261 | 37356 | 60451 |
| PCID2 | 14262 | 37357 | 60452 |
| PCIF1 | 14263 | 37358 | 60453 |
| PCK1 | 14264 | 37359 | 60454 |
| PCK2 | 14265 | 37360 | 60455 |
| PCK2 | 14266 | 37361 | 60456 |
| PCLAF | 14267 | 37362 | 60457 |
| PCLO | 14268 | 37363 | 60458 |
| PCLO | 14269 | 37364 | 60459 |
| PCM1 | 14270 | 37365 | 60460 |
| PCM1 | 14271 | 37366 | 60461 |
| PCM1 | 14272 | 37367 | 60462 |
| PCMT1 | 14273 | 37368 | 60463 |
| PCMT1 | 14274 | 37369 | 60464 |
| PCMTD1 | 14275 | 37370 | 60465 |
| PCMTD2 | 14276 | 37371 | 60466 |
| PCNA | 14277 | 37372 | 60467 |
| PCNP | 14278 | 37373 | 60468 |
| PCNP | 14279 | 37374 | 60469 |
| PCNT | 14280 | 37375 | 60470 |
| PCNX1 | 14281 | 37376 | 60471 |
| PCNX2 | 14282 | 37377 | 60472 |
| PCNX2 | 14283 | 37378 | 60473 |
| PCNX3 | 14284 | 37379 | 60474 |
| PCNX4 | 14285 | 37380 | 60475 |
| PCOLCE | 14286 | 37381 | 60476 |
| PCOLCE2 | 14287 | 37382 | 60477 |
| PCOTH | 14288 | 37383 | 60478 |
| PCP2 | 14289 | 37384 | 60479 |
| PCP4 | 14290 | 37385 | 60480 |
| PCP4L1 | 14291 | 37386 | 60481 |
| PCSK1 | 14292 | 37387 | 60482 |
| PCSK1N | 14293 | 37388 | 60483 |
| PCSK2 | 14294 | 37389 | 60484 |
| PCSK4 | 14295 | 37390 | 60485 |
| PCSK5 | 14296 | 37391 | 60486 |
| PCSK5 | 14297 | 37392 | 60487 |
| PCSK6 | 14298 | 37393 | 60488 |
| PCSK6 | 14299 | 37394 | 60489 |
| PCSK6 | 14300 | 37395 | 60490 |
| PCSK6 | 14301 | 37396 | 60491 |
| PCSK6 | 14302 | 37397 | 60492 |
| PCSK7 | 14303 | 37398 | 60493 |
| PCSK9 | 14304 | 37399 | 60494 |
| PCTP | 14305 | 37400 | 60495 |
| PCTP | 14306 | 37401 | 60496 |
| PCTP | 14307 | 37402 | 60497 |
| PCYOX1 | 14308 | 37403 | 60498 |
| PCYOX1L | 14309 | 37404 | 60499 |
| PCYT1A | 14310 | 37405 | 60500 |
| PCYT1B | 14311 | 37406 | 60501 |
| PCYT1B | 14312 | 37407 | 60502 |
| PCYT2 | 14313 | 37408 | 60503 |
| PDAP1 | 14314 | 37409 | 60504 |
| PDC | 14315 | 37410 | 60505 |
| PDCD1 | 14316 | 37411 | 60506 |
| PDCD10 | 14317 | 37412 | 60507 |
| PDCD11 | 14318 | 37413 | 60508 |
| PDCD1LG2 | 14319 | 37414 | 60509 |
| PDCD2 | 14320 | 37415 | 60510 |
| PDCD2 | 14321 | 37416 | 60511 |
| PDCD2 | 14322 | 37417 | 60512 |
| PDCD2L | 14323 | 37418 | 60513 |
| PDCD4 | 14324 | 37419 | 60514 |
| PDCD5 | 14325 | 37420 | 60515 |
| PDCD6 | 14326 | 37421 | 60516 |
| PDCD6 | 14327 | 37422 | 60517 |
| PDCD6IP | 14328 | 37423 | 60518 |
| PDCD6IP | 14329 | 37424 | 60519 |
| PDCD7 | 14330 | 37425 | 60520 |
| PDCL | 14331 | 37426 | 60521 |
| PDCL2 | 14332 | 37427 | 60522 |
| PDCL3 | 14333 | 37428 | 60523 |
| PDE10A | 14334 | 37429 | 60524 |
| PDE11A | 14335 | 37430 | 60525 |
| PDE12 | 14336 | 37431 | 60526 |
| PDE12 | 14337 | 37432 | 60527 |
| PDE12 | 14338 | 37433 | 60528 |
| PDE1A | 14339 | 37434 | 60529 |
| PDE1A | 14340 | 37435 | 60530 |
| PDE1B | 14341 | 37436 | 60531 |
| PDE1C | 14342 | 37437 | 60532 |
| PDE1C | 14343 | 37438 | 60533 |
| PDE2A | 14344 | 37439 | 60534 |
| PDE3A | 14345 | 37440 | 60535 |
| PDE3B | 14346 | 37441 | 60536 |
| PDE4A | 14347 | 37442 | 60537 |
| PDE4B | 14348 | 37443 | 60538 |
| PDE4C | 14349 | 37444 | 60539 |
| PDE4D | 14350 | 37445 | 60540 |
| PDE4DIP | 14351 | 37446 | 60541 |
| PDE4DIP | 14352 | 37447 | 60542 |
| PDE4DIP | 14353 | 37448 | 60543 |
| PDE4DIP | 14354 | 37449 | 60544 |
| PDE5A | 14355 | 37450 | 60545 |
| PDE6A | 14356 | 37451 | 60546 |
| PDE6B | 14357 | 37452 | 60547 |
| PDE6B | 14358 | 37453 | 60548 |
| PDE6C | 14359 | 37454 | 60549 |
| PDE6D | 14360 | 37455 | 60550 |
| PDE6D | 14361 | 37456 | 60551 |
| PDE6G | 14362 | 37457 | 60552 |
| PDE6H | 14363 | 37458 | 60553 |
| PDE7A | 14364 | 37459 | 60554 |
| PDE7B | 14365 | 37460 | 60555 |
| PDE8A | 14366 | 37461 | 60556 |
| PDE8B | 14367 | 37462 | 60557 |
| PDE8B | 14368 | 37463 | 60558 |
| PDE9A | 14369 | 37464 | 60559 |
| PDF | 14370 | 37465 | 60560 |
| PDGFA | 14371 | 37466 | 60561 |
| PDGFA | 14372 | 37467 | 60562 |
| PDGFB | 14373 | 37468 | 60563 |
| PDGFC | 14374 | 37469 | 60564 |
| PDGFD | 14375 | 37470 | 60565 |
| PDGFRA | 14376 | 37471 | 60566 |
| PDGFRA | 14377 | 37472 | 60567 |
| PDGFRB | 14378 | 37473 | 60568 |
| PDGFRL | 14379 | 37474 | 60569 |
| PDHA1 | 14380 | 37475 | 60570 |
| PDHA2 | 14381 | 37476 | 60571 |
| PDHB | 14382 | 37477 | 60572 |
| PDHX | 14383 | 37478 | 60573 |
| PDIA2 | 14384 | 37479 | 60574 |
| PDIA3 | 14385 | 37480 | 60575 |
| PDIA4 | 14386 | 37481 | 60576 |
| PDIA5 | 14387 | 37482 | 60577 |
| PDIA6 | 14388 | 37483 | 60578 |
| PDIK1L | 14389 | 37484 | 60579 |
| PDILT | 14390 | 37485 | 60580 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| PDK1 | 14391 | 37486 | 60581 |
| PDK2 | 14392 | 37487 | 60582 |
| PDK2 | 14393 | 37488 | 60583 |
| PDK3 | 14394 | 37489 | 60584 |
| PDK4 | 14395 | 37490 | 60585 |
| PDLIM1 | 14396 | 37491 | 60586 |
| PDLIM2 | 14397 | 37492 | 60587 |
| PDLIM2 | 14398 | 37493 | 60588 |
| PDLIM2 | 14399 | 37494 | 60589 |
| PDLIM3 | 14400 | 37495 | 60590 |
| PDLIM4 | 14401 | 37496 | 60591 |
| PDLIM4 | 14402 | 37497 | 60592 |
| PDLIM5 | 14403 | 37498 | 60593 |
| PDLIM5 | 14404 | 37499 | 60594 |
| PDLIM5 | 14405 | 37500 | 60595 |
| PDLIM5 | 14406 | 37501 | 60596 |
| PDLIM7 | 14407 | 37502 | 60597 |
| PDLIM7 | 14408 | 37503 | 60598 |
| PDP1 | 14409 | 37504 | 60599 |
| PDP2 | 14410 | 37505 | 60600 |
| PDPK1 | 14411 | 37506 | 60601 |
| PDPK1 | 14412 | 37507 | 60602 |
| PDPN | 14413 | 37508 | 60603 |
| PDPR | 14414 | 37509 | 60604 |
| PDRG1 | 14415 | 37510 | 60605 |
| PDS5A | 14416 | 37511 | 60606 |
| PDS5A | 14417 | 37512 | 60607 |
| PDS5B | 14418 | 37513 | 60608 |
| PDSS1 | 14419 | 37514 | 60609 |
| PDSS1 | 14420 | 37515 | 60610 |
| PDSS2 | 14421 | 37516 | 60611 |
| PDX1 | 14422 | 37517 | 60612 |
| PDXDC1 | 14423 | 37518 | 60613 |
| PDXDC1 | 14424 | 37519 | 60614 |
| PDXDC1 | 14425 | 37520 | 60615 |
| PDXK | 14426 | 37521 | 60616 |
| PDXP | 14427 | 37522 | 60617 |
| PDYN | 14428 | 37523 | 60618 |
| PDZD11 | 14429 | 37524 | 60619 |
| PDZD2 | 14430 | 37525 | 60620 |
| PDZD3 | 14431 | 37526 | 60621 |
| PDZD4 | 14432 | 37527 | 60622 |
| PDZD7 | 14433 | 37528 | 60623 |
| PDZD7 | 14434 | 37529 | 60624 |
| PDZD7 | 14435 | 37530 | 60625 |
| PDZD8 | 14436 | 37531 | 60626 |
| PDZD9 | 14437 | 37532 | 60627 |
| PDZK1 | 14438 | 37533 | 60628 |
| PDZK1IP1 | 14439 | 37534 | 60629 |
| PDZRN3 | 14440 | 37535 | 60630 |
| PDZRN4 | 14441 | 37536 | 60631 |
| PEA15 | 14442 | 37537 | 60632 |
| PEAK1 | 14443 | 37538 | 60633 |
| PEAK3 | 14444 | 37539 | 60634 |
| PEAR1 | 14445 | 37540 | 60635 |
| PEBP1 | 14446 | 37541 | 60636 |
| PEBP4 | 14447 | 37542 | 60637 |
| PECAM1 | 14448 | 37543 | 60638 |
| PECR | 14449 | 37544 | 60639 |
| PEF1 | 14450 | 37545 | 60640 |
| PEG10 | 14451 | 37546 | 60641 |
| PEG10 | 14452 | 37547 | 60642 |
| PEG3 | 14453 | 37548 | 60643 |
| PELI1 | 14454 | 37549 | 60644 |
| PELI2 | 14455 | 37550 | 60645 |
| PELI3 | 14456 | 37551 | 60646 |
| PELO | 14457 | 37552 | 60647 |
| PELP1 | 14458 | 37553 | 60648 |
| PEMT | 14459 | 37554 | 60649 |
| PEMT | 14460 | 37555 | 60650 |
| PENK | 14461 | 37556 | 60651 |
| PEPD | 14462 | 37557 | 60652 |
| PER1 | 14463 | 37558 | 60653 |
| PER2 | 14464 | 37559 | 60654 |
| PER3 | 14465 | 37560 | 60655 |
| PERM1 | 14466 | 37561 | 60656 |
| PERP | 14467 | 37562 | 60657 |
| PES1 | 14468 | 37563 | 60658 |
| PET100 | 14469 | 37564 | 60659 |
| PET117 | 14470 | 37565 | 60660 |
| PEX1 | 14471 | 37566 | 60661 |
| PEX10 | 14472 | 37567 | 60662 |
| PEX11A | 14473 | 37568 | 60663 |
| PEX11B | 14474 | 37569 | 60664 |
| PEX11G | 14475 | 37570 | 60665 |
| PEX12 | 14476 | 37571 | 60666 |
| PEX13 | 14477 | 37572 | 60667 |
| PEX14 | 14478 | 37573 | 60668 |
| PEX16 | 14479 | 37574 | 60669 |
| PEX16 | 14480 | 37575 | 60670 |
| PEX19 | 14481 | 37576 | 60671 |
| PEX2 | 14482 | 37577 | 60672 |
| PEX26 | 14483 | 37578 | 60673 |
| PEX3 | 14484 | 37579 | 60674 |
| PEX5 | 14485 | 37580 | 60675 |
| PEX5L | 14486 | 37581 | 60676 |
| PEX6 | 14487 | 37582 | 60677 |
| PEX7 | 14488 | 37583 | 60678 |
| PF4 | 14489 | 37584 | 60679 |
| PF4V1 | 14490 | 37585 | 60680 |
| PFAS | 14491 | 37586 | 60681 |
| PFDN1 | 14492 | 37587 | 60682 |
| PFDN2 | 14493 | 37588 | 60683 |
| PFDN4 | 14494 | 37589 | 60684 |
| PFDN5 | 14495 | 37590 | 60685 |
| PFDN6 | 14496 | 37591 | 60686 |
| PFKFB1 | 14497 | 37592 | 60687 |
| PFKFB2 | 14498 | 37593 | 60688 |
| PFKFB2 | 14499 | 37594 | 60689 |
| PFKFB3 | 14500 | 37595 | 60690 |
| PFKFB3 | 14501 | 37596 | 60691 |
| PFKFB4 | 14502 | 37597 | 60692 |
| PFKL | 14503 | 37598 | 60693 |
| PFKM | 14504 | 37599 | 60694 |
| PFKP | 14505 | 37600 | 60695 |
| PFN1 | 14506 | 37601 | 60696 |
| PFN2 | 14507 | 37602 | 60697 |
| PFN2 | 14508 | 37603 | 60698 |
| PFN3 | 14509 | 37604 | 60699 |
| PFN4 | 14510 | 37605 | 60700 |
| PGA3 | 14511 | 37606 | 60701 |
| PGA5 | 14512 | 37607 | 60702 |
| PGAM1 | 14513 | 37608 | 60703 |
| PGAM2 | 14514 | 37609 | 60704 |
| PGAM5 | 14515 | 37610 | 60705 |
| PGAM5 | 14516 | 37611 | 60706 |
| PGAP1 | 14517 | 37612 | 60707 |
| PGAP2 | 14518 | 37613 | 60708 |
| PGAP2 | 14519 | 37614 | 60709 |
| PGAP3 | 14520 | 37615 | 60710 |
| PGAP3 | 14521 | 37616 | 60711 |
| PGBD1 | 14522 | 37617 | 60712 |
| PGBD2 | 14523 | 37618 | 60713 |
| PGBD3 | 14524 | 37619 | 60714 |
| PGBD4 | 14525 | 37620 | 60715 |
| PGBD5 | 14526 | 37621 | 60716 |
| PGC | 14527 | 37622 | 60717 |
| PGC | 14528 | 37623 | 60718 |
| PGD | 14529 | 37624 | 60719 |
| PGF | 14530 | 37625 | 60720 |
| PGGHG | 14531 | 37626 | 60721 |
| PGGT1B | 14532 | 37627 | 60722 |
| PGK1 | 14533 | 37628 | 60723 |
| PGK2 | 14534 | 37629 | 60724 |
| PGLS | 14535 | 37630 | 60725 |
| PGLYRP1 | 14536 | 37631 | 60726 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| PGLYRP2 | 14537 | 37632 | 60727 |
| PGLYRP3 | 14538 | 37633 | 60728 |
| PGLYRP4 | 14539 | 37634 | 60729 |
| PGM1 | 14540 | 37635 | 60730 |
| PGM2 | 14541 | 37636 | 60731 |
| PGM2L1 | 14542 | 37637 | 60732 |
| PGM3 | 14543 | 37638 | 60733 |
| PGM3 | 14544 | 37639 | 60734 |
| PGM3 | 14545 | 37640 | 60735 |
| PGM5 | 14546 | 37641 | 60736 |
| PGP | 14547 | 37642 | 60737 |
| PGPEP1 | 14548 | 37643 | 60738 |
| PGPEP1 | 14549 | 37644 | 60739 |
| PGPEP1 | 14550 | 37645 | 60740 |
| PGPEP1 | 14551 | 37646 | 60741 |
| PGPEP1L | 14552 | 37647 | 60742 |
| PGR | 14553 | 37648 | 60743 |
| PGRMC1 | 14554 | 37649 | 60744 |
| PGRMC2 | 14555 | 37650 | 60745 |
| PGS1 | 14556 | 37651 | 60746 |
| PHACTR1 | 14557 | 37652 | 60747 |
| PHACTR2 | 14558 | 37653 | 60748 |
| PHACTR3 | 14559 | 37654 | 60749 |
| PHACTR4 | 14560 | 37655 | 60750 |
| PHAX | 14561 | 37656 | 60751 |
| PHB | 14562 | 37657 | 60752 |
| PHB2 | 14563 | 37658 | 60753 |
| PHC1 | 14564 | 37659 | 60754 |
| PHC2 | 14565 | 37660 | 60755 |
| PHC3 | 14566 | 37661 | 60756 |
| PHEX | 14567 | 37662 | 60757 |
| PHEX | 14568 | 37663 | 60758 |
| PHF1 | 14569 | 37664 | 60759 |
| PHF1 | 14570 | 37665 | 60760 |
| PHF10 | 14571 | 37666 | 60761 |
| PHF11 | 14572 | 37667 | 60762 |
| PHF12 | 14573 | 37668 | 60763 |
| PHF12 | 14574 | 37669 | 60764 |
| PHF12 | 14575 | 37670 | 60765 |
| PHF13 | 14576 | 37671 | 60766 |
| PHF14 | 14577 | 37672 | 60767 |
| PHF19 | 14578 | 37673 | 60768 |
| PHF19 | 14579 | 37674 | 60769 |
| PHF19 | 14580 | 37675 | 60770 |
| PHF2 | 14581 | 37676 | 60771 |
| PHF20 | 14582 | 37677 | 60772 |
| PHF20L1 | 14583 | 37678 | 60773 |
| PHF20L1 | 14584 | 37679 | 60774 |
| PHF21A | 14585 | 37680 | 60775 |
| PHF21B | 14586 | 37681 | 60776 |
| PHF23 | 14587 | 37682 | 60777 |
| PHF24 | 14588 | 37683 | 60778 |
| PHF3 | 14589 | 37684 | 60779 |
| PHF3 | 14590 | 37685 | 60780 |
| PHF5A | 14591 | 37686 | 60781 |
| PHF6 | 14592 | 37687 | 60782 |
| PHF6 | 14593 | 37688 | 60783 |
| PHF7 | 14594 | 37689 | 60784 |
| PHF8 | 14595 | 37690 | 60785 |
| PHF8 | 14596 | 37691 | 60786 |
| PHF8 | 14597 | 37692 | 60787 |
| PHGDH | 14598 | 37693 | 60788 |
| PHGR1 | 14599 | 37694 | 60789 |
| PHIP | 14600 | 37695 | 60790 |
| PHKA1 | 14601 | 37696 | 60791 |
| PHKA2 | 14602 | 37697 | 60792 |
| PHKB | 14603 | 37698 | 60793 |
| PHKG1 | 14604 | 37699 | 60794 |
| PHKG2 | 14605 | 37700 | 60795 |
| PHKG2 | 14606 | 37701 | 60796 |
| PHLDA1 | 14607 | 37702 | 60797 |
| PHLDA2 | 14608 | 37703 | 60798 |
| PHLDA3 | 14609 | 37704 | 60799 |
| PHLDB1 | 14610 | 37705 | 60800 |
| PHLDB2 | 14611 | 37706 | 60801 |
| PHLDB3 | 14612 | 37707 | 60802 |
| PHLPP1 | 14613 | 37708 | 60803 |
| PHLPP2 | 14614 | 37709 | 60804 |
| PHOSPHO1 | 14615 | 37710 | 60805 |
| PHOSPHO2 | 14616 | 37711 | 60806 |
| PHOX2A | 14617 | 37712 | 60807 |
| PHOX2B | 14618 | 37713 | 60808 |
| PHPT1 | 14619 | 37714 | 60809 |
| PHPT1 | 14620 | 37715 | 60810 |
| PHRF1 | 14621 | 37716 | 60811 |
| PHTF1 | 14622 | 37717 | 60812 |
| PHTF1 | 14623 | 37718 | 60813 |
| PHTF1 | 14624 | 37719 | 60814 |
| PHTF2 | 14625 | 37720 | 60815 |
| PHTF2 | 14626 | 37721 | 60816 |
| PHYH | 14627 | 37722 | 60817 |
| PHYHD1 | 14628 | 37723 | 60818 |
| PHYHD1 | 14629 | 37724 | 60819 |
| PHYHIP | 14630 | 37725 | 60820 |
| PHYHIPL | 14631 | 37726 | 60821 |
| PHYKPL | 14632 | 37727 | 60822 |
| PI15 | 14633 | 37728 | 60823 |
| PI16 | 14634 | 37729 | 60824 |
| PI3 | 14635 | 37730 | 60825 |
| PI4K2A | 14636 | 37731 | 60826 |
| PI4K2B | 14637 | 37732 | 60827 |
| PI4KA | 14638 | 37733 | 60828 |
| PI4KB | 14639 | 37734 | 60829 |
| PIANP | 14640 | 37735 | 60830 |
| PIANP | 14641 | 37736 | 60831 |
| PIAS1 | 14642 | 37737 | 60832 |
| PIAS2 | 14643 | 37738 | 60833 |
| PIAS2 | 14644 | 37739 | 60834 |
| PIAS2 | 14645 | 37740 | 60835 |
| PIAS2 | 14646 | 37741 | 60836 |
| PIAS2 | 14647 | 37742 | 60837 |
| PIAS3 | 14648 | 37743 | 60838 |
| PIAS4 | 14649 | 37744 | 60839 |
| PIBF1 | 14650 | 37745 | 60840 |
| PICALM | 14651 | 37746 | 60841 |
| PICK1 | 14652 | 37747 | 60842 |
| PID1 | 14653 | 37748 | 60843 |
| PIDD1 | 14654 | 37749 | 60844 |
| PIEZO1 | 14655 | 37750 | 60845 |
| PIEZO2 | 14656 | 37751 | 60846 |
| PIF1 | 14657 | 37752 | 60847 |
| PIF1 | 14658 | 37753 | 60848 |
| PIFO | 14659 | 37754 | 60849 |
| PIGA | 14660 | 37755 | 60850 |
| PIGB | 14661 | 37756 | 60851 |
| PIGBOS1 | 14662 | 37757 | 60852 |
| PIGC | 14663 | 37758 | 60853 |
| PIGF | 14664 | 37759 | 60854 |
| PIGF | 14665 | 37760 | 60855 |
| PIGG | 14666 | 37761 | 60856 |
| PIGG | 14667 | 37762 | 60857 |
| PIGG | 14668 | 37763 | 60858 |
| PIGG | 14669 | 37764 | 60859 |
| PIGG | 14670 | 37765 | 60860 |
| PIGH | 14671 | 37766 | 60861 |
| PIGK | 14672 | 37767 | 60862 |
| PIGL | 14673 | 37768 | 60863 |
| PIGM | 14674 | 37769 | 60864 |
| PIGN | 14675 | 37770 | 60865 |
| PIGO | 14676 | 37771 | 60866 |
| PIGP | 14677 | 37772 | 60867 |
| PIGQ | 14678 | 37773 | 60868 |
| PIGQ | 14679 | 37774 | 60869 |
| PIGR | 14680 | 37775 | 60870 |
| PIGS | 14681 | 37776 | 60871 |
| PIGT | 14682 | 37777 | 60872 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| PIGU | 14683 | 37778 | 60873 |
| PIGV | 14684 | 37779 | 60874 |
| PIGW | 14685 | 37780 | 60875 |
| PIGX | 14686 | 37781 | 60876 |
| PIGY | 14687 | 37782 | 60877 |
| PIGZ | 14688 | 37783 | 60878 |
| PIH1D1 | 14689 | 37784 | 60879 |
| PIH1D2 | 14690 | 37785 | 60880 |
| PIH1D2 | 14691 | 37786 | 60881 |
| PIH1D3 | 14692 | 37787 | 60882 |
| PIK3AP1 | 14693 | 37788 | 60883 |
| PIK3C2A | 14694 | 37789 | 60884 |
| PIK3C2B | 14695 | 37790 | 60885 |
| PIK3C2G | 14696 | 37791 | 60886 |
| PIK3C3 | 14697 | 37792 | 60887 |
| PIK3CA | 14698 | 37793 | 60888 |
| PIK3CB | 14699 | 37794 | 60889 |
| PIK3CD | 14700 | 37795 | 60890 |
| PIK3CG | 14701 | 37796 | 60891 |
| PIK3IP1 | 14702 | 37797 | 60892 |
| PIK3IP1 | 14703 | 37798 | 60893 |
| PIK3R1 | 14704 | 37799 | 60894 |
| PIK3R2 | 14705 | 37800 | 60895 |
| PIK3R3 | 14706 | 37801 | 60896 |
| PIK3R4 | 14707 | 37802 | 60897 |
| PIK3R5 | 14708 | 37803 | 60898 |
| PIK3R6 | 14709 | 37804 | 60899 |
| PIKFYVE | 14710 | 37805 | 60900 |
| PIKFYVE | 14711 | 37806 | 60901 |
| PILRA | 14712 | 37807 | 60902 |
| PILRA | 14713 | 37808 | 60903 |
| PILRB | 14714 | 37809 | 60904 |
| PIM1 | 14715 | 37810 | 60905 |
| PIM2 | 14716 | 37811 | 60906 |
| PIM3 | 14717 | 37812 | 60907 |
| PIMREG | 14718 | 37813 | 60908 |
| PIMREG | 14719 | 37814 | 60909 |
| PIN1 | 14720 | 37815 | 60910 |
| PIN4 | 14721 | 37816 | 60911 |
| PIN4 | 14722 | 37817 | 60912 |
| PINK1 | 14723 | 37818 | 60913 |
| PINLYP | 14724 | 37819 | 60914 |
| PINX1 | 14725 | 37820 | 60915 |
| PINX1 | 14726 | 37821 | 60916 |
| PIP | 14727 | 37822 | 60917 |
| PIP4K2A | 14728 | 37823 | 60918 |
| PIP4K2B | 14729 | 37824 | 60919 |
| PIP4K2C | 14730 | 37825 | 60920 |
| PIP4P1 | 14731 | 37826 | 60921 |
| PIP4P2 | 14732 | 37827 | 60922 |
| PIP5K1A | 14733 | 37828 | 60923 |
| PIP5K1B | 14734 | 37829 | 60924 |
| PIP5K1B | 14735 | 37830 | 60925 |
| PIP5K1C | 14736 | 37831 | 60926 |
| PIP5K1C | 14737 | 37832 | 60927 |
| PIP5K1C | 14738 | 37833 | 60928 |
| PIP5KL1 | 14739 | 37834 | 60929 |
| PIPOX | 14740 | 37835 | 60930 |
| PIR | 14741 | 37836 | 60931 |
| PIRT | 14742 | 37837 | 60932 |
| PISD | 14743 | 37838 | 60933 |
| PISD | 14744 | 37839 | 60934 |
| PITHD1 | 14745 | 37840 | 60935 |
| PITPNA | 14746 | 37841 | 60936 |
| PITPNB | 14747 | 37842 | 60937 |
| PITPNB | 14748 | 37843 | 60938 |
| PITPNC1 | 14749 | 37844 | 60939 |
| PITPNC1 | 14750 | 37845 | 60940 |
| PITPNM1 | 14751 | 37846 | 60941 |
| PITPNM2 | 14752 | 37847 | 60942 |
| PITPNM3 | 14753 | 37848 | 60943 |
| PITRM1 | 14754 | 37849 | 60944 |
| PITX1 | 14755 | 37850 | 60945 |
| PITX2 | 14756 | 37851 | 60946 |
| PITX3 | 14757 | 37852 | 60947 |
| PIWIL1 | 14758 | 37853 | 60948 |
| PIWIL1 | 14759 | 37854 | 60949 |
| PIWIL2 | 14760 | 37855 | 60950 |
| PIWIL3 | 14761 | 37856 | 60951 |
| PIWIL4 | 14762 | 37857 | 60952 |
| PJA1 | 14763 | 37858 | 60953 |
| PJA2 | 14764 | 37859 | 60954 |
| PJVK | 14765 | 37860 | 60955 |
| PKD1 | 14766 | 37861 | 60956 |
| PKD1L1 | 14767 | 37862 | 60957 |
| PKD1L2 | 14768 | 37863 | 60958 |
| PKD1L2 | 14769 | 37864 | 60959 |
| PKD1L3 | 14770 | 37865 | 60960 |
| PKD2 | 14771 | 37866 | 60961 |
| PKD2L1 | 14772 | 37867 | 60962 |
| PKD2L2 | 14773 | 37868 | 60963 |
| PKD2L2 | 14774 | 37869 | 60964 |
| PKDCC | 14775 | 37870 | 60965 |
| PKDREJ | 14776 | 37871 | 60966 |
| PKHD1 | 14777 | 37872 | 60967 |
| PKHD1 | 14778 | 37873 | 60968 |
| PKHD1L1 | 14779 | 37874 | 60969 |
| PKIA | 14780 | 37875 | 60970 |
| PKIB | 14781 | 37876 | 60971 |
| PKIB | 14782 | 37877 | 60972 |
| PKIG | 14783 | 37878 | 60973 |
| PKLR | 14784 | 37879 | 60974 |
| PKM | 14785 | 37880 | 60975 |
| PKMYT1 | 14786 | 37881 | 60976 |
| PKMYT1 | 14787 | 37882 | 60977 |
| PKN1 | 14788 | 37883 | 60978 |
| PKN2 | 14789 | 37884 | 60979 |
| PKN3 | 14790 | 37885 | 60980 |
| PKN3 | 14791 | 37886 | 60981 |
| PKNOX1 | 14792 | 37887 | 60982 |
| PKNOX2 | 14793 | 37888 | 60983 |
| PKP1 | 14794 | 37889 | 60984 |
| PKP2 | 14795 | 37890 | 60985 |
| PKP3 | 14796 | 37891 | 60986 |
| PKP4 | 14797 | 37892 | 60987 |
| PKP4 | 14798 | 37893 | 60988 |
| PLA1A | 14799 | 37894 | 60989 |
| PLA2G10 | 14800 | 37895 | 60990 |
| PLA2G12A | 14801 | 37896 | 60991 |
| PLA2G12B | 14802 | 37897 | 60992 |
| PLA2G15 | 14803 | 37898 | 60993 |
| PLA2G16 | 14804 | 37899 | 60994 |
| PLA2G1B | 14805 | 37900 | 60995 |
| PLA2G2A | 14806 | 37901 | 60996 |
| PLA2G2C | 14807 | 37902 | 60997 |
| PLA2G2D | 14808 | 37903 | 60998 |
| PLA2G2D | 14809 | 37904 | 60999 |
| PLA2G2E | 14810 | 37905 | 61000 |
| PLA2G2F | 14811 | 37906 | 61001 |
| PLA2G3 | 14812 | 37907 | 61002 |
| PLA2G4A | 14813 | 37908 | 61003 |
| PLA2G4C | 14814 | 37909 | 61004 |
| PLA2G4C | 14815 | 37910 | 61005 |
| PLA2G4D | 14816 | 37911 | 61006 |
| PLA2G4E | 14817 | 37912 | 61007 |
| PLA2G4F | 14818 | 37913 | 61008 |
| PLA2G5 | 14819 | 37914 | 61009 |
| PLA2G6 | 14820 | 37915 | 61010 |
| PLA2G7 | 14821 | 37916 | 61011 |
| PLA2R1 | 14822 | 37917 | 61012 |
| PLA2R1 | 14823 | 37918 | 61013 |
| PLAA | 14824 | 37919 | 61014 |
| PLAC1 | 14825 | 37920 | 61015 |
| PLAC4 | 14826 | 37921 | 61016 |
| PLAC8 | 14827 | 37922 | 61017 |
| PLAC8L1 | 14828 | 37923 | 61018 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| PLAC9 | 14829 | 37924 | 61019 |
| PLAC9 | 14830 | 37925 | 61020 |
| PLAG1 | 14831 | 37926 | 61021 |
| PLAGL1 | 14832 | 37927 | 61022 |
| PLAGL2 | 14833 | 37928 | 61023 |
| PLAT | 14834 | 37929 | 61024 |
| PLAU | 14835 | 37930 | 61025 |
| PLAUR | 14836 | 37931 | 61026 |
| PLAUR | 14837 | 37932 | 61027 |
| PLB1 | 14838 | 37933 | 61028 |
| PLBD1 | 14839 | 37934 | 61029 |
| PLBD2 | 14840 | 37935 | 61030 |
| PLCB1 | 14841 | 37936 | 61031 |
| PLCB1 | 14842 | 37937 | 61032 |
| PLCB2 | 14843 | 37938 | 61033 |
| PLCB2 | 14844 | 37939 | 61034 |
| PLCB3 | 14845 | 37940 | 61035 |
| PLCB4 | 14846 | 37941 | 61036 |
| PLCB4 | 14847 | 37942 | 61037 |
| PLCD1 | 14848 | 37943 | 61038 |
| PLCD3 | 14849 | 37944 | 61039 |
| PLCD4 | 14850 | 37945 | 61040 |
| PLCE1 | 14851 | 37946 | 61041 |
| PLCG1 | 14852 | 37947 | 61042 |
| PLCG2 | 14853 | 37948 | 61043 |
| PLCH1 | 14854 | 37949 | 61044 |
| PLCH1 | 14855 | 37950 | 61045 |
| PLCH2 | 14856 | 37951 | 61046 |
| PLCH2 | 14857 | 37952 | 61047 |
| PLCH2 | 14858 | 37953 | 61048 |
| PLCL1 | 14859 | 37954 | 61049 |
| PLCL2 | 14860 | 37955 | 61050 |
| PLCXD1 | 14861 | 37956 | 61051 |
| PLCXD2 | 14862 | 37957 | 61052 |
| PLCXD2 | 14863 | 37958 | 61053 |
| PLCXD3 | 14864 | 37959 | 61054 |
| PLCZ1 | 14865 | 37960 | 61055 |
| PLD1 | 14866 | 37961 | 61056 |
| PLD2 | 14867 | 37962 | 61057 |
| PLD3 | 14868 | 37963 | 61058 |
| PLD4 | 14869 | 37964 | 61059 |
| PLD5 | 14870 | 37965 | 61060 |
| PLD6 | 14871 | 37966 | 61061 |
| PLEC | 14872 | 37967 | 61062 |
| PLEK | 14873 | 37968 | 61063 |
| PLEK2 | 14874 | 37969 | 61064 |
| PLEKHA1 | 14875 | 37970 | 61065 |
| PLEKHA1 | 14876 | 37971 | 61066 |
| PLEKHA1 | 14877 | 37972 | 61067 |
| PLEKHA2 | 14878 | 37973 | 61068 |
| PLEKHA3 | 14879 | 37974 | 61069 |
| PLEKHA4 | 14880 | 37975 | 61070 |
| PLEKHA4 | 14881 | 37976 | 61071 |
| PLEKHA5 | 14882 | 37977 | 61072 |
| PLEKHA5 | 14883 | 37978 | 61073 |
| PLEKHA6 | 14884 | 37979 | 61074 |
| PLEKHA7 | 14885 | 37980 | 61075 |
| PLEKHA7 | 14886 | 37981 | 61076 |
| PLEKHA8 | 14887 | 37982 | 61077 |
| PLEKHA8 | 14888 | 37983 | 61078 |
| PLEKHA8 | 14889 | 37984 | 61079 |
| PLEKHA8 | 14890 | 37985 | 61080 |
| PLEKHA8 | 14891 | 37986 | 61081 |
| PLEKHB1 | 14892 | 37987 | 61082 |
| PLEKHB2 | 14893 | 37988 | 61083 |
| PLEKHB2 | 14894 | 37989 | 61084 |
| PLEKHD1 | 14895 | 37990 | 61085 |
| PLEKHF1 | 14896 | 37991 | 61086 |
| PLEKHF2 | 14897 | 37992 | 61087 |
| PLEKHG1 | 14898 | 37993 | 61088 |
| PLEKHG1 | 14899 | 37994 | 61089 |
| PLEKHG2 | 14900 | 37995 | 61090 |
| PLEKHG2 | 14901 | 37996 | 61091 |
| PLEKHG3 | 14902 | 37997 | 61092 |
| PLEKHG4 | 14903 | 37998 | 61093 |
| PLEKHG4B | 14904 | 37999 | 61094 |
| PLEKHG5 | 14905 | 38000 | 61095 |
| PLEKHG6 | 14906 | 38001 | 61096 |
| PLEKHG7 | 14907 | 38002 | 61097 |
| PLEKHH1 | 14908 | 38003 | 61098 |
| PLEKHH2 | 14909 | 38004 | 61099 |
| PLEKHH3 | 14910 | 38005 | 61100 |
| PLEKHJ1 | 14911 | 38006 | 61101 |
| PLEKHJ1 | 14912 | 38007 | 61102 |
| PLEKHM1 | 14913 | 38008 | 61103 |
| PLEKHM1 | 14914 | 38009 | 61104 |
| PLEKHM2 | 14915 | 38010 | 61105 |
| PLEKHM3 | 14916 | 38011 | 61106 |
| PLEKHN1 | 14917 | 38012 | 61107 |
| PLEKHO1 | 14918 | 38013 | 61108 |
| PLEKHO2 | 14919 | 38014 | 61109 |
| PLEKHS1 | 14920 | 38015 | 61110 |
| PLEKHS1 | 14921 | 38016 | 61111 |
| PLEKHS1 | 14922 | 38017 | 61112 |
| PLET1 | 14923 | 38018 | 61113 |
| PLG | 14924 | 38019 | 61114 |
| PLGLB2 | 14925 | 38020 | 61115 |
| PLGRKT | 14926 | 38021 | 61116 |
| PLIN1 | 14927 | 38022 | 61117 |
| PLIN2 | 14928 | 38023 | 61118 |
| PLIN3 | 14929 | 38024 | 61119 |
| PLIN4 | 14930 | 38025 | 61120 |
| PLIN5 | 14931 | 38026 | 61121 |
| PLK1 | 14932 | 38027 | 61122 |
| PLK2 | 14933 | 38028 | 61123 |
| PLK3 | 14934 | 38029 | 61124 |
| PLK4 | 14935 | 38030 | 61125 |
| PLK5 | 14936 | 38031 | 61126 |
| PLLP | 14937 | 38032 | 61127 |
| PLN | 14938 | 38033 | 61128 |
| PLOD1 | 14939 | 38034 | 61129 |
| PLOD2 | 14940 | 38035 | 61130 |
| PLOD3 | 14941 | 38036 | 61131 |
| PLP1 | 14942 | 38037 | 61132 |
| PLP2 | 14943 | 38038 | 61133 |
| PLPBP | 14944 | 38039 | 61134 |
| PLPBP | 14945 | 38040 | 61135 |
| PLPP1 | 14946 | 38041 | 61136 |
| PLPP2 | 14947 | 38042 | 61137 |
| PLPP3 | 14948 | 38043 | 61138 |
| PLPP4 | 14949 | 38044 | 61139 |
| PLPP4 | 14950 | 38045 | 61140 |
| PLPP4 | 14951 | 38046 | 61141 |
| PLPP4 | 14952 | 38047 | 61142 |
| PLPP5 | 14953 | 38048 | 61143 |
| PLPP5 | 14954 | 38049 | 61144 |
| PLPP5 | 14955 | 38050 | 61145 |
| PLPP5 | 14956 | 38051 | 61146 |
| PLPP5 | 14957 | 38052 | 61147 |
| PLPP6 | 14958 | 38053 | 61148 |
| PLPP7 | 14959 | 38054 | 61149 |
| PLPPR1 | 14960 | 38055 | 61150 |
| PLPPR2 | 14961 | 38056 | 61151 |
| PLPPR2 | 14962 | 38057 | 61152 |
| PLPPR3 | 14963 | 38058 | 61153 |
| PLPPR4 | 14964 | 38059 | 61154 |
| PLPPR5 | 14965 | 38060 | 61155 |
| PLRG1 | 14966 | 38061 | 61156 |
| PLS1 | 14967 | 38062 | 61157 |
| PLS3 | 14968 | 38063 | 61158 |
| PLSCR1 | 14969 | 38064 | 61159 |
| PLSCR2 | 14970 | 38065 | 61160 |
| PLSCR3 | 14971 | 38066 | 61161 |
| PLSCR4 | 14972 | 38067 | 61162 |
| PLSCR5 | 14973 | 38068 | 61163 |
| PLTP | 14974 | 38069 | 61164 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| PLVAP | 14975 | 38070 | 61165 |
| PLXDC1 | 14976 | 38071 | 61166 |
| PLXDC2 | 14977 | 38072 | 61167 |
| PLXNA1 | 14978 | 38073 | 61168 |
| PLXNA2 | 14979 | 38074 | 61169 |
| PLXNA3 | 14980 | 38075 | 61170 |
| PLXNA4 | 14981 | 38076 | 61171 |
| PLXNA4 | 14982 | 38077 | 61172 |
| PLXNA4 | 14983 | 38078 | 61173 |
| PLXNB1 | 14984 | 38079 | 61174 |
| PLXNB2 | 14985 | 38080 | 61175 |
| PLXNB3 | 14986 | 38081 | 61176 |
| PLXNC1 | 14987 | 38082 | 61177 |
| PLXND1 | 14988 | 38083 | 61178 |
| PM20D1 | 14989 | 38084 | 61179 |
| PM20D2 | 14990 | 38085 | 61180 |
| PMAIP1 | 14991 | 38086 | 61181 |
| PMCH | 14992 | 38087 | 61182 |
| PMEL | 14993 | 38088 | 61183 |
| PMEPA1 | 14994 | 38089 | 61184 |
| PMF1 | 14995 | 38090 | 61185 |
| PMF1 | 14996 | 38091 | 61186 |
| PMF1-BGLAP | 14997 | 38092 | 61187 |
| PMF1-BGLAP | 14998 | 38093 | 61188 |
| PMFBP1 | 14999 | 38094 | 61189 |
| PML | 15000 | 38095 | 61190 |
| PML | 15001 | 38096 | 61191 |
| PML | 15002 | 38097 | 61192 |
| PML | 15003 | 38098 | 61193 |
| PML | 15004 | 38099 | 61194 |
| PML | 15005 | 38100 | 61195 |
| PML | 15006 | 38101 | 61196 |
| PMM1 | 15007 | 38102 | 61197 |
| PMM2 | 15008 | 38103 | 61198 |
| PMP2 | 15009 | 38104 | 61199 |
| PMP2 | 15010 | 38105 | 61200 |
| PMP22 | 15011 | 38106 | 61201 |
| PMP22 | 15012 | 38107 | 61202 |
| PMPCA | 15013 | 38108 | 61203 |
| PMPCB | 15014 | 38109 | 61204 |
| PMS1 | 15015 | 38110 | 61205 |
| PMS1 | 15016 | 38111 | 61206 |
| PMS1 | 15017 | 38112 | 61207 |
| PMS2 | 15018 | 38113 | 61208 |
| PMVK | 15019 | 38114 | 61209 |
| PNCK | 15020 | 38115 | 61210 |
| PNISR | 15021 | 38116 | 61211 |
| PNISR | 15022 | 38117 | 61212 |
| PNISR | 15023 | 38118 | 61213 |
| PNISR | 15024 | 38119 | 61214 |
| PNISR | 15025 | 38120 | 61215 |
| PNKD | 15026 | 38121 | 61216 |
| PNKD | 15027 | 38122 | 61217 |
| PNKP | 15028 | 38123 | 61218 |
| PNLDC1 | 15029 | 38124 | 61219 |
| PNLIP | 15030 | 38125 | 61220 |
| PNLIPRP1 | 15031 | 38126 | 61221 |
| PNLIPRP2 | 15032 | 38127 | 61222 |
| PNLIPRP3 | 15033 | 38128 | 61223 |
| PNMA1 | 15034 | 38129 | 61224 |
| PNMA2 | 15035 | 38130 | 61225 |
| PNMA3 | 15036 | 38131 | 61226 |
| PNMA3 | 15037 | 38132 | 61227 |
| PNMA5 | 15038 | 38133 | 61228 |
| PNMA6A | 15039 | 38134 | 61229 |
| PNMA6E | 15040 | 38135 | 61230 |
| PNMA8A | 15041 | 38136 | 61231 |
| PNMA8A | 15042 | 38137 | 61232 |
| PNMA8B | 15043 | 38138 | 61233 |
| PNMT | 15044 | 38139 | 61234 |
| PNN | 15045 | 38140 | 61235 |
| PNO1 | 15046 | 38141 | 61236 |
| PNO1 | 15047 | 38142 | 61237 |
| PNOC | 15048 | 38143 | 61238 |
| PNP | 15049 | 38144 | 61239 |
| PNPLA1 | 15050 | 38145 | 61240 |
| PNPLA2 | 15051 | 38146 | 61241 |
| PNPLA3 | 15052 | 38147 | 61242 |
| PNPLA4 | 15053 | 38148 | 61243 |
| PNPLA5 | 15054 | 38149 | 61244 |
| PNPLA6 | 15055 | 38150 | 61245 |
| PNPLA7 | 15056 | 38151 | 61246 |
| PNPLA8 | 15057 | 38152 | 61247 |
| PNPO | 15058 | 38153 | 61248 |
| PNPT1 | 15059 | 38154 | 61249 |
| PNRC1 | 15060 | 38155 | 61250 |
| PNRC2 | 15061 | 38156 | 61251 |
| POC1A | 15062 | 38157 | 61252 |
| POC1B | 15063 | 38158 | 61253 |
| POC5 | 15064 | 38159 | 61254 |
| PODN | 15065 | 38160 | 61255 |
| PODNL1 | 15066 | 38161 | 61256 |
| PODXL | 15067 | 38162 | 61257 |
| PODXL2 | 15068 | 38163 | 61258 |
| POF1B | 15069 | 38164 | 61259 |
| POF1B | 15070 | 38165 | 61260 |
| POFUT1 | 15071 | 38166 | 61261 |
| POFUT1 | 15072 | 38167 | 61262 |
| POFUT2 | 15073 | 38168 | 61263 |
| POFUT2 | 15074 | 38169 | 61264 |
| POGK | 15075 | 38170 | 61265 |
| POGLUT1 | 15076 | 38171 | 61266 |
| POGZ | 15077 | 38172 | 61267 |
| POLA1 | 15078 | 38173 | 61268 |
| POLA2 | 15079 | 38174 | 61269 |
| POLB | 15080 | 38175 | 61270 |
| POLD1 | 15081 | 38176 | 61271 |
| POLD2 | 15082 | 38177 | 61272 |
| POLD3 | 15083 | 38178 | 61273 |
| POLD4 | 15084 | 38179 | 61274 |
| POLD4 | 15085 | 38180 | 61275 |
| POLDIP2 | 15086 | 38181 | 61276 |
| POLDIP3 | 15087 | 38182 | 61277 |
| POLE | 15088 | 38183 | 61278 |
| POLE2 | 15089 | 38184 | 61279 |
| POLE2 | 15090 | 38185 | 61280 |
| POLE3 | 15091 | 38186 | 61281 |
| POLE4 | 15092 | 38187 | 61282 |
| POLG | 15093 | 38188 | 61283 |
| POLG2 | 15094 | 38189 | 61284 |
| POLH | 15095 | 38190 | 61285 |
| POLH | 15096 | 38191 | 61286 |
| POLI | 15097 | 38192 | 61287 |
| POLI | 15098 | 38193 | 61288 |
| POLK | 15099 | 38194 | 61289 |
| POLL | 15100 | 38195 | 61290 |
| POLM | 15101 | 38196 | 61291 |
| POLM | 15102 | 38197 | 61292 |
| POLN | 15103 | 38198 | 61293 |
| POLQ | 15104 | 38199 | 61294 |
| POLR1A | 15105 | 38200 | 61295 |
| POLR1B | 15106 | 38201 | 61296 |
| POLR1C | 15107 | 38202 | 61297 |
| POLR1C | 15108 | 38203 | 61298 |
| POLR1D | 15109 | 38204 | 61299 |
| POLR1D | 15110 | 38205 | 61300 |
| POLR1E | 15111 | 38206 | 61301 |
| POLR2A | 15112 | 38207 | 61302 |
| POLR2B | 15113 | 38208 | 61303 |
| POLR2C | 15114 | 38209 | 61304 |
| POLR2D | 15115 | 38210 | 61305 |
| POLR2E | 15116 | 38211 | 61306 |
| POLR2E | 15117 | 38212 | 61307 |
| POLR2F | 15118 | 38213 | 61308 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| POLR2F | 15119 | 38214 | 61309 |
| POLR2F | 15120 | 38215 | 61310 |
| POLR2G | 15121 | 38216 | 61311 |
| POLR2H | 15122 | 38217 | 61312 |
| POLR2H | 15123 | 38218 | 61313 |
| POLR2H | 15124 | 38219 | 61314 |
| POLR2H | 15125 | 38220 | 61315 |
| POLR2H | 15126 | 38221 | 61316 |
| POLR2I | 15127 | 38222 | 61317 |
| POLR2J | 15128 | 38223 | 61318 |
| POLR2J2 | 15129 | 38224 | 61319 |
| POLR2K | 15130 | 38225 | 61320 |
| POLR2L | 15131 | 38226 | 61321 |
| POLR2M | 15132 | 38227 | 61322 |
| POLR3A | 15133 | 38228 | 61323 |
| POLR3B | 15134 | 38229 | 61324 |
| POLR3C | 15135 | 38230 | 61325 |
| POLR3D | 15136 | 38231 | 61326 |
| POLR3E | 15137 | 38232 | 61327 |
| POLR3F | 15138 | 38233 | 61328 |
| POLR3G | 15139 | 38234 | 61329 |
| POLR3GL | 15140 | 38235 | 61330 |
| POLR3H | 15141 | 38236 | 61331 |
| POLR3K | 15142 | 38237 | 61332 |
| POLRMT | 15143 | 38238 | 61333 |
| POM121 | 15144 | 38239 | 61334 |
| POM121C | 15145 | 38240 | 61335 |
| POM121L12 | 15146 | 38241 | 61336 |
| POM121L2 | 15147 | 38242 | 61337 |
| POMC | 15148 | 38243 | 61338 |
| POMGNT1 | 15149 | 38244 | 61339 |
| POMGNT1 | 15150 | 38245 | 61340 |
| POMGNT2 | 15151 | 38246 | 61341 |
| POMK | 15152 | 38247 | 61342 |
| POMP | 15153 | 38248 | 61343 |
| POMT1 | 15154 | 38249 | 61344 |
| POMT2 | 15155 | 38250 | 61345 |
| POMZP3 | 15156 | 38251 | 61346 |
| POMZP3 | 15157 | 38252 | 61347 |
| PON1 | 15158 | 38253 | 61348 |
| PON2 | 15159 | 38254 | 61349 |
| PON3 | 15160 | 38255 | 61350 |
| POP1 | 15161 | 38256 | 61351 |
| POP3 | 15162 | 38257 | 61352 |
| POP4 | 15163 | 38258 | 61353 |
| POP5 | 15164 | 38259 | 61354 |
| POP7 | 15165 | 38260 | 61355 |
| POPDC2 | 15166 | 38261 | 61356 |
| POPDC2 | 15167 | 38262 | 61357 |
| POPDC3 | 15168 | 38263 | 61358 |
| POR | 15169 | 38264 | 61359 |
| PORCN | 15170 | 38265 | 61360 |
| POSTN | 15171 | 38266 | 61361 |
| POT1 | 15172 | 38267 | 61362 |
| POTEA | 15173 | 38268 | 61363 |
| POTEB3 | 15174 | 38269 | 61364 |
| POTEC | 15175 | 38270 | 61365 |
| POTEF | 15176 | 38271 | 61366 |
| POTEI | 15177 | 38272 | 61367 |
| POTEM | 15178 | 38273 | 61368 |
| POU1F1 | 15179 | 38274 | 61369 |
| POU2AF1 | 15180 | 38275 | 61370 |
| POU2F1 | 15181 | 38276 | 61371 |
| POU2F2 | 15182 | 38277 | 61372 |
| POU2F2 | 15183 | 38278 | 61373 |
| POU2F2 | 15184 | 38279 | 61374 |
| POU2F3 | 15185 | 38280 | 61375 |
| POU3F1 | 15186 | 38281 | 61376 |
| POU3F2 | 15187 | 38282 | 61377 |
| POU3F3 | 15188 | 38283 | 61378 |
| POU3F4 | 15189 | 38284 | 61379 |
| POU4F1 | 15190 | 38285 | 61380 |
| POU4F2 | 15191 | 38286 | 61381 |
| POU4F3 | 15192 | 38287 | 61382 |
| POU5F1 | 15193 | 38288 | 61383 |
| POU5F2 | 15194 | 38289 | 61384 |
| POU6F1 | 15195 | 38290 | 61385 |
| POU6F1 | 15196 | 38291 | 61386 |
| POU6F2 | 15197 | 38292 | 61387 |
| PP2D1 | 15198 | 38293 | 61388 |
| PPA1 | 15199 | 38294 | 61389 |
| PPA2 | 15200 | 38295 | 61390 |
| PPAN | 15201 | 38296 | 61391 |
| PPAN-P2RY11 | 15202 | 38297 | 61392 |
| PPARA | 15203 | 38298 | 61393 |
| PPARD | 15204 | 38299 | 61394 |
| PPARD | 15205 | 38300 | 61395 |
| PPARG | 15206 | 38301 | 61396 |
| PPARG | 15207 | 38302 | 61397 |
| PPARGC1A | 15208 | 38303 | 61398 |
| PPARGC1B | 15209 | 38304 | 61399 |
| PPAT | 15210 | 38305 | 61400 |
| PPBP | 15211 | 38306 | 61401 |
| PPCDC | 15212 | 38307 | 61402 |
| PPCDC | 15213 | 38308 | 61403 |
| PPCS | 15214 | 38309 | 61404 |
| PPCS | 15215 | 38310 | 61405 |
| PPCS | 15216 | 38311 | 61406 |
| PPDPF | 15217 | 38312 | 61407 |
| PPDPF | 15218 | 38313 | 61408 |
| PPDPFL | 15219 | 38314 | 61409 |
| PPDPFL | 15220 | 38315 | 61410 |
| PPEF1 | 15221 | 38316 | 61411 |
| PPEF2 | 15222 | 38317 | 61412 |
| PPFIA1 | 15223 | 38318 | 61413 |
| PPFIA1 | 15224 | 38319 | 61414 |
| PPFIA2 | 15225 | 38320 | 61415 |
| PPFIA2 | 15226 | 38321 | 61416 |
| PPFIA3 | 15227 | 38322 | 61417 |
| PPFIA4 | 15228 | 38323 | 61418 |
| PPFIBP1 | 15229 | 38324 | 61419 |
| PPFIBP2 | 15230 | 38325 | 61420 |
| PPFIBP2 | 15231 | 38326 | 61421 |
| PPFIBP2 | 15232 | 38327 | 61422 |
| PPHLN1 | 15233 | 38328 | 61423 |
| PPHLN1 | 15234 | 38329 | 61424 |
| PPHLN1 | 15235 | 38330 | 61425 |
| PPIA | 15236 | 38331 | 61426 |
| PPIAL4F | 15237 | 38332 | 61427 |
| PPIB | 15238 | 38333 | 61428 |
| PPIC | 15239 | 38334 | 61429 |
| PPID | 15240 | 38335 | 61430 |
| PPIE | 15241 | 38336 | 61431 |
| PPIE | 15242 | 38337 | 61432 |
| PPIE | 15243 | 38338 | 61433 |
| PPIF | 15244 | 38339 | 61434 |
| PPIG | 15245 | 38340 | 61435 |
| PPIH | 15246 | 38341 | 61436 |
| PPIL1 | 15247 | 38342 | 61437 |
| PPIL2 | 15248 | 38343 | 61438 |
| PPIL2 | 15249 | 38344 | 61439 |
| PPIL2 | 15250 | 38345 | 61440 |
| PPIL3 | 15251 | 38346 | 61441 |
| PPIL4 | 15252 | 38347 | 61442 |
| PPIL6 | 15253 | 38348 | 61443 |
| PPIL6 | 15254 | 38349 | 61444 |
| PPIP5K1 | 15255 | 38350 | 61445 |
| PPIP5K2 | 15256 | 38351 | 61446 |
| PPL | 15257 | 38352 | 61447 |
| PPM1A | 15258 | 38353 | 61448 |
| PPM1A | 15259 | 38354 | 61449 |
| PPM1B | 15260 | 38355 | 61450 |
| PPM1B | 15261 | 38356 | 61451 |
| PPM1B | 15262 | 38357 | 61452 |
| PPM1D | 15263 | 38358 | 61453 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| PPM1E | 15264 | 38359 | 61454 |
| PPM1F | 15265 | 38360 | 61455 |
| PPM1G | 15266 | 38361 | 61456 |
| PPM1H | 15267 | 38362 | 61457 |
| PPM1J | 15268 | 38363 | 61458 |
| PPM1K | 15269 | 38364 | 61459 |
| PPM1L | 15270 | 38365 | 61460 |
| PPM1M | 15271 | 38366 | 61461 |
| PPM1N | 15272 | 38367 | 61462 |
| PPME1 | 15273 | 38368 | 61463 |
| PPOX | 15274 | 38369 | 61464 |
| PPP1CA | 15275 | 38370 | 61465 |
| PPP1CB | 15276 | 38371 | 61466 |
| PPP1CC | 15277 | 38372 | 61467 |
| PPP1CC | 15278 | 38373 | 61468 |
| PPP1R10 | 15279 | 38374 | 61469 |
| PPP1R11 | 15280 | 38375 | 61470 |
| PPP1R12A | 15281 | 38376 | 61471 |
| PPP1R12B | 15282 | 38377 | 61472 |
| PPP1R12B | 15283 | 38378 | 61473 |
| PPP1R12B | 15284 | 38379 | 61474 |
| PPP1R12B | 15285 | 38380 | 61475 |
| PPP1R12C | 15286 | 38381 | 61476 |
| PPP1R13B | 15287 | 38382 | 61477 |
| PPP1R13L | 15288 | 38383 | 61478 |
| PPP1R14A | 15289 | 38384 | 61479 |
| PPP1R14C | 15290 | 38385 | 61480 |
| PPP1R14D | 15291 | 38386 | 61481 |
| PPP1R14D | 15292 | 38387 | 61482 |
| PPP1R15A | 15293 | 38388 | 61483 |
| PPP1R15B | 15294 | 38389 | 61484 |
| PPP1R16A | 15295 | 38390 | 61485 |
| PPP1R16B | 15296 | 38391 | 61486 |
| PPP1R17 | 15297 | 38392 | 61487 |
| PPP1R18 | 15298 | 38393 | 61488 |
| PPP1R1A | 15299 | 38394 | 61489 |
| PPP1R1B | 15300 | 38395 | 61490 |
| PPP1R1C | 15301 | 38396 | 61491 |
| PPP1R1C | 15302 | 38397 | 61492 |
| PPP1R2 | 15303 | 38398 | 61493 |
| PPP1R21 | 15304 | 38399 | 61494 |
| PPP1R26 | 15305 | 38400 | 61495 |
| PPP1R27 | 15306 | 38401 | 61496 |
| PPP1R2P9 | 15307 | 38402 | 61497 |
| PPP1R32 | 15308 | 38403 | 61498 |
| PPP1R35 | 15309 | 38404 | 61499 |
| PPP1R35 | 15310 | 38405 | 61500 |
| PPP1R36 | 15311 | 38406 | 61501 |
| PPP1R37 | 15312 | 38407 | 61502 |
| PPP1R3A | 15313 | 38408 | 61503 |
| PPP1R3B | 15314 | 38409 | 61504 |
| PPP1R3C | 15315 | 38410 | 61505 |
| PPP1R3D | 15316 | 38411 | 61506 |
| PPP1R3E | 15317 | 38412 | 61507 |
| PPP1R3F | 15318 | 38413 | 61508 |
| PPP1R3G | 15319 | 38414 | 61509 |
| PPP1R42 | 15320 | 38415 | 61510 |
| PPP1R42 | 15321 | 38416 | 61511 |
| PPP1R7 | 15322 | 38417 | 61512 |
| PPP1R7 | 15323 | 38418 | 61513 |
| PPP1R8 | 15324 | 38419 | 61514 |
| PPP1R9A | 15325 | 38420 | 61515 |
| PPP1R9B | 15326 | 38421 | 61516 |
| PPP2CA | 15327 | 38422 | 61517 |
| PPP2CB | 15328 | 38423 | 61518 |
| PPP2R1A | 15329 | 38424 | 61519 |
| PPP2R1B | 15330 | 38425 | 61520 |
| PPP2R1B | 15331 | 38426 | 61521 |
| PPP2R2A | 15332 | 38427 | 61522 |
| PPP2R2B | 15333 | 38428 | 61523 |
| PPP2R2C | 15334 | 38429 | 61524 |
| PPP2R2D | 15335 | 38430 | 61525 |
| PPP2R3A | 15336 | 38431 | 61526 |
| PPP2R3B | 15337 | 38432 | 61527 |
| PPP2R3C | 15338 | 38433 | 61528 |
| PPP2R5A | 15339 | 38434 | 61529 |
| PPP2R5B | 15340 | 38435 | 61530 |
| PPP2R5C | 15341 | 38436 | 61531 |
| PPP2R5C | 15342 | 38437 | 61532 |
| PPP2R5D | 15343 | 38438 | 61533 |
| PPP2R5E | 15344 | 38439 | 61534 |
| PPP3CA | 15345 | 38440 | 61535 |
| PPP3CB | 15346 | 38441 | 61536 |
| PPP3CB | 15347 | 38442 | 61537 |
| PPP3CC | 15348 | 38443 | 61538 |
| PPP3R1 | 15349 | 38444 | 61539 |
| PPP3R2 | 15350 | 38445 | 61540 |
| PPP4C | 15351 | 38446 | 61541 |
| PPP4R1 | 15352 | 38447 | 61542 |
| PPP4R2 | 15353 | 38448 | 61543 |
| PPP4R2 | 15354 | 38449 | 61544 |
| PPP4R3A | 15355 | 38450 | 61545 |
| PPP4R3B | 15356 | 38451 | 61546 |
| PPP4R3CP | 15357 | 38452 | 61547 |
| PPP4R4 | 15358 | 38453 | 61548 |
| PPP4R4 | 15359 | 38454 | 61549 |
| PPP4R4 | 15360 | 38455 | 61550 |
| PPP5C | 15361 | 38456 | 61551 |
| PPP5D1 | 15362 | 38457 | 61552 |
| PPP6C | 15363 | 38458 | 61553 |
| PPP6R1 | 15364 | 38459 | 61554 |
| PPP6R2 | 15365 | 38460 | 61555 |
| PPP6R2 | 15366 | 38461 | 61556 |
| PPP6R3 | 15367 | 38462 | 61557 |
| PPP6R3 | 15368 | 38463 | 61558 |
| PPRC1 | 15369 | 38464 | 61559 |
| PPT1 | 15370 | 38465 | 61560 |
| PPT2 | 15371 | 38466 | 61561 |
| PPTC7 | 15372 | 38467 | 61562 |
| PPWD1 | 15373 | 38468 | 61563 |
| PPY | 15374 | 38469 | 61564 |
| PQBP1 | 15375 | 38470 | 61565 |
| PQLC1 | 15376 | 38471 | 61566 |
| PQLC1 | 15377 | 38472 | 61567 |
| PQLC2 | 15378 | 38473 | 61568 |
| PQLC2L | 15379 | 38474 | 61569 |
| PQLC2L | 15380 | 38475 | 61570 |
| PQLC2L | 15381 | 38476 | 61571 |
| PQLC2L | 15382 | 38477 | 61572 |
| PQLC3 | 15383 | 38478 | 61573 |
| PQLC3 | 15384 | 38479 | 61574 |
| PQLC3 | 15385 | 38480 | 61575 |
| PRAC1 | 15386 | 38481 | 61576 |
| PRAC2 | 15387 | 38482 | 61577 |
| PRADC1 | 15388 | 38483 | 61578 |
| PRAF2 | 15389 | 38484 | 61579 |
| PRAG1 | 15390 | 38485 | 61580 |
| PRAM1 | 15391 | 38486 | 61581 |
| FRAME | 15392 | 38487 | 61582 |
| PRAMEF1 | 15393 | 38488 | 61583 |
| PRAMEF10 | 15394 | 38489 | 61584 |
| PRAMEF12 | 15395 | 38490 | 61585 |
| PRAMEF17 | 15396 | 38491 | 61586 |
| PRAMEF18 | 15397 | 38492 | 61587 |
| PRAMEF19 | 15398 | 38493 | 61588 |
| PRAMEF20 | 15399 | 38494 | 61589 |
| PRAMEF22 | 15400 | 38495 | 61590 |
| PRAMEF25 | 15401 | 38496 | 61591 |
| PRAMEF5 | 15402 | 38497 | 61592 |
| PRAMEF8 | 15403 | 38498 | 61593 |
| PRAP1 | 15404 | 38499 | 61594 |
| PRB1 | 15405 | 38500 | 61595 |
| PRB3 | 15406 | 38501 | 61596 |
| PRB4 | 15407 | 38502 | 61597 |
| PRC1 | 15408 | 38503 | 61598 |
| PRC1 | 15409 | 38504 | 61599 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| PRCC | 15410 | 38505 | 61600 |
| PRCD | 15411 | 38506 | 61601 |
| PRCP | 15412 | 38507 | 61602 |
| PRDM1 | 15413 | 38508 | 61603 |
| PRDM10 | 15414 | 38509 | 61604 |
| PRDM11 | 15415 | 38510 | 61605 |
| PRDM11 | 15416 | 38511 | 61606 |
| PRDM12 | 15417 | 38512 | 61607 |
| PRDM13 | 15418 | 38513 | 61608 |
| PRDM14 | 15419 | 38514 | 61609 |
| PRDM15 | 15420 | 38515 | 61610 |
| PRDM16 | 15421 | 38516 | 61611 |
| PRDM2 | 15422 | 38517 | 61612 |
| PRDM2 | 15423 | 38518 | 61613 |
| PRDM2 | 15424 | 38519 | 61614 |
| PRDM4 | 15425 | 38520 | 61615 |
| PRDM5 | 15426 | 38521 | 61616 |
| PRDM5 | 15427 | 38522 | 61617 |
| PRDM6 | 15428 | 38523 | 61618 |
| PRDM7 | 15429 | 38524 | 61619 |
| PRDM8 | 15430 | 38525 | 61620 |
| PRDM9 | 15431 | 38526 | 61621 |
| PRDX1 | 15432 | 38527 | 61622 |
| PRDX2 | 15433 | 38528 | 61623 |
| PRDX3 | 15434 | 38529 | 61624 |
| PRDX4 | 15435 | 38530 | 61625 |
| PRDX5 | 15436 | 38531 | 61626 |
| PRDX6 | 15437 | 38532 | 61627 |
| PREB | 15438 | 38533 | 61628 |
| PREB | 15439 | 38534 | 61629 |
| PRELID1 | 15440 | 38535 | 61630 |
| PRELID2 | 15441 | 38536 | 61631 |
| PRELID3A | 15442 | 38537 | 61632 |
| PRELID3B | 15443 | 38538 | 61633 |
| PRELP | 15444 | 38539 | 61634 |
| PREP | 15445 | 38540 | 61635 |
| PREPL | 15446 | 38541 | 61636 |
| PREX1 | 15447 | 38542 | 61637 |
| PREX2 | 15448 | 38543 | 61638 |
| PREX2 | 15449 | 38544 | 61639 |
| PRF1 | 15450 | 38545 | 61640 |
| PRG2 | 15451 | 38546 | 61641 |
| PRG3 | 15452 | 38547 | 61642 |
| PRG4 | 15453 | 38548 | 61643 |
| PRH2 | 15454 | 38549 | 61644 |
| PRICKLE1 | 15455 | 38550 | 61645 |
| PRICKLE2 | 15456 | 38551 | 61646 |
| PRICKLE3 | 15457 | 38552 | 61647 |
| PRICKLE4 | 15458 | 38553 | 61648 |
| PRIM1 | 15459 | 38554 | 61649 |
| PRIM2 | 15460 | 38555 | 61650 |
| PRIM2 | 15461 | 38556 | 61651 |
| PRIMA1 | 15462 | 38557 | 61652 |
| PRIMPOL | 15463 | 38558 | 61653 |
| PRKAA1 | 15464 | 38559 | 61654 |
| PRKAA2 | 15465 | 38560 | 61655 |
| PRKAB1 | 15466 | 38561 | 61656 |
| PRKAB2 | 15467 | 38562 | 61657 |
| PRKACA | 15468 | 38563 | 61658 |
| PRKACB | 15469 | 38564 | 61659 |
| PRKACB | 15470 | 38565 | 61660 |
| PRKAG1 | 15471 | 38566 | 61661 |
| PRKAG2 | 15472 | 38567 | 61662 |
| PRKAG3 | 15473 | 38568 | 61663 |
| PRKAR1A | 15474 | 38569 | 61664 |
| PRKAR1A | 15475 | 38570 | 61665 |
| PRKAR1B | 15476 | 38571 | 61666 |
| PRKAR2A | 15477 | 38572 | 61667 |
| PRKAR2A | 15478 | 38573 | 61668 |
| PRKAR2B | 15479 | 38574 | 61669 |
| PRKCA | 15480 | 38575 | 61670 |
| PRKCB | 15481 | 38576 | 61671 |
| PRKCB | 15482 | 38577 | 61672 |
| PRKCD | 15483 | 38578 | 61673 |
| PRKCE | 15484 | 38579 | 61674 |
| PRKCG | 15485 | 38580 | 61675 |
| PRKCG | 15486 | 38581 | 61676 |
| PRKCH | 15487 | 38582 | 61677 |
| PRKCI | 15488 | 38583 | 61678 |
| PRKCQ | 15489 | 38584 | 61679 |
| PRKCQ | 15490 | 38585 | 61680 |
| PRKCSH | 15491 | 38586 | 61681 |
| PRKCZ | 15492 | 38587 | 61682 |
| PRKD1 | 15493 | 38588 | 61683 |
| PRKD2 | 15494 | 38589 | 61684 |
| PRKD3 | 15495 | 38590 | 61685 |
| PRKDC | 15496 | 38591 | 61686 |
| PRKG1 | 15497 | 38592 | 61687 |
| PRKG2 | 15498 | 38593 | 61688 |
| PRKN | 15499 | 38594 | 61689 |
| PRKRA | 15500 | 38595 | 61690 |
| PRKRIP1 | 15501 | 38596 | 61691 |
| PRKX | 15502 | 38597 | 61692 |
| PRL | 15503 | 38598 | 61693 |
| PRLH | 15504 | 38599 | 61694 |
| PRLHR | 15505 | 38600 | 61695 |
| PRLR | 15506 | 38601 | 61696 |
| PRLR | 15507 | 38602 | 61697 |
| PRLR | 15508 | 38603 | 61698 |
| PRLR | 15509 | 38604 | 61699 |
| PRM1 | 15510 | 38605 | 61700 |
| PRM2 | 15511 | 38606 | 61701 |
| PRM2 | 15512 | 38607 | 61702 |
| PRM2 | 15513 | 38608 | 61703 |
| PRM2 | 15514 | 38609 | 61704 |
| PRM3 | 15515 | 38610 | 61705 |
| PRMT1 | 15516 | 38611 | 61706 |
| PRMT2 | 15517 | 38612 | 61707 |
| PRMT2 | 15518 | 38613 | 61708 |
| PRMT2 | 15519 | 38614 | 61709 |
| PRMT2 | 15520 | 38615 | 61710 |
| PRMT3 | 15521 | 38616 | 61711 |
| PRMT5 | 15522 | 38617 | 61712 |
| PRMT6 | 15523 | 38618 | 61713 |
| PRMT7 | 15524 | 38619 | 61714 |
| PRMT7 | 15525 | 38620 | 61715 |
| PRMT8 | 15526 | 38621 | 61716 |
| PRMT9 | 15527 | 38622 | 61717 |
| PRND | 15528 | 38623 | 61718 |
| PRNP | 15529 | 38624 | 61719 |
| PROB1 | 15530 | 38625 | 61720 |
| PROC | 15531 | 38626 | 61721 |
| PROCA1 | 15532 | 38627 | 61722 |
| PROCR | 15533 | 38628 | 61723 |
| PRODH | 15534 | 38629 | 61724 |
| PRODH2 | 15535 | 38630 | 61725 |
| PROK1 | 15536 | 38631 | 61726 |
| PROK2 | 15537 | 38632 | 61727 |
| PROKR1 | 15538 | 38633 | 61728 |
| PROKR2 | 15539 | 38634 | 61729 |
| PROM1 | 15540 | 38635 | 61730 |
| PROM2 | 15541 | 38636 | 61731 |
| PROP1 | 15542 | 38637 | 61732 |
| PRORY | 15543 | 38638 | 61733 |
| PROS1 | 15544 | 38639 | 61734 |
| PROSER1 | 15545 | 38640 | 61735 |
| PROSER2 | 15546 | 38641 | 61736 |
| PROSER3 | 15547 | 38642 | 61737 |
| PROX1 | 15548 | 38643 | 61738 |
| PROX2 | 15549 | 38644 | 61739 |
| PROZ | 15550 | 38645 | 61740 |
| PRPF18 | 15551 | 38646 | 61741 |
| PRPF19 | 15552 | 38647 | 61742 |
| PRPF3 | 15553 | 38648 | 61743 |
| PRPF3 | 15554 | 38649 | 61744 |
| PRPF3 | 15555 | 38650 | 61745 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| PRPF3 | 15556 | 38651 | 61746 |
| PRPF31 | 15557 | 38652 | 61747 |
| PRPF38A | 15558 | 38653 | 61748 |
| PRPF38B | 15559 | 38654 | 61749 |
| PRPF39 | 15560 | 38655 | 61750 |
| PRPF4 | 15561 | 38656 | 61751 |
| PRPF4 | 15562 | 38657 | 61752 |
| PRPF40A | 15563 | 38658 | 61753 |
| PRPF40B | 15564 | 38659 | 61754 |
| PRPF4B | 15565 | 38660 | 61755 |
| PRPF6 | 15566 | 38661 | 61756 |
| PRPF8 | 15567 | 38662 | 61757 |
| PRPH | 15568 | 38663 | 61758 |
| PRPH2 | 15569 | 38664 | 61759 |
| PRPS1 | 15570 | 38665 | 61760 |
| PRPS1L1 | 15571 | 38666 | 61761 |
| PRPS2 | 15572 | 38667 | 61762 |
| PRPSAP1 | 15573 | 38668 | 61763 |
| PRPSAP2 | 15574 | 38669 | 61764 |
| PRR11 | 15575 | 38670 | 61765 |
| PRR12 | 15576 | 38671 | 61766 |
| PRR13 | 15577 | 38672 | 61767 |
| PRR14 | 15578 | 38673 | 61768 |
| PRR14L | 15579 | 38674 | 61769 |
| PRR15 | 15580 | 38675 | 61770 |
| PRR15L | 15581 | 38676 | 61771 |
| PRR16 | 15582 | 38677 | 61772 |
| PRR18 | 15583 | 38678 | 61773 |
| PRR19 | 15584 | 38679 | 61774 |
| PRR20E | 15585 | 38680 | 61775 |
| PRR22 | 15586 | 38681 | 61776 |
| PRR23A | 15587 | 38682 | 61777 |
| PRR23B | 15588 | 38683 | 61778 |
| PRR23C | 15589 | 38684 | 61779 |
| PRR23D2 | 15590 | 38685 | 61780 |
| PRR25 | 15591 | 38686 | 61781 |
| PRR27 | 15592 | 38687 | 61782 |
| PRR29 | 15593 | 38688 | 61783 |
| PRR29 | 15594 | 38689 | 61784 |
| PRR29 | 15595 | 38690 | 61785 |
| PRR3 | 15596 | 38691 | 61786 |
| PRR30 | 15597 | 38692 | 61787 |
| PRR31 | 15598 | 38693 | 61788 |
| PRR32 | 15599 | 38694 | 61789 |
| PRR34 | 15600 | 38695 | 61790 |
| PRR35 | 15601 | 38696 | 61791 |
| PRR36 | 15602 | 38697 | 61792 |
| PRR4 | 15603 | 38698 | 61793 |
| PRR4 | 15604 | 38699 | 61794 |
| PRR5 | 15605 | 38700 | 61795 |
| PRR5L | 15606 | 38701 | 61796 |
| PRR5L | 15607 | 38702 | 61797 |
| PRR7 | 15608 | 38703 | 61798 |
| PRR9 | 15609 | 38704 | 61799 |
| PRRC1 | 15610 | 38705 | 61800 |
| PRRC1 | 15611 | 38706 | 61801 |
| PRRC2A | 15612 | 38707 | 61802 |
| PRRC2B | 15613 | 38708 | 61803 |
| PRRC2C | 15614 | 38709 | 61804 |
| PRRG1 | 15615 | 38710 | 61805 |
| PRRG1 | 15616 | 38711 | 61806 |
| PRRG2 | 15617 | 38712 | 61807 |
| PRRG3 | 15618 | 38713 | 61808 |
| PRRG4 | 15619 | 38714 | 61809 |
| PRRT1 | 15620 | 38715 | 61810 |
| PRRT2 | 15621 | 38716 | 61811 |
| PRRT2 | 15622 | 38717 | 61812 |
| PRRT2 | 15623 | 38718 | 61813 |
| PRRT3 | 15624 | 38719 | 61814 |
| PRRT3 | 15625 | 38720 | 61815 |
| PRRT4 | 15626 | 38721 | 61816 |
| PRRT4 | 15627 | 38722 | 61817 |
| PRRX1 | 15628 | 38723 | 61818 |
| PRRX1 | 15629 | 38724 | 61819 |
| PRRX2 | 15630 | 38725 | 61820 |
| PRSS1 | 15631 | 38726 | 61821 |
| PRSS12 | 15632 | 38727 | 61822 |
| PRSS16 | 15633 | 38728 | 61823 |
| PRSS2 | 15634 | 38729 | 61824 |
| PRSS21 | 15635 | 38730 | 61825 |
| PRSS21 | 15636 | 38731 | 61826 |
| PRSS22 | 15637 | 38732 | 61827 |
| PRSS23 | 15638 | 38733 | 61828 |
| PRSS27 | 15639 | 38734 | 61829 |
| PRSS3 | 15640 | 38735 | 61830 |
| PRSS33 | 15641 | 38736 | 61831 |
| PRSS35 | 15642 | 38737 | 61832 |
| PRSS36 | 15643 | 38738 | 61833 |
| PRSS37 | 15644 | 38739 | 61834 |
| PRSS38 | 15645 | 38740 | 61835 |
| PRSS41 | 15646 | 38741 | 61836 |
| PRSS42 | 15647 | 38742 | 61837 |
| PRSS45 | 15648 | 38743 | 61838 |
| PRSS47 | 15649 | 38744 | 61839 |
| PRSS48 | 15650 | 38745 | 61840 |
| PRSS48 | 15651 | 38746 | 61841 |
| PRSS50 | 15652 | 38747 | 61842 |
| PRSS53 | 15653 | 38748 | 61843 |
| PRSS54 | 15654 | 38749 | 61844 |
| PRSS55 | 15655 | 38750 | 61845 |
| PRSS55 | 15656 | 38751 | 61846 |
| PRSS56 | 15657 | 38752 | 61847 |
| PRSS57 | 15658 | 38753 | 61848 |
| PRSS58 | 15659 | 38754 | 61849 |
| PRSS8 | 15660 | 38755 | 61850 |
| PRTFDC1 | 15661 | 38756 | 61851 |
| PRTFDC1 | 15662 | 38757 | 61852 |
| PRTG | 15663 | 38758 | 61853 |
| PRTN3 | 15664 | 38759 | 61854 |
| PRUNE1 | 15665 | 38760 | 61855 |
| PRUNE2 | 15666 | 38761 | 61856 |
| PRX | 15667 | 38762 | 61857 |
| PRY | 15668 | 38763 | 61858 |
| PSAP | 15669 | 38764 | 61859 |
| PSAPL1 | 15670 | 38765 | 61860 |
| PSAT1 | 15671 | 38766 | 61861 |
| PSCA | 15672 | 38767 | 61862 |
| PSD | 15673 | 38768 | 61863 |
| PSD2 | 15674 | 38769 | 61864 |
| PSD3 | 15675 | 38770 | 61865 |
| PSD4 | 15676 | 38771 | 61866 |
| PSEN1 | 15677 | 38772 | 61867 |
| PSEN2 | 15678 | 38773 | 61868 |
| PSENEN | 15679 | 38774 | 61869 |
| PSG1 | 15680 | 38775 | 61870 |
| PSG1 | 15681 | 38776 | 61871 |
| PSG1 | 15682 | 38777 | 61872 |
| PSG11 | 15683 | 38778 | 61873 |
| PSG2 | 15684 | 38779 | 61874 |
| PSG3 | 15685 | 38780 | 61875 |
| PSG4 | 15686 | 38781 | 61876 |
| PSG5 | 15687 | 38782 | 61877 |
| PSG6 | 15688 | 38783 | 61878 |
| PSG6 | 15689 | 38784 | 61879 |
| PSG7 | 15690 | 38785 | 61880 |
| PSG8 | 15691 | 38786 | 61881 |
| PSG8 | 15692 | 38787 | 61882 |
| PSG9 | 15693 | 38788 | 61883 |
| PSIP1 | 15694 | 38789 | 61884 |
| PSIP1 | 15695 | 38790 | 61885 |
| PSKH1 | 15696 | 38791 | 61886 |
| PSKH2 | 15697 | 38792 | 61887 |
| PSMA1 | 15698 | 38793 | 61888 |
| PSMA1 | 15699 | 38794 | 61889 |
| PSMA2 | 15700 | 38795 | 61890 |
| PSMA3 | 15701 | 38796 | 61891 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| PSMA4 | 15702 | 38797 | 61892 |
| PSMA4 | 15703 | 38798 | 61893 |
| PSMA5 | 15704 | 38799 | 61894 |
| PSMA6 | 15705 | 38800 | 61895 |
| PSMA7 | 15706 | 38801 | 61896 |
| PSMA8 | 15707 | 38802 | 61897 |
| PSMB1 | 15708 | 38803 | 61898 |
| PSMB10 | 15709 | 38804 | 61899 |
| PSMB11 | 15710 | 38805 | 61900 |
| PSMB2 | 15711 | 38806 | 61901 |
| PSMB3 | 15712 | 38807 | 61902 |
| PSMB4 | 15713 | 38808 | 61903 |
| PSMB5 | 15714 | 38809 | 61904 |
| PSMB5 | 15715 | 38810 | 61905 |
| PSMB6 | 15716 | 38811 | 61906 |
| PSMB6 | 15717 | 38812 | 61907 |
| PSMB7 | 15718 | 38813 | 61908 |
| PSMB8 | 15719 | 38814 | 61909 |
| PSMB9 | 15720 | 38815 | 61910 |
| PSMC1 | 15721 | 38816 | 61911 |
| PSMC2 | 15722 | 38817 | 61912 |
| PSMC2 | 15723 | 38818 | 61913 |
| PSMC3 | 15724 | 38819 | 61914 |
| PSMC3IP | 15725 | 38820 | 61915 |
| PSMC4 | 15726 | 38821 | 61916 |
| PSMC5 | 15727 | 38822 | 61917 |
| PSMC6 | 15728 | 38823 | 61918 |
| PSMD1 | 15729 | 38824 | 61919 |
| PSMD10 | 15730 | 38825 | 61920 |
| PSMD10 | 15731 | 38826 | 61921 |
| PSMD11 | 15732 | 38827 | 61922 |
| PSMD11 | 15733 | 38828 | 61923 |
| PSMD12 | 15734 | 38829 | 61924 |
| PSMD13 | 15735 | 38830 | 61925 |
| PSMD14 | 15736 | 38831 | 61926 |
| PSMD2 | 15737 | 38832 | 61927 |
| PSMD3 | 15738 | 38833 | 61928 |
| PSMD4 | 15739 | 38834 | 61929 |
| PSMD5 | 15740 | 38835 | 61930 |
| PSMD6 | 15741 | 38836 | 61931 |
| PSMD7 | 15742 | 38837 | 61932 |
| PSMD8 | 15743 | 38838 | 61933 |
| PSMD9 | 15744 | 38839 | 61934 |
| PSME1 | 15745 | 38840 | 61935 |
| PSME1 | 15746 | 38841 | 61936 |
| PSME1 | 15747 | 38842 | 61937 |
| PSME2 | 15748 | 38843 | 61938 |
| PSME3 | 15749 | 38844 | 61939 |
| PSME4 | 15750 | 38845 | 61940 |
| PSMF1 | 15751 | 38846 | 61941 |
| PSMF1 | 15752 | 38847 | 61942 |
| PSMF1 | 15753 | 38848 | 61943 |
| PSMF1 | 15754 | 38849 | 61944 |
| PSMG1 | 15755 | 38850 | 61945 |
| PSMG2 | 15756 | 38851 | 61946 |
| PSMG3 | 15757 | 38852 | 61947 |
| PSMG4 | 15758 | 38853 | 61948 |
| PSMG4 | 15759 | 38854 | 61949 |
| PSORS1C1 | 15760 | 38855 | 61950 |
| PSORS1C2 | 15761 | 38856 | 61951 |
| PSPC1 | 15762 | 38857 | 61952 |
| PSPH | 15763 | 38858 | 61953 |
| PSPN | 15764 | 38859 | 61954 |
| PSRC1 | 15765 | 38860 | 61955 |
| PSTK | 15766 | 38861 | 61956 |
| PSTPIP1 | 15767 | 38862 | 61957 |
| PSTPIP2 | 15768 | 38863 | 61958 |
| PTAFR | 15769 | 38864 | 61959 |
| PTAR1 | 15770 | 38865 | 61960 |
| PTBP1 | 15771 | 38866 | 61961 |
| PTBP2 | 15772 | 38867 | 61962 |
| PTBP3 | 15773 | 38868 | 61963 |
| PTBP3 | 15774 | 38869 | 61964 |
| PTCD1 | 15775 | 38870 | 61965 |
| PTCD2 | 15776 | 38871 | 61966 |
| PTCD3 | 15777 | 38872 | 61967 |
| PTCH1 | 15778 | 38873 | 61968 |
| PTCH2 | 15779 | 38874 | 61969 |
| PTCH2 | 15780 | 38875 | 61970 |
| PTCHD1 | 15781 | 38876 | 61971 |
| PTCHD3 | 15782 | 38877 | 61972 |
| PTCHD4 | 15783 | 38878 | 61973 |
| PTCHD4 | 15784 | 38879 | 61974 |
| PTCRA | 15785 | 38880 | 61975 |
| PTDSS1 | 15786 | 38881 | 61976 |
| PTDSS2 | 15787 | 38882 | 61977 |
| PTEN | 15788 | 38883 | 61978 |
| PTER | 15789 | 38884 | 61979 |
| PTF1A | 15790 | 38885 | 61980 |
| PTGDR | 15791 | 38886 | 61981 |
| PTGDR | 15792 | 38887 | 61982 |
| PTGDR2 | 15793 | 38888 | 61983 |
| PTGDS | 15794 | 38889 | 61984 |
| PTGER1 | 15795 | 38890 | 61985 |
| PTGER2 | 15796 | 38891 | 61986 |
| PTGER3 | 15797 | 38892 | 61987 |
| PTGER3 | 15798 | 38893 | 61988 |
| PTGER3 | 15799 | 38894 | 61989 |
| PTGER3 | 15800 | 38895 | 61990 |
| PTGER3 | 15801 | 38896 | 61991 |
| PTGER4 | 15802 | 38897 | 61992 |
| PTGES | 15803 | 38898 | 61993 |
| PTGES2 | 15804 | 38899 | 61994 |
| PTGES3 | 15805 | 38900 | 61995 |
| PTGES3L | 15806 | 38901 | 61996 |
| PTGFR | 15807 | 38902 | 61997 |
| PTGFR | 15808 | 38903 | 61998 |
| PTGFRN | 15809 | 38904 | 61999 |
| PTGIR | 15810 | 38905 | 62000 |
| PTGIS | 15811 | 38906 | 62001 |
| PTGR1 | 15812 | 38907 | 62002 |
| PTGR1 | 15813 | 38908 | 62003 |
| PTGR2 | 15814 | 38909 | 62004 |
| PTGS1 | 15815 | 38910 | 62005 |
| PTGS2 | 15816 | 38911 | 62006 |
| PTH | 15817 | 38912 | 62007 |
| PTH1R | 15818 | 38913 | 62008 |
| PTH2 | 15819 | 38914 | 62009 |
| PTH2R | 15820 | 38915 | 62010 |
| PTHLH | 15821 | 38916 | 62011 |
| PTHLH | 15822 | 38917 | 62012 |
| PTK2 | 15823 | 38918 | 62013 |
| PTK2 | 15824 | 38919 | 62014 |
| PTK2B | 15825 | 38920 | 62015 |
| PTK6 | 15826 | 38921 | 62016 |
| PTK7 | 15827 | 38922 | 62017 |
| PTMA | 15828 | 38923 | 62018 |
| PTMS | 15829 | 38924 | 62019 |
| PTN | 15830 | 38925 | 62020 |
| PTOV1 | 15831 | 38926 | 62021 |
| PTOV1 | 15832 | 38927 | 62022 |
| PTP4A1 | 15833 | 38928 | 62023 |
| PTP4A2 | 15834 | 38929 | 62024 |
| PTP4A2 | 15835 | 38930 | 62025 |
| PTP4A3 | 15836 | 38931 | 62026 |
| PTPA | 15837 | 38932 | 62027 |
| PTPDC1 | 15838 | 38933 | 62028 |
| PTPMT1 | 15839 | 38934 | 62029 |
| PTPMT1 | 15840 | 38935 | 62030 |
| PTPN1 | 15841 | 38936 | 62031 |
| PTPN11 | 15842 | 38937 | 62032 |
| PTPN11 | 15843 | 38938 | 62033 |
| PTPN12 | 15844 | 38939 | 62034 |
| PTPN13 | 15845 | 38940 | 62035 |
| PTPN14 | 15846 | 38941 | 62036 |
| PTPN18 | 15847 | 38942 | 62037 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| PTPN2 | 15848 | 38943 | 62038 |
| PTPN2 | 15849 | 38944 | 62039 |
| PTPN20 | 15850 | 38945 | 62040 |
| PTPN20 | 15851 | 38946 | 62041 |
| PTPN20 | 15852 | 38947 | 62042 |
| PTPN20 | 15853 | 38948 | 62043 |
| PTPN20 | 15854 | 38949 | 62044 |
| PTPN21 | 15855 | 38950 | 62045 |
| PTPN22 | 15856 | 38951 | 62046 |
| PTPN23 | 15857 | 38952 | 62047 |
| PTPN3 | 15858 | 38953 | 62048 |
| PTPN4 | 15859 | 38954 | 62049 |
| PTPN5 | 15860 | 38955 | 62050 |
| PTPN6 | 15861 | 38956 | 62051 |
| PTPN6 | 15862 | 38957 | 62052 |
| PTPN7 | 15863 | 38958 | 62053 |
| PTPN9 | 15864 | 38959 | 62054 |
| PTPRA | 15865 | 38960 | 62055 |
| PTPRB | 15866 | 38961 | 62056 |
| PTPRC | 15867 | 38962 | 62057 |
| PTPRC | 15868 | 38963 | 62058 |
| PTPRCAP | 15869 | 38964 | 62059 |
| PTPRD | 15870 | 38965 | 62060 |
| PTPRE | 15871 | 38966 | 62061 |
| PTPRF | 15872 | 38967 | 62062 |
| PTPRG | 15873 | 38968 | 62063 |
| PTPRH | 15874 | 38969 | 62064 |
| PTPRJ | 15875 | 38970 | 62065 |
| PTPRJ | 15876 | 38971 | 62066 |
| PTPRK | 15877 | 38972 | 62067 |
| PTPRK | 15878 | 38973 | 62068 |
| PTPRM | 15879 | 38974 | 62069 |
| PTPRN | 15880 | 38975 | 62070 |
| PTPRN2 | 15881 | 38976 | 62071 |
| PTPRO | 15882 | 38977 | 62072 |
| PTPRQ | 15883 | 38978 | 62073 |
| PTPRR | 15884 | 38979 | 62074 |
| PTPRS | 15885 | 38980 | 62075 |
| PTPRT | 15886 | 38981 | 62076 |
| PTPRU | 15887 | 38982 | 62077 |
| PTPRZ1 | 15888 | 38983 | 62078 |
| PTRH1 | 15889 | 38984 | 62079 |
| PTRH1 | 15890 | 38985 | 62080 |
| PTRH2 | 15891 | 38986 | 62081 |
| PTRH2 | 15892 | 38987 | 62082 |
| PTRHD1 | 15893 | 38988 | 62083 |
| PTS | 15894 | 38989 | 62084 |
| PTTG1 | 15895 | 38990 | 62085 |
| PTTG1IP | 15896 | 38991 | 62086 |
| PTTG1IP | 15897 | 38992 | 62087 |
| PTTG2 | 15898 | 38993 | 62088 |
| PTX3 | 15899 | 38994 | 62089 |
| PTX4 | 15900 | 38995 | 62090 |
| PUDP | 15901 | 38996 | 62091 |
| PUDP | 15902 | 38997 | 62092 |
| PUF60 | 15903 | 38998 | 62093 |
| PUM1 | 15904 | 38999 | 62094 |
| PUM2 | 15905 | 39000 | 62095 |
| PUM3 | 15906 | 39001 | 62096 |
| PURA | 15907 | 39002 | 62097 |
| PURB | 15908 | 39003 | 62098 |
| PURG | 15909 | 39004 | 62099 |
| PURG | 15910 | 39005 | 62100 |
| PUS1 | 15911 | 39006 | 62101 |
| PUS10 | 15912 | 39007 | 62102 |
| PUS3 | 15913 | 39008 | 62103 |
| PUS7 | 15914 | 39009 | 62104 |
| PUS7L | 15915 | 39010 | 62105 |
| PUSL1 | 15916 | 39011 | 62106 |
| PVALB | 15917 | 39012 | 62107 |
| PVR | 15918 | 39013 | 62108 |
| PVR | 15919 | 39014 | 62109 |
| PVRIG | 15920 | 39015 | 62110 |
| PWP1 | 15921 | 39016 | 62111 |
| PWP2 | 15922 | 39017 | 62112 |
| PWWP2A | 15923 | 39018 | 62113 |
| PWWP2A | 15924 | 39019 | 62114 |
| PWWP2A | 15925 | 39020 | 62115 |
| PWWP2B | 15926 | 39021 | 62116 |
| PWWP2B | 15927 | 39022 | 62117 |
| PXDC1 | 15928 | 39023 | 62118 |
| PXDN | 15929 | 39024 | 62119 |
| PXDNL | 15930 | 39025 | 62120 |
| PXK | 15931 | 39026 | 62121 |
| PXK | 15932 | 39027 | 62122 |
| PXK | 15933 | 39028 | 62123 |
| PXK | 15934 | 39029 | 62124 |
| PXMP2 | 15935 | 39030 | 62125 |
| PXMP4 | 15936 | 39031 | 62126 |
| PXMP4 | 15937 | 39032 | 62127 |
| PXN | 15938 | 39033 | 62128 |
| PXT1 | 15939 | 39034 | 62129 |
| PXYLP1 | 15940 | 39035 | 62130 |
| PYCARD | 15941 | 39036 | 62131 |
| PYCR1 | 15942 | 39037 | 62132 |
| PYCR1 | 15943 | 39038 | 62133 |
| PYCR1 | 15944 | 39039 | 62134 |
| PYCR2 | 15945 | 39040 | 62135 |
| PYCR3 | 15946 | 39041 | 62136 |
| PYDC1 | 15947 | 39042 | 62137 |
| PYDC2 | 15948 | 39043 | 62138 |
| PYGB | 15949 | 39044 | 62139 |
| PYGL | 15950 | 39045 | 62140 |
| PYGM | 15951 | 39046 | 62141 |
| PYGO1 | 15952 | 39047 | 62142 |
| PYGO2 | 15953 | 39048 | 62143 |
| PYHIN1 | 15954 | 39049 | 62144 |
| PYHIN1 | 15955 | 39050 | 62145 |
| PYM1 | 15956 | 39051 | 62146 |
| PYROXD1 | 15957 | 39052 | 62147 |
| PYROXD2 | 15958 | 39053 | 62148 |
| PYY | 15959 | 39054 | 62149 |
| PZP | 15960 | 39055 | 62150 |
| QARS | 15961 | 39056 | 62151 |
| QDPR | 15962 | 39057 | 62152 |
| QKI | 15963 | 39058 | 62153 |
| QKI | 15964 | 39059 | 62154 |
| QKI | 15965 | 39060 | 62155 |
| QKI | 15966 | 39061 | 62156 |
| QPCT | 15967 | 39062 | 62157 |
| QPCTL | 15968 | 39063 | 62158 |
| QPRT | 15969 | 39064 | 62159 |
| QRFP | 15970 | 39065 | 62160 |
| QRFPR | 15971 | 39066 | 62161 |
| QRICH1 | 15972 | 39067 | 62162 |
| QRICH2 | 15973 | 39068 | 62163 |
| QRSL1 | 15974 | 39069 | 62164 |
| QSER1 | 15975 | 39070 | 62165 |
| QSOX1 | 15976 | 39071 | 62166 |
| QSOX1 | 15977 | 39072 | 62167 |
| QSOX2 | 15978 | 39073 | 62168 |
| QTRT1 | 15979 | 39074 | 62169 |
| QTRT2 | 15980 | 39075 | 62170 |
| R3HCC1 | 15981 | 39076 | 62171 |
| R3HCC1L | 15982 | 39077 | 62172 |
| R3HDM1 | 15983 | 39078 | 62173 |
| R3HDM2 | 15984 | 39079 | 62174 |
| R3HDM4 | 15985 | 39080 | 62175 |
| R3HDML | 15986 | 39081 | 62176 |
| RAB10 | 15987 | 39082 | 62177 |
| RAB11A | 15988 | 39083 | 62178 |
| RAB11A | 15989 | 39084 | 62179 |
| RAB11B | 15990 | 39085 | 62180 |
| RAB11FIP1 | 15991 | 39086 | 62181 |
| RAB11FIP2 | 15992 | 39087 | 62182 |
| RAB11FIP3 | 15993 | 39088 | 62183 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| RAB11FIP4 | 15994 | 39089 | 62184 |
| RAB11FIP5 | 15995 | 39090 | 62185 |
| RAB12 | 15996 | 39091 | 62186 |
| RAB13 | 15997 | 39092 | 62187 |
| RAB14 | 15998 | 39093 | 62188 |
| RAB15 | 15999 | 39094 | 62189 |
| RAB15 | 16000 | 39095 | 62190 |
| RAB17 | 16001 | 39096 | 62191 |
| RAB18 | 16002 | 39097 | 62192 |
| RAB18 | 16003 | 39098 | 62193 |
| RAB19 | 16004 | 39099 | 62194 |
| RAB1A | 16005 | 39100 | 62195 |
| RAB1B | 16006 | 39101 | 62196 |
| RAB20 | 16007 | 39102 | 62197 |
| RAB21 | 16008 | 39103 | 62198 |
| RAB22A | 16009 | 39104 | 62199 |
| RAB23 | 16010 | 39105 | 62200 |
| RAB24 | 16011 | 39106 | 62201 |
| RAB25 | 16012 | 39107 | 62202 |
| RAB26 | 16013 | 39108 | 62203 |
| RAB27A | 16014 | 39109 | 62204 |
| RAB27B | 16015 | 39110 | 62205 |
| RAB28 | 16016 | 39111 | 62206 |
| RAB28 | 16017 | 39112 | 62207 |
| RAB28 | 16018 | 39113 | 62208 |
| RAB29 | 16019 | 39114 | 62209 |
| RAB2A | 16020 | 39115 | 62210 |
| RAB2B | 16021 | 39116 | 62211 |
| RAB30 | 16022 | 39117 | 62212 |
| RAB31 | 16023 | 39118 | 62213 |
| RAB32 | 16024 | 39119 | 62214 |
| RAB33A | 16025 | 39120 | 62215 |
| RAB33B | 16026 | 39121 | 62216 |
| RAB34 | 16027 | 39122 | 62217 |
| RAB34 | 16028 | 39123 | 62218 |
| RAB35 | 16029 | 39124 | 62219 |
| RAB36 | 16030 | 39125 | 62220 |
| RAB36 | 16031 | 39126 | 62221 |
| RAB37 | 16032 | 39127 | 62222 |
| RAB38 | 16033 | 39128 | 62223 |
| RAB39A | 16034 | 39129 | 62224 |
| RAB39B | 16035 | 39130 | 62225 |
| RAB3A | 16036 | 39131 | 62226 |
| RAB3B | 16037 | 39132 | 62227 |
| RAB3C | 16038 | 39133 | 62228 |
| RAB3D | 16039 | 39134 | 62229 |
| RAB3GAP1 | 16040 | 39135 | 62230 |
| RAB3GAP2 | 16041 | 39136 | 62231 |
| RAB3IL1 | 16042 | 39137 | 62232 |
| RAB3IP | 16043 | 39138 | 62233 |
| RAB3IP | 16044 | 39139 | 62234 |
| RAB40B | 16045 | 39140 | 62235 |
| RAB40C | 16046 | 39141 | 62236 |
| RAB41 | 16047 | 39142 | 62237 |
| RAB42 | 16048 | 39143 | 62238 |
| RAB43 | 16049 | 39144 | 62239 |
| RAB43 | 16050 | 39145 | 62240 |
| RAB44 | 16051 | 39146 | 62241 |
| RAB4A | 16052 | 39147 | 62242 |
| RAB4B | 16053 | 39148 | 62243 |
| RAB5A | 16054 | 39149 | 62244 |
| RAB5B | 16055 | 39150 | 62245 |
| RAB5C | 16056 | 39151 | 62246 |
| RAB6A | 16057 | 39152 | 62247 |
| RAB6B | 16058 | 39153 | 62248 |
| RAB6C | 16059 | 39154 | 62249 |
| RAB7A | 16060 | 39155 | 62250 |
| RAB7B | 16061 | 39156 | 62251 |
| RAB8A | 16062 | 39157 | 62252 |
| RAB8B | 16063 | 39158 | 62253 |
| RAB9A | 16064 | 39159 | 62254 |
| RAB9B | 16065 | 39160 | 62255 |
| RABAC1 | 16066 | 39161 | 62256 |
| RABEP1 | 16067 | 39162 | 62257 |
| RABEP1 | 16068 | 39163 | 62258 |
| RABEP2 | 16069 | 39164 | 62259 |
| RABEPK | 16070 | 39165 | 62260 |
| RABGAP1 | 16071 | 39166 | 62261 |
| RABGAP1L | 16072 | 39167 | 62262 |
| RABGAP1L | 16073 | 39168 | 62263 |
| RABGEF1 | 16074 | 39169 | 62264 |
| RABGGTA | 16075 | 39170 | 62265 |
| RABGGTB | 16076 | 39171 | 62266 |
| RABIF | 16077 | 39172 | 62267 |
| RABL2A | 16078 | 39173 | 62268 |
| RABL2A | 16079 | 39174 | 62269 |
| RABL3 | 16080 | 39175 | 62270 |
| RABL6 | 16081 | 39176 | 62271 |
| RABL6 | 16082 | 39177 | 62272 |
| RAC1 | 16083 | 39178 | 62273 |
| RAC2 | 16084 | 39179 | 62274 |
| RAC3 | 16085 | 39180 | 62275 |
| RAC3 | 16086 | 39181 | 62276 |
| RACGAP1 | 16087 | 39182 | 62277 |
| RACK1 | 16088 | 39183 | 62278 |
| RAD1 | 16089 | 39184 | 62279 |
| RAD17 | 16090 | 39185 | 62280 |
| RAD18 | 16091 | 39186 | 62281 |
| RAD21 | 16092 | 39187 | 62282 |
| RAD21L1 | 16093 | 39188 | 62283 |
| RAD23A | 16094 | 39189 | 62284 |
| RAD23B | 16095 | 39190 | 62285 |
| RAD50 | 16096 | 39191 | 62286 |
| RAD51 | 16097 | 39192 | 62287 |
| RAD51 | 16098 | 39193 | 62288 |
| RAD51AP1 | 16099 | 39194 | 62289 |
| RAD51AP2 | 16100 | 39195 | 62290 |
| RAD51B | 16101 | 39196 | 62291 |
| RAD51B | 16102 | 39197 | 62292 |
| RAD51B | 16103 | 39198 | 62293 |
| RAD51B | 16104 | 39199 | 62294 |
| RAD51B | 16105 | 39200 | 62295 |
| RAD51B | 16106 | 39201 | 62296 |
| RAD51B | 16107 | 39202 | 62297 |
| RAD51B | 16108 | 39203 | 62298 |
| RAD51C | 16109 | 39204 | 62299 |
| RAD51C | 16110 | 39205 | 62300 |
| RAD51D | 16111 | 39206 | 62301 |
| RAD52 | 16112 | 39207 | 62302 |
| RAD52 | 16113 | 39208 | 62303 |
| RAD52 | 16114 | 39209 | 62304 |
| RAD54B | 16115 | 39210 | 62305 |
| RAD54L | 16116 | 39211 | 62306 |
| RAD54L2 | 16117 | 39212 | 62307 |
| RAD9A | 16118 | 39213 | 62308 |
| RAD9B | 16119 | 39214 | 62309 |
| RAD9B | 16120 | 39215 | 62310 |
| RAD9B | 16121 | 39216 | 62311 |
| RADIL | 16122 | 39217 | 62312 |
| RAE1 | 16123 | 39218 | 62313 |
| RAET1E | 16124 | 39219 | 62314 |
| RAET1E | 16125 | 39220 | 62315 |
| RAET1E | 16126 | 39221 | 62316 |
| RAET1G | 16127 | 39222 | 62317 |
| RAET1L | 16128 | 39223 | 62318 |
| RAF1 | 16129 | 39224 | 62319 |
| RAG1 | 16130 | 39225 | 62320 |
| RAG2 | 16131 | 39226 | 62321 |
| RAI1 | 16132 | 39227 | 62322 |
| RAI14 | 16133 | 39228 | 62323 |
| RAI2 | 16134 | 39229 | 62324 |
| RALA | 16135 | 39230 | 62325 |
| RALB | 16136 | 39231 | 62326 |
| RALBP1 | 16137 | 39232 | 62327 |
| RALGAPA1 | 16138 | 39233 | 62328 |
| RALGAPA1 | 16139 | 39234 | 62329 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| RALGAPA2 | 16140 | 39235 | 62330 |
| RALGAPB | 16141 | 39236 | 62331 |
| RALGDS | 16142 | 39237 | 62332 |
| RALGPS1 | 16143 | 39238 | 62333 |
| RALGPS1 | 16144 | 39239 | 62334 |
| RALGPS1 | 16145 | 39240 | 62335 |
| RALGPS2 | 16146 | 39241 | 62336 |
| RALY | 16147 | 39242 | 62337 |
| RALYL | 16148 | 39243 | 62338 |
| RAMP1 | 16149 | 39244 | 62339 |
| RAMP2 | 16150 | 39245 | 62340 |
| RAMP3 | 16151 | 39246 | 62341 |
| RAN | 16152 | 39247 | 62342 |
| RANBP1 | 16153 | 39248 | 62343 |
| RANBP10 | 16154 | 39249 | 62344 |
| RANBP17 | 16155 | 39250 | 62345 |
| RANBP2 | 16156 | 39251 | 62346 |
| RANBP3 | 16157 | 39252 | 62347 |
| RANBP3L | 16158 | 39253 | 62348 |
| RANBP3L | 16159 | 39254 | 62349 |
| RANBP3L | 16160 | 39255 | 62350 |
| RANBP6 | 16161 | 39256 | 62351 |
| RANBP9 | 16162 | 39257 | 62352 |
| RANGAP1 | 16163 | 39258 | 62353 |
| RANGRF | 16164 | 39259 | 62354 |
| RANGRF | 16165 | 39260 | 62355 |
| RANGRF | 16166 | 39261 | 62356 |
| RANGRF | 16167 | 39262 | 62357 |
| RAP1A | 16168 | 39263 | 62358 |
| RAP1B | 16169 | 39264 | 62359 |
| RAP1GAP | 16170 | 39265 | 62360 |
| RAP1GAP2 | 16171 | 39266 | 62361 |
| RAP1GDS1 | 16172 | 39267 | 62362 |
| RAP2A | 16173 | 39268 | 62363 |
| RAP2B | 16174 | 39269 | 62364 |
| RAP2C | 16175 | 39270 | 62365 |
| RAPGEF1 | 16176 | 39271 | 62366 |
| RAPGEF2 | 16177 | 39272 | 62367 |
| RAPGEF3 | 16178 | 39273 | 62368 |
| RAPGEF4 | 16179 | 39274 | 62369 |
| RAPGEF5 | 16180 | 39275 | 62370 |
| RAPGEF6 | 16181 | 39276 | 62371 |
| RAPGEF6 | 16182 | 39277 | 62372 |
| RAPGEF6 | 16183 | 39278 | 62373 |
| RAPGEF6 | 16184 | 39279 | 62374 |
| RAPGEFL1 | 16185 | 39280 | 62375 |
| RAPH1 | 16186 | 39281 | 62376 |
| RAPH1 | 16187 | 39282 | 62377 |
| RAPH1 | 16188 | 39283 | 62378 |
| RAPSN | 16189 | 39284 | 62379 |
| RARA | 16190 | 39285 | 62380 |
| RARB | 16191 | 39286 | 62381 |
| RARG | 16192 | 39287 | 62382 |
| RARRES1 | 16193 | 39288 | 62383 |
| RARRES1 | 16194 | 39289 | 62384 |
| RARRES2 | 16195 | 39290 | 62385 |
| RARRES3 | 16196 | 39291 | 62386 |
| RARS | 16197 | 39292 | 62387 |
| RARS2 | 16198 | 39293 | 62388 |
| RARS2 | 16199 | 39294 | 62389 |
| RASA1 | 16200 | 39295 | 62390 |
| RASA2 | 16201 | 39296 | 62391 |
| RASA3 | 16202 | 39297 | 62392 |
| RASA4 | 16203 | 39298 | 62393 |
| RASAL1 | 16204 | 39299 | 62394 |
| RASAL2 | 16205 | 39300 | 62395 |
| RASAL3 | 16206 | 39301 | 62396 |
| RASAL3 | 16207 | 39302 | 62397 |
| RASD1 | 16208 | 39303 | 62398 |
| RASD1 | 16209 | 39304 | 62399 |
| RASD2 | 16210 | 39305 | 62400 |
| RASEF | 16211 | 39306 | 62401 |
| RASGEF1A | 16212 | 39307 | 62402 |
| RASGEF1B | 16213 | 39308 | 62403 |
| RASGEF1C | 16214 | 39309 | 62404 |
| RASGRF1 | 16215 | 39310 | 62405 |
| RASGRF2 | 16216 | 39311 | 62406 |
| RASGRP1 | 16217 | 39312 | 62407 |
| RASGRP1 | 16218 | 39313 | 62408 |
| RASGRP2 | 16219 | 39314 | 62409 |
| RASGRP3 | 16220 | 39315 | 62410 |
| RASGRP4 | 16221 | 39316 | 62411 |
| RASIP1 | 16222 | 39317 | 62412 |
| RASL10A | 16223 | 39318 | 62413 |
| RASL10B | 16224 | 39319 | 62414 |
| RASL11A | 16225 | 39320 | 62415 |
| RASL11B | 16226 | 39321 | 62416 |
| RASL12 | 16227 | 39322 | 62417 |
| RASSF1 | 16228 | 39323 | 62418 |
| RASSF10 | 16229 | 39324 | 62419 |
| RASSF2 | 16230 | 39325 | 62420 |
| RASSF3 | 16231 | 39326 | 62421 |
| RASSF4 | 16232 | 39327 | 62422 |
| RASSF5 | 16233 | 39328 | 62423 |
| RASSF5 | 16234 | 39329 | 62424 |
| RASSF6 | 16235 | 39330 | 62425 |
| RASSF7 | 16236 | 39331 | 62426 |
| RASSF7 | 16237 | 39332 | 62427 |
| RASSF7 | 16238 | 39333 | 62428 |
| RASSF8 | 16239 | 39334 | 62429 |
| RASSF8 | 16240 | 39335 | 62430 |
| RASSF9 | 16241 | 39336 | 62431 |
| RAVER1 | 16242 | 39337 | 62432 |
| RAVER2 | 16243 | 39338 | 62433 |
| RAX | 16244 | 39339 | 62434 |
| RAX2 | 16245 | 39340 | 62435 |
| RB1 | 16246 | 39341 | 62436 |
| RB1CC1 | 16247 | 39342 | 62437 |
| RBAK | 16248 | 39343 | 62438 |
| RBAK-RBAKDN | 16249 | 39344 | 62439 |
| RBBP4 | 16250 | 39345 | 62440 |
| RBBP5 | 16251 | 39346 | 62441 |
| RBBP5 | 16252 | 39347 | 62442 |
| RBBP5 | 16253 | 39348 | 62443 |
| RBBP6 | 16254 | 39349 | 62444 |
| RBBP6 | 16255 | 39350 | 62445 |
| RBBP7 | 16256 | 39351 | 62446 |
| RBBP8 | 16257 | 39352 | 62447 |
| RBBP8NL | 16258 | 39353 | 62448 |
| RBBP9 | 16259 | 39354 | 62449 |
| RBCK1 | 16260 | 39355 | 62450 |
| RBCK1 | 16261 | 39356 | 62451 |
| RBFA | 16262 | 39357 | 62452 |
| RBFA | 16263 | 39358 | 62453 |
| RBFOX1 | 16264 | 39359 | 62454 |
| RBFOX1 | 16265 | 39360 | 62455 |
| RBFOX1 | 16266 | 39361 | 62456 |
| RBFOX2 | 16267 | 39362 | 62457 |
| RBFOX3 | 16268 | 39363 | 62458 |
| RBKS | 16269 | 39364 | 62459 |
| RBL1 | 16270 | 39365 | 62460 |
| RBL1 | 16271 | 39366 | 62461 |
| RBL2 | 16272 | 39367 | 62462 |
| RBL2 | 16273 | 39368 | 62463 |
| RBM10 | 16274 | 39369 | 62464 |
| RBM11 | 16275 | 39370 | 62465 |
| RBM12 | 16276 | 39371 | 62466 |
| RBM12B | 16277 | 39372 | 62467 |
| RBM14 | 16278 | 39373 | 62468 |
| RBM14 | 16279 | 39374 | 62469 |
| RBM14-RBM4 | 16280 | 39375 | 62470 |
| RBM15 | 16281 | 39376 | 62471 |
| RBM15 | 16282 | 39377 | 62472 |
| RBM15B | 16283 | 39378 | 62473 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| RBM17 | 16284 | 39379 | 62474 |
| RBM18 | 16285 | 39380 | 62475 |
| RBM19 | 16286 | 39381 | 62476 |
| RBM20 | 16287 | 39382 | 62477 |
| RBM22 | 16288 | 39383 | 62478 |
| RBM23 | 16289 | 39384 | 62479 |
| RBM24 | 16290 | 39385 | 62480 |
| RBM25 | 16291 | 39386 | 62481 |
| REM26 | 16292 | 39387 | 62482 |
| RBM27 | 16293 | 39388 | 62483 |
| RBM28 | 16294 | 39389 | 62484 |
| RBM3 | 16295 | 39390 | 62485 |
| RBM33 | 16296 | 39391 | 62486 |
| RBM34 | 16297 | 39392 | 62487 |
| RBM38 | 16298 | 39393 | 62488 |
| RBM38 | 16299 | 39394 | 62489 |
| RBM39 | 16300 | 39395 | 62490 |
| RBM4 | 16301 | 39396 | 62491 |
| RBM4 | 16302 | 39397 | 62492 |
| RBM4 | 16303 | 39398 | 62493 |
| RBM41 | 16304 | 39399 | 62494 |
| RBM41 | 16305 | 39400 | 62495 |
| RBM42 | 16306 | 39401 | 62496 |
| RBM43 | 16307 | 39402 | 62497 |
| RBM44 | 16308 | 39403 | 62498 |
| RBM45 | 16309 | 39404 | 62499 |
| RBM46 | 16310 | 39405 | 62500 |
| RBM46 | 16311 | 39406 | 62501 |
| RBM46 | 16312 | 39407 | 62502 |
| RBM47 | 16313 | 39408 | 62503 |
| RBM48 | 16314 | 39409 | 62504 |
| RBM4B | 16315 | 39410 | 62505 |
| RBM4B | 16316 | 39411 | 62506 |
| RBM5 | 16317 | 39412 | 62507 |
| RBM6 | 16318 | 39413 | 62508 |
| RBM7 | 16319 | 39414 | 62509 |
| RBM8A | 16320 | 39415 | 62510 |
| RBMS1 | 16321 | 39416 | 62511 |
| RBMS2 | 16322 | 39417 | 62512 |
| RBMS3 | 16323 | 39418 | 62513 |
| RBMS3 | 16324 | 39419 | 62514 |
| RBMX | 16325 | 39420 | 62515 |
| RBMX2 | 16326 | 39421 | 62516 |
| RBMXL1 | 16327 | 39422 | 62517 |
| RBMXL3 | 16328 | 39423 | 62518 |
| RBMY1F | 16329 | 39424 | 62519 |
| RBMY1J | 16330 | 39425 | 62520 |
| RBP1 | 16331 | 39426 | 62521 |
| RBP1 | 16332 | 39427 | 62522 |
| RBP1 | 16333 | 39428 | 62523 |
| RBP2 | 16334 | 39429 | 62524 |
| RBP3 | 16335 | 39430 | 62525 |
| RBP4 | 16336 | 39431 | 62526 |
| RBP5 | 16337 | 39432 | 62527 |
| RBP5 | 16338 | 39433 | 62528 |
| RBP7 | 16339 | 39434 | 62529 |
| RBPJ | 16340 | 39435 | 62530 |
| RBPJL | 16341 | 39436 | 62531 |
| RBPJL | 16342 | 39437 | 62532 |
| RBPMS | 16343 | 39438 | 62533 |
| RBPMS | 16344 | 39439 | 62534 |
| RBPMS | 16345 | 39440 | 62535 |
| RBPMS2 | 16346 | 39441 | 62536 |
| RBSN | 16347 | 39442 | 62537 |
| RBX1 | 16348 | 39443 | 62538 |
| RC3H1 | 16349 | 39444 | 62539 |
| RC3H2 | 16350 | 39445 | 62540 |
| RC3H2 | 16351 | 39446 | 62541 |
| RC3H2 | 16352 | 39447 | 62542 |
| RCAN1 | 16353 | 39448 | 62543 |
| RCAN1 | 16354 | 39449 | 62544 |
| RCAN2 | 16355 | 39450 | 62545 |
| RCAN3 | 16356 | 39451 | 62546 |
| RCAN3 | 16357 | 39452 | 62547 |
| RCBTB1 | 16358 | 39453 | 62548 |
| RCBTB1 | 16359 | 39454 | 62549 |
| RCBTB1 | 16360 | 39455 | 62550 |
| RCBTB2 | 16361 | 39456 | 62551 |
| RCBTB2 | 16362 | 39457 | 62552 |
| RCBTB2 | 16363 | 39458 | 62553 |
| RCC1 | 16364 | 39459 | 62554 |
| RCC1L | 16365 | 39460 | 62555 |
| RCC1L | 16366 | 39461 | 62556 |
| RCC1L | 16367 | 39462 | 62557 |
| RCC2 | 16368 | 39463 | 62558 |
| RCCD1 | 16369 | 39464 | 62559 |
| RCE1 | 16370 | 39465 | 62560 |
| RCHY1 | 16371 | 39466 | 62561 |
| RCL1 | 16372 | 39467 | 62562 |
| RCN1 | 16373 | 39468 | 62563 |
| RCN2 | 16374 | 39469 | 62564 |
| RCN3 | 16375 | 39470 | 62565 |
| RCOR1 | 16376 | 39471 | 62566 |
| RCOR2 | 16377 | 39472 | 62567 |
| RCOR3 | 16378 | 39473 | 62568 |
| RCOR3 | 16379 | 39474 | 62569 |
| RCOR3 | 16380 | 39475 | 62570 |
| RCSD1 | 16381 | 39476 | 62571 |
| RCVRN | 16382 | 39477 | 62572 |
| RD3 | 16383 | 39478 | 62573 |
| RD3L | 16384 | 39479 | 62574 |
| RDH10 | 16385 | 39480 | 62575 |
| RDH11 | 16386 | 39481 | 62576 |
| RDH12 | 16387 | 39482 | 62577 |
| RDH13 | 16388 | 39483 | 62578 |
| RDH14 | 16389 | 39484 | 62579 |
| RDH16 | 16390 | 39485 | 62580 |
| RDH5 | 16391 | 39486 | 62581 |
| RDH8 | 16392 | 39487 | 62582 |
| RDM1 | 16393 | 39488 | 62583 |
| RDM1 | 16394 | 39489 | 62584 |
| RDM1 | 16395 | 39490 | 62585 |
| RDX | 16396 | 39491 | 62586 |
| RDX | 16397 | 39492 | 62587 |
| REC114 | 16398 | 39493 | 62588 |
| REC8 | 16399 | 39494 | 62589 |
| RECK | 16400 | 39495 | 62590 |
| RECK | 16401 | 39496 | 62591 |
| RECK | 16402 | 39497 | 62592 |
| RECQL | 16403 | 39498 | 62593 |
| RECQL4 | 16404 | 39499 | 62594 |
| RECQL5 | 16405 | 39500 | 62595 |
| RECQL5 | 16406 | 39501 | 62596 |
| RECQL5 | 16407 | 39502 | 62597 |
| REEP1 | 16408 | 39503 | 62598 |
| REEP1 | 16409 | 39504 | 62599 |
| REEP2 | 16410 | 39505 | 62600 |
| REEP3 | 16411 | 39506 | 62601 |
| REEP4 | 16412 | 39507 | 62602 |
| REEP4 | 16413 | 39508 | 62603 |
| REEP4 | 16414 | 39509 | 62604 |
| REEP5 | 16415 | 39510 | 62605 |
| REEP6 | 16416 | 39511 | 62606 |
| REEP6 | 16417 | 39512 | 62607 |
| REG1A | 16418 | 39513 | 62608 |
| REG1B | 16419 | 39514 | 62609 |
| REG3A | 16420 | 39515 | 62610 |
| REG3G | 16421 | 39516 | 62611 |
| REG4 | 16422 | 39517 | 62612 |
| REG4 | 16423 | 39518 | 62613 |
| REL | 16424 | 39519 | 62614 |
| RELA | 16425 | 39520 | 62615 |
| RELB | 16426 | 39521 | 62616 |
| RELL1 | 16427 | 39522 | 62617 |
| RELL2 | 16428 | 39523 | 62618 |
| RELN | 16429 | 39524 | 62619 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| RELT | 16430 | 39525 | 62620 |
| REM1 | 16431 | 39526 | 62621 |
| REM2 | 16432 | 39527 | 62622 |
| REN | 16433 | 39528 | 62623 |
| RENBP | 16434 | 39529 | 62624 |
| REP15 | 16435 | 39530 | 62625 |
| REPIN1 | 16436 | 39531 | 62626 |
| REPS1 | 16437 | 39532 | 62627 |
| REPS2 | 16438 | 39533 | 62628 |
| RER1 | 16439 | 39534 | 62629 |
| RERE | 16440 | 39535 | 62630 |
| RERG | 16441 | 39536 | 62631 |
| RERGL | 16442 | 39537 | 62632 |
| RESP18 | 16443 | 39538 | 62633 |
| REST | 16444 | 39539 | 62634 |
| RET | 16445 | 39540 | 62635 |
| RET | 16446 | 39541 | 62636 |
| RETN | 16447 | 39542 | 62637 |
| RETNLB | 16448 | 39543 | 62638 |
| RETREG1 | 16449 | 39544 | 62639 |
| RETREG2 | 16450 | 39545 | 62640 |
| RETREG3 | 16451 | 39546 | 62641 |
| RETSAT | 16452 | 39547 | 62642 |
| REV1 | 16453 | 39548 | 62643 |
| REV3L | 16454 | 39549 | 62644 |
| REX1BD | 16455 | 39550 | 62645 |
| REXO1 | 16456 | 39551 | 62646 |
| REXO2 | 16457 | 39552 | 62647 |
| REXO4 | 16458 | 39553 | 62648 |
| REXO5 | 16459 | 39554 | 62649 |
| RFC1 | 16460 | 39555 | 62650 |
| RFC2 | 16461 | 39556 | 62651 |
| RFC3 | 16462 | 39557 | 62652 |
| RFC3 | 16463 | 39558 | 62653 |
| RFC4 | 16464 | 39559 | 62654 |
| RFC5 | 16465 | 39560 | 62655 |
| RFESD | 16466 | 39561 | 62656 |
| RFFL | 16467 | 39562 | 62657 |
| RFK | 16468 | 39563 | 62658 |
| RFLNB | 16469 | 39564 | 62659 |
| RFNG | 16470 | 39565 | 62660 |
| RFPL1 | 16471 | 39566 | 62661 |
| RFPL2 | 16472 | 39567 | 62662 |
| RFPL3 | 16473 | 39568 | 62663 |
| RFPL4AL1 | 16474 | 39569 | 62664 |
| RFPL4B | 16475 | 39570 | 62665 |
| RFT1 | 16476 | 39571 | 62666 |
| RFTN1 | 16477 | 39572 | 62667 |
| RFTN2 | 16478 | 39573 | 62668 |
| RFWD2 | 16479 | 39574 | 62669 |
| RFWD3 | 16480 | 39575 | 62670 |
| RFX1 | 16481 | 39576 | 62671 |
| RFX2 | 16482 | 39577 | 62672 |
| RFX3 | 16483 | 39578 | 62673 |
| RFX3 | 16484 | 39579 | 62674 |
| RFX3 | 16485 | 39580 | 62675 |
| RFX4 | 16486 | 39581 | 62676 |
| RFX5 | 16487 | 39582 | 62677 |
| RFX6 | 16488 | 39583 | 62678 |
| RFX7 | 16489 | 39584 | 62679 |
| RFX8 | 16490 | 39585 | 62680 |
| RFXANK | 16491 | 39586 | 62681 |
| RFXAP | 16492 | 39587 | 62682 |
| RGCC | 16493 | 39588 | 62683 |
| RGL1 | 16494 | 39589 | 62684 |
| RGL2 | 16495 | 39590 | 62685 |
| RGL3 | 16496 | 39591 | 62686 |
| RGL4 | 16497 | 39592 | 62687 |
| RGL4 | 16498 | 39593 | 62688 |
| RGMA | 16499 | 39594 | 62689 |
| RGMB | 16500 | 39595 | 62690 |
| RGN | 16501 | 39596 | 62691 |
| RGP1 | 16502 | 39597 | 62692 |
| RGPD2 | 16503 | 39598 | 62693 |
| RGPD6 | 16504 | 39599 | 62694 |
| RGPD6 | 16505 | 39600 | 62695 |
| RGPD8 | 16506 | 39601 | 62696 |
| RGR | 16507 | 39602 | 62697 |
| RGS1 | 16508 | 39603 | 62698 |
| RGS10 | 16509 | 39604 | 62699 |
| RGS11 | 16510 | 39605 | 62700 |
| RGS12 | 16511 | 39606 | 62701 |
| RGS12 | 16512 | 39607 | 62702 |
| RGS13 | 16513 | 39608 | 62703 |
| RGS14 | 16514 | 39609 | 62704 |
| RGS16 | 16515 | 39610 | 62705 |
| RGS17 | 16516 | 39611 | 62706 |
| RGS18 | 16517 | 39612 | 62707 |
| RGS19 | 16518 | 39613 | 62708 |
| RGS2 | 16519 | 39614 | 62709 |
| RGS20 | 16520 | 39615 | 62710 |
| RGS21 | 16521 | 39616 | 62711 |
| RGS22 | 16522 | 39617 | 62712 |
| RGS3 | 16523 | 39618 | 62713 |
| RGS3 | 16524 | 39619 | 62714 |
| RGS4 | 16525 | 39620 | 62715 |
| RGS4 | 16526 | 39621 | 62716 |
| RGS5 | 16527 | 39622 | 62717 |
| RGS5 | 16528 | 39623 | 62718 |
| RGS6 | 16529 | 39624 | 62719 |
| RGS6 | 16530 | 39625 | 62720 |
| RGS7 | 16531 | 39626 | 62721 |
| RGS7 | 16532 | 39627 | 62722 |
| RGS7BP | 16533 | 39628 | 62723 |
| RGS7BP | 16534 | 39629 | 62724 |
| RGS8 | 16535 | 39630 | 62725 |
| RGS9 | 16536 | 39631 | 62726 |
| RGS9 | 16537 | 39632 | 62727 |
| RGS9BP | 16538 | 39633 | 62728 |
| RGSL1 | 16539 | 39634 | 62729 |
| RHAG | 16540 | 39635 | 62730 |
| RHBDD1 | 16541 | 39636 | 62731 |
| RHBDD2 | 16542 | 39637 | 62732 |
| RHBDD3 | 16543 | 39638 | 62733 |
| RHBDF1 | 16544 | 39639 | 62734 |
| RHBDF2 | 16545 | 39640 | 62735 |
| RHBDL1 | 16546 | 39641 | 62736 |
| RHBDL2 | 16547 | 39642 | 62737 |
| RHBDL3 | 16548 | 39643 | 62738 |
| RHBG | 16549 | 39644 | 62739 |
| RHCE | 16550 | 39645 | 62740 |
| RHCE | 16551 | 39646 | 62741 |
| RHCG | 16552 | 39647 | 62742 |
| RHD | 16553 | 39648 | 62743 |
| RHD | 16554 | 39649 | 62744 |
| RHD | 16555 | 39650 | 62745 |
| RHEB | 16556 | 39651 | 62746 |
| RHEBL1 | 16557 | 39652 | 62747 |
| RHNO1 | 16558 | 39653 | 62748 |
| RHO | 16559 | 39654 | 62749 |
| RHOA | 16560 | 39655 | 62750 |
| RHOA | 16561 | 39656 | 62751 |
| RHOA | 16562 | 39657 | 62752 |
| RHOB | 16563 | 39658 | 62753 |
| RHOBTB1 | 16564 | 39659 | 62754 |
| RHOBTB2 | 16565 | 39660 | 62755 |
| RHOBTB3 | 16566 | 39661 | 62756 |
| RHOC | 16567 | 39662 | 62757 |
| RHOD | 16568 | 39663 | 62758 |
| RHOF | 16569 | 39664 | 62759 |
| RHOG | 16570 | 39665 | 62760 |
| RHOH | 16571 | 39666 | 62761 |
| RHOJ | 16572 | 39667 | 62762 |
| RHOQ | 16573 | 39668 | 62763 |
| RHOT1 | 16574 | 39669 | 62764 |
| RHOT2 | 16575 | 39670 | 62765 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| RHOU | 16576 | 39671 | 62766 |
| RHOV | 16577 | 39672 | 62767 |
| RHOXF1 | 16578 | 39673 | 62768 |
| RHOXF2B | 16579 | 39674 | 62769 |
| RHPN1 | 16580 | 39675 | 62770 |
| RHPN2 | 16581 | 39676 | 62771 |
| RIBC1 | 16582 | 39677 | 62772 |
| RIBC1 | 16583 | 39678 | 62773 |
| RIBC1 | 16584 | 39679 | 62774 |
| RIBC2 | 16585 | 39680 | 62775 |
| RIC1 | 16586 | 39681 | 62776 |
| RIC1 | 16587 | 39682 | 62777 |
| RIC3 | 16588 | 39683 | 62778 |
| RIC3 | 16589 | 39684 | 62779 |
| RIC8A | 16590 | 39685 | 62780 |
| RIC8B | 16591 | 39686 | 62781 |
| RIC8B | 16592 | 39687 | 62782 |
| RICTOR | 16593 | 39688 | 62783 |
| RIDA | 16594 | 39689 | 62784 |
| RIF1 | 16595 | 39690 | 62785 |
| RIIAD1 | 16596 | 39691 | 62786 |
| RILP | 16597 | 39692 | 62787 |
| RILPL1 | 16598 | 39693 | 62788 |
| RILPL1 | 16599 | 39694 | 62789 |
| RILPL2 | 16600 | 39695 | 62790 |
| RIMBP2 | 16601 | 39696 | 62791 |
| RIMBP2 | 16602 | 39697 | 62792 |
| RIMBP2 | 16603 | 39698 | 62793 |
| RIMBP2 | 16604 | 39699 | 62794 |
| RIMBP2 | 16605 | 39700 | 62795 |
| RIMBP3C | 16606 | 39701 | 62796 |
| RIMKLA | 16607 | 39702 | 62797 |
| RIMKLB | 16608 | 39703 | 62798 |
| RIMS1 | 16609 | 39704 | 62799 |
| RIMS1 | 16610 | 39705 | 62800 |
| RIMS1 | 16611 | 39706 | 62801 |
| RIMS2 | 16612 | 39707 | 62802 |
| RIMS3 | 16613 | 39708 | 62803 |
| RIMS4 | 16614 | 39709 | 62804 |
| RIN1 | 16615 | 39710 | 62805 |
| RIN2 | 16616 | 39711 | 62806 |
| RIN3 | 16617 | 39712 | 62807 |
| RING1 | 16618 | 39713 | 62808 |
| RINL | 16619 | 39714 | 62809 |
| RINT1 | 16620 | 39715 | 62810 |
| RIOK1 | 16621 | 39716 | 62811 |
| RIOK2 | 16622 | 39717 | 62812 |
| RIOK2 | 16623 | 39718 | 62813 |
| RIOK3 | 16624 | 39719 | 62814 |
| RIOX1 | 16625 | 39720 | 62815 |
| RIOX2 | 16626 | 39721 | 62816 |
| RIPK1 | 16627 | 39722 | 62817 |
| RIPK2 | 16628 | 39723 | 62818 |
| RIPK3 | 16629 | 39724 | 62819 |
| RIPK4 | 16630 | 39725 | 62820 |
| RIPOR1 | 16631 | 39726 | 62821 |
| RIPOR2 | 16632 | 39727 | 62822 |
| RIPOR2 | 16633 | 39728 | 62823 |
| RIPOR2 | 16634 | 39729 | 62824 |
| RIPOR3 | 16635 | 39730 | 62825 |
| RIPPLY1 | 16636 | 39731 | 62826 |
| RIPPLY2 | 16637 | 39732 | 62827 |
| RIPPLY3 | 16638 | 39733 | 62828 |
| RIPPLY3 | 16639 | 39734 | 62829 |
| RIT1 | 16640 | 39735 | 62830 |
| RIT2 | 16641 | 39736 | 62831 |
| RIT2 | 16642 | 39737 | 62832 |
| RITA1 | 16643 | 39738 | 62833 |
| RLBP1 | 16644 | 39739 | 62834 |
| RLF | 16645 | 39740 | 62835 |
| RLIM | 16646 | 39741 | 62836 |
| RLN1 | 16647 | 39742 | 62837 |
| RLN2 | 16648 | 39743 | 62838 |
| RLN2 | 16649 | 39744 | 62839 |
| RLN3 | 16650 | 39745 | 62840 |
| RLN3 | 16651 | 39746 | 62841 |
| RMDN1 | 16652 | 39747 | 62842 |
| RMDN1 | 16653 | 39748 | 62843 |
| RMDN2 | 16654 | 39749 | 62844 |
| RMDN3 | 16655 | 39750 | 62845 |
| RMI1 | 16656 | 39751 | 62846 |
| RMI2 | 16657 | 39752 | 62847 |
| RMND1 | 16658 | 39753 | 62848 |
| RMND5A | 16659 | 39754 | 62849 |
| RMND5B | 16660 | 39755 | 62850 |
| RNASE1 | 16661 | 39756 | 62851 |
| RNASE10 | 16662 | 39757 | 62852 |
| RNASE11 | 16663 | 39758 | 62853 |
| RNASE12 | 16664 | 39759 | 62854 |
| RNASE13 | 16665 | 39760 | 62855 |
| RNASE2 | 16666 | 39761 | 62856 |
| RNASE3 | 16667 | 39762 | 62857 |
| RNASE4 | 16668 | 39763 | 62858 |
| RNASE4 | 16669 | 39764 | 62859 |
| RNASE6 | 16670 | 39765 | 62860 |
| RNASE7 | 16671 | 39766 | 62861 |
| RNASE8 | 16672 | 39767 | 62862 |
| RNASE9 | 16673 | 39768 | 62863 |
| RNASEH1 | 16674 | 39769 | 62864 |
| RNASEH2A | 16675 | 39770 | 62865 |
| RNASEH2B | 16676 | 39771 | 62866 |
| RNASEH2B | 16677 | 39772 | 62867 |
| RNASEH2C | 16678 | 39773 | 62868 |
| RNASEK | 16679 | 39774 | 62869 |
| RNASEL | 16680 | 39775 | 62870 |
| RNASET2 | 16681 | 39776 | 62871 |
| RND1 | 16682 | 39777 | 62872 |
| RND2 | 16683 | 39778 | 62873 |
| RND3 | 16684 | 39779 | 62874 |
| RNF10 | 16685 | 39780 | 62875 |
| RNF103 | 16686 | 39781 | 62876 |
| RNF103 | 16687 | 39782 | 62877 |
| RNF11 | 16688 | 39783 | 62878 |
| RNF111 | 16689 | 39784 | 62879 |
| RNF112 | 16690 | 39785 | 62880 |
| RNF113A | 16691 | 39786 | 62881 |
| RNF113B | 16692 | 39787 | 62882 |
| RNF114 | 16693 | 39788 | 62883 |
| RNF115 | 16694 | 39789 | 62884 |
| RNF121 | 16695 | 39790 | 62885 |
| RNF121 | 16696 | 39791 | 62886 |
| RNF122 | 16697 | 39792 | 62887 |
| RNF123 | 16698 | 39793 | 62888 |
| RNF125 | 16699 | 39794 | 62889 |
| RNF126 | 16700 | 39795 | 62890 |
| RNF128 | 16701 | 39796 | 62891 |
| RNF13 | 16702 | 39797 | 62892 |
| RNF130 | 16703 | 39798 | 62893 |
| RNF130 | 16704 | 39799 | 62894 |
| RNF133 | 16705 | 39800 | 62895 |
| RNF135 | 16706 | 39801 | 62896 |
| RNF135 | 16707 | 39802 | 62897 |
| RNF138 | 16708 | 39803 | 62898 |
| RNF139 | 16709 | 39804 | 62899 |
| RNF14 | 16710 | 39805 | 62900 |
| RNF141 | 16711 | 39806 | 62901 |
| RNF144A | 16712 | 39807 | 62902 |
| RNF144A | 16713 | 39808 | 62903 |
| RNF144A | 16714 | 39809 | 62904 |
| RNF144B | 16715 | 39810 | 62905 |
| RNF145 | 16716 | 39811 | 62906 |
| RNF146 | 16717 | 39812 | 62907 |
| RNF148 | 16718 | 39813 | 62908 |
| RNF149 | 16719 | 39814 | 62909 |
| RNF150 | 16720 | 39815 | 62910 |
| RNF151 | 16721 | 39816 | 62911 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| RNF151 | 16722 | 39817 | 62912 |
| RNF152 | 16723 | 39818 | 62913 |
| RNF157 | 16724 | 39819 | 62914 |
| RNF165 | 16725 | 39820 | 62915 |
| RNF166 | 16726 | 39821 | 62916 |
| RNF167 | 16727 | 39822 | 62917 |
| RNF168 | 16728 | 39823 | 62918 |
| RNF169 | 16729 | 39824 | 62919 |
| RNF17 | 16730 | 39825 | 62920 |
| RNF170 | 16731 | 39826 | 62921 |
| RNF170 | 16732 | 39827 | 62922 |
| RNF175 | 16733 | 39828 | 62923 |
| RNF180 | 16734 | 39829 | 62924 |
| RNF180 | 16735 | 39830 | 62925 |
| RNF180 | 16736 | 39831 | 62926 |
| RNF180 | 16737 | 39832 | 62927 |
| RNF181 | 16738 | 39833 | 62928 |
| RNF182 | 16739 | 39834 | 62929 |
| RNF183 | 16740 | 39835 | 62930 |
| RNF185 | 16741 | 39836 | 62931 |
| RNF186 | 16742 | 39837 | 62932 |
| RNF187 | 16743 | 39838 | 62933 |
| RNF19A | 16744 | 39839 | 62934 |
| RNF19B | 16745 | 39840 | 62935 |
| RNF19B | 16746 | 39841 | 62936 |
| RNF2 | 16747 | 39842 | 62937 |
| RNF20 | 16748 | 39843 | 62938 |
| RNF207 | 16749 | 39844 | 62939 |
| RNF208 | 16750 | 39845 | 62940 |
| RNF212 | 16751 | 39846 | 62941 |
| RNF212 | 16752 | 39847 | 62942 |
| RNF212 | 16753 | 39848 | 62943 |
| RNF212B | 16754 | 39849 | 62944 |
| RNF213 | 16755 | 39850 | 62945 |
| RNF213 | 16756 | 39851 | 62946 |
| RNF214 | 16757 | 39852 | 62947 |
| RNF215 | 16758 | 39853 | 62948 |
| RNF216 | 16759 | 39854 | 62949 |
| RNF217 | 16760 | 39855 | 62950 |
| RNF217 | 16761 | 39856 | 62951 |
| RNF219 | 16762 | 39857 | 62952 |
| RNF220 | 16763 | 39858 | 62953 |
| RNF222 | 16764 | 39859 | 62954 |
| RNF223 | 16765 | 39860 | 62955 |
| RNF224 | 16766 | 39861 | 62956 |
| RNF225 | 16767 | 39862 | 62957 |
| RNF24 | 16768 | 39863 | 62958 |
| RNF25 | 16769 | 39864 | 62959 |
| RNF26 | 16770 | 39865 | 62960 |
| RNF31 | 16771 | 39866 | 62961 |
| RNF32 | 16772 | 39867 | 62962 |
| RNF32 | 16773 | 39868 | 62963 |
| RNF32 | 16774 | 39869 | 62964 |
| RNF34 | 16775 | 39870 | 62965 |
| RNF38 | 16776 | 39871 | 62966 |
| RNF39 | 16777 | 39872 | 62967 |
| RNF4 | 16778 | 39873 | 62968 |
| RNF4 | 16779 | 39874 | 62969 |
| RNF40 | 16780 | 39875 | 62970 |
| RNF41 | 16781 | 39876 | 62971 |
| RNF43 | 16782 | 39877 | 62972 |
| RNF44 | 16783 | 39878 | 62973 |
| RNF5 | 16784 | 39879 | 62974 |
| RNF6 | 16785 | 39880 | 62975 |
| RNF6 | 16786 | 39881 | 62976 |
| RNF7 | 16787 | 39882 | 62977 |
| RNF7 | 16788 | 39883 | 62978 |
| RNF8 | 16789 | 39884 | 62979 |
| RNF8 | 16790 | 39885 | 62980 |
| RNFT1 | 16791 | 39886 | 62981 |
| RNFT2 | 16792 | 39887 | 62982 |
| RNFT2 | 16793 | 39888 | 62983 |
| RNGTT | 16794 | 39889 | 62984 |
| RNH1 | 16795 | 39890 | 62985 |
| RNLS | 16796 | 39891 | 62986 |
| RNLS | 16797 | 39892 | 62987 |
| RNMT | 16798 | 39893 | 62988 |
| RNMT | 16799 | 39894 | 62989 |
| RNPC3 | 16800 | 39895 | 62990 |
| RNPEP | 16801 | 39896 | 62991 |
| RNPEPL1 | 16802 | 39897 | 62992 |
| RNPS1 | 16803 | 39898 | 62993 |
| RNPS1 | 16804 | 39899 | 62994 |
| ROBO1 | 16805 | 39900 | 62995 |
| ROBO2 | 16806 | 39901 | 62996 |
| ROBO3 | 16807 | 39902 | 62997 |
| ROBO4 | 16808 | 39903 | 62998 |
| ROCK1 | 16809 | 39904 | 62999 |
| ROCK2 | 16810 | 39905 | 63000 |
| ROGDI | 16811 | 39906 | 63001 |
| ROM1 | 16812 | 39907 | 63002 |
| ROMO1 | 16813 | 39908 | 63003 |
| ROPN1 | 16814 | 39909 | 63004 |
| ROPN1B | 16815 | 39910 | 63005 |
| ROPN1L | 16816 | 39911 | 63006 |
| ROR1 | 16817 | 39912 | 63007 |
| ROR1 | 16818 | 39913 | 63008 |
| ROR2 | 16819 | 39914 | 63009 |
| ROR2 | 16820 | 39915 | 63010 |
| RORA | 16821 | 39916 | 63011 |
| RORB | 16822 | 39917 | 63012 |
| RORC | 16823 | 39918 | 63013 |
| ROS1 | 16824 | 39919 | 63014 |
| RP1 | 16825 | 39920 | 63015 |
| RP1L1 | 16826 | 39921 | 63016 |
| RP2 | 16827 | 39922 | 63017 |
| RP9 | 16828 | 39923 | 63018 |
| RPA1 | 16829 | 39924 | 63019 |
| RPA2 | 16830 | 39925 | 63020 |
| RPA3 | 16831 | 39926 | 63021 |
| RPA4 | 16832 | 39927 | 63022 |
| RPAIN | 16833 | 39928 | 63023 |
| RPAIN | 16834 | 39929 | 63024 |
| RPAIN | 16835 | 39930 | 63025 |
| RPAIN | 16836 | 39931 | 63026 |
| RPAP1 | 16837 | 39932 | 63027 |
| RPAP2 | 16838 | 39933 | 63028 |
| RPAP3 | 16839 | 39934 | 63029 |
| RPE | 16840 | 39935 | 63030 |
| RPE | 16841 | 39936 | 63031 |
| RPE | 16842 | 39937 | 63032 |
| RPE | 16843 | 39938 | 63033 |
| RPE65 | 16844 | 39939 | 63034 |
| RPEL1 | 16845 | 39940 | 63035 |
| RPF1 | 16846 | 39941 | 63036 |
| RPF2 | 16847 | 39942 | 63037 |
| RPGR | 16848 | 39943 | 63038 |
| RPGR | 16849 | 39944 | 63039 |
| RPGRIP1 | 16850 | 39945 | 63040 |
| RPGRIP1L | 16851 | 39946 | 63041 |
| RPGRIP1L | 16852 | 39947 | 63042 |
| RPGRIP1L | 16853 | 39948 | 63043 |
| RPH3A | 16854 | 39949 | 63044 |
| RPH3AL | 16855 | 39950 | 63045 |
| RPIA | 16856 | 39951 | 63046 |
| RPL10 | 16857 | 39952 | 63047 |
| RPL10 | 16858 | 39953 | 63048 |
| RPL10 | 16859 | 39954 | 63049 |
| RPL10A | 16860 | 39955 | 63050 |
| RPL10L | 16861 | 39956 | 63051 |
| RPL11 | 16862 | 39957 | 63052 |
| RPL12 | 16863 | 39958 | 63053 |
| RPL13 | 16864 | 39959 | 63054 |
| RPL13A | 16865 | 39960 | 63055 |
| RPL14 | 16866 | 39961 | 63056 |
| RPL15 | 16867 | 39962 | 63057 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| RPL15 | 16868 | 39963 | 63058 |
| RPL17 | 16869 | 39964 | 63059 |
| RPL17-C18orf32 | 16870 | 39965 | 63060 |
| RPL18 | 16871 | 39966 | 63061 |
| RPL18A | 16872 | 39967 | 63062 |
| RPL19 | 16873 | 39968 | 63063 |
| RPL22 | 16874 | 39969 | 63064 |
| RPL22L1 | 16875 | 39970 | 63065 |
| RPL23 | 16876 | 39971 | 63066 |
| RPL23A | 16877 | 39972 | 63067 |
| RPL24 | 16878 | 39973 | 63068 |
| RPL26 | 16879 | 39974 | 63069 |
| RPL26L1 | 16880 | 39975 | 63070 |
| RPL27 | 16881 | 39976 | 63071 |
| RPL27A | 16882 | 39977 | 63072 |
| RPL28 | 16883 | 39978 | 63073 |
| RPL28 | 16884 | 39979 | 63074 |
| RPL28 | 16885 | 39980 | 63075 |
| RPL28 | 16886 | 39981 | 63076 |
| RPL28 | 16887 | 39982 | 63077 |
| RPL29 | 16888 | 39983 | 63078 |
| RPL3 | 16889 | 39984 | 63079 |
| RPL30 | 16890 | 39985 | 63080 |
| RPL31 | 16891 | 39986 | 63081 |
| RPL31 | 16892 | 39987 | 63082 |
| RPL32 | 16893 | 39988 | 63083 |
| RPL34 | 16894 | 39989 | 63084 |
| RPL35 | 16895 | 39990 | 63085 |
| RPL35A | 16896 | 39991 | 63086 |
| RPL36 | 16897 | 39992 | 63087 |
| RPL36A | 16898 | 39993 | 63088 |
| RPL36A | 16899 | 39994 | 63089 |
| RPL36AL | 16900 | 39995 | 63090 |
| RPL37 | 16901 | 39996 | 63091 |
| RPL37A | 16902 | 39997 | 63092 |
| RPL38 | 16903 | 39998 | 63093 |
| RPL39 | 16904 | 39999 | 63094 |
| RPL39L | 16905 | 40000 | 63095 |
| RPL3L | 16906 | 40001 | 63096 |
| RPL4 | 16907 | 40002 | 63097 |
| RPL41 | 16908 | 40003 | 63098 |
| RPL5 | 16909 | 40004 | 63099 |
| RPL6 | 16910 | 40005 | 63100 |
| RPL7 | 16911 | 40006 | 63101 |
| RPL7A | 16912 | 40007 | 63102 |
| RPL7L1 | 16913 | 40008 | 63103 |
| RPL8 | 16914 | 40009 | 63104 |
| RPL9 | 16915 | 40010 | 63105 |
| RPLP0 | 16916 | 40011 | 63106 |
| RPLP1 | 16917 | 40012 | 63107 |
| RPLP2 | 16918 | 40013 | 63108 |
| RPN1 | 16919 | 40014 | 63109 |
| RPN2 | 16920 | 40015 | 63110 |
| RPN2 | 16921 | 40016 | 63111 |
| RPP14 | 16922 | 40017 | 63112 |
| RPP21 | 16923 | 40018 | 63113 |
| RPP21 | 16924 | 40019 | 63114 |
| RPP25 | 16925 | 40020 | 63115 |
| RPP25L | 16926 | 40021 | 63116 |
| RPP30 | 16927 | 40022 | 63117 |
| RPP30 | 16928 | 40023 | 63118 |
| RPP38 | 16929 | 40024 | 63119 |
| RPP40 | 16930 | 40025 | 63120 |
| RPRD1A | 16931 | 40026 | 63121 |
| RPRD1A | 16932 | 40027 | 63122 |
| RPRD1B | 16933 | 40028 | 63123 |
| RPRD2 | 16934 | 40029 | 63124 |
| RPRD2 | 16935 | 40030 | 63125 |
| RPRM | 16936 | 40031 | 63126 |
| RPRML | 16937 | 40032 | 63127 |
| RPS10 | 16938 | 40033 | 63128 |
| RPS11 | 16939 | 40034 | 63129 |
| RPS12 | 16940 | 40035 | 63130 |
| RPS13 | 16941 | 40036 | 63131 |
| RPS14 | 16942 | 40037 | 63132 |
| RPS15 | 16943 | 40038 | 63133 |
| RPS15A | 16944 | 40039 | 63134 |
| RPS16 | 16945 | 40040 | 63135 |
| RPS17 | 16946 | 40041 | 63136 |
| RPS18 | 16947 | 40042 | 63137 |
| RPS19 | 16948 | 40043 | 63138 |
| RPS19 | 16949 | 40044 | 63139 |
| RPS19BP1 | 16950 | 40045 | 63140 |
| RPS2 | 16951 | 40046 | 63141 |
| RPS20 | 16952 | 40047 | 63142 |
| RPS20 | 16953 | 40048 | 63143 |
| RPS21 | 16954 | 40049 | 63144 |
| RPS23 | 16955 | 40050 | 63145 |
| RPS24 | 16956 | 40051 | 63146 |
| RPS24 | 16957 | 40052 | 63147 |
| RPS24 | 16958 | 40053 | 63148 |
| RPS25 | 16959 | 40054 | 63149 |
| RPS26 | 16960 | 40055 | 63150 |
| RPS27 | 16961 | 40056 | 63151 |
| RPS27 | 16962 | 40057 | 63152 |
| RPS27A | 16963 | 40058 | 63153 |
| RPS27L | 16964 | 40059 | 63154 |
| RPS28 | 16965 | 40060 | 63155 |
| RPS29 | 16966 | 40061 | 63156 |
| RPS29 | 16967 | 40062 | 63157 |
| RPS3 | 16968 | 40063 | 63158 |
| RPS3 | 16969 | 40064 | 63159 |
| RPS3A | 16970 | 40065 | 63160 |
| RPS3A | 16971 | 40066 | 63161 |
| RPS4X | 16972 | 40067 | 63162 |
| RPS4Y1 | 16973 | 40068 | 63163 |
| RPS4Y2 | 16974 | 40069 | 63164 |
| RPS5 | 16975 | 40070 | 63165 |
| RPS6 | 16976 | 40071 | 63166 |
| RPS6KA1 | 16977 | 40072 | 63167 |
| RPS6KA2 | 16978 | 40073 | 63168 |
| RPS6KA3 | 16979 | 40074 | 63169 |
| RPS6KA4 | 16980 | 40075 | 63170 |
| RPS6KA5 | 16981 | 40076 | 63171 |
| RPS6KA5 | 16982 | 40077 | 63172 |
| RPS6KA6 | 16983 | 40078 | 63173 |
| RPS6KB1 | 16984 | 40079 | 63174 |
| RPS6KB1 | 16985 | 40080 | 63175 |
| RPS6KB2 | 16986 | 40081 | 63176 |
| RPS6KC1 | 16987 | 40082 | 63177 |
| RPS6KL1 | 16988 | 40083 | 63178 |
| RPS7 | 16989 | 40084 | 63179 |
| RPS8 | 16990 | 40085 | 63180 |
| RPS9 | 16991 | 40086 | 63181 |
| RPS9 | 16992 | 40087 | 63182 |
| RPSA | 16993 | 40088 | 63183 |
| RPTN | 16994 | 40089 | 63184 |
| RPTOR | 16995 | 40090 | 63185 |
| RPUSD1 | 16996 | 40091 | 63186 |
| RPUSD1 | 16997 | 40092 | 63187 |
| RPUSD2 | 16998 | 40093 | 63188 |
| RPUSD3 | 16999 | 40094 | 63189 |
| RPUSD3 | 17000 | 40095 | 63190 |
| RPUSD3 | 17001 | 40096 | 63191 |
| RPUSD4 | 17002 | 40097 | 63192 |
| RRAD | 17003 | 40098 | 63193 |
| RRAGA | 17004 | 40099 | 63194 |
| RRAGB | 17005 | 40100 | 63195 |
| RRAGC | 17006 | 40101 | 63196 |
| RRAGD | 17007 | 40102 | 63197 |
| RRAS | 17008 | 40103 | 63198 |
| RRAS2 | 17009 | 40104 | 63199 |
| RRBP1 | 17010 | 40105 | 63200 |
| RREB1 | 17011 | 40106 | 63201 |
| RRH | 17012 | 40107 | 63202 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| RRM1 | 17013 | 40108 | 63203 |
| RRM2 | 17014 | 40109 | 63204 |
| RRM2B | 17015 | 40110 | 63205 |
| RRN3 | 17016 | 40111 | 63206 |
| RRNAD1 | 17017 | 40112 | 63207 |
| RRNAD1 | 17018 | 40113 | 63208 |
| RRP1 | 17019 | 40114 | 63209 |
| RRP12 | 17020 | 40115 | 63210 |
| RRP15 | 17021 | 40116 | 63211 |
| RRP1B | 17022 | 40117 | 63212 |
| RRP36 | 17023 | 40118 | 63213 |
| RRP7A | 17024 | 40119 | 63214 |
| RRP8 | 17025 | 40120 | 63215 |
| RRP9 | 17026 | 40121 | 63216 |
| RRS1 | 17027 | 40122 | 63217 |
| RS1 | 17028 | 40123 | 63218 |
| RSAD1 | 17029 | 40124 | 63219 |
| RSAD2 | 17030 | 40125 | 63220 |
| RSBN1 | 17031 | 40126 | 63221 |
| RSBN1L | 17032 | 40127 | 63222 |
| RSC1A1 | 17033 | 40128 | 63223 |
| RSF1 | 17034 | 40129 | 63224 |
| RSG1 | 17035 | 40130 | 63225 |
| RSL1D1 | 17036 | 40131 | 63226 |
| RSL24D1 | 17037 | 40132 | 63227 |
| RSPH1 | 17038 | 40133 | 63228 |
| RSPH10B2 | 17039 | 40134 | 63229 |
| RSPH14 | 17040 | 40135 | 63230 |
| RSPH3 | 17041 | 40136 | 63231 |
| RSPH4A | 17042 | 40137 | 63232 |
| RSPH4A | 17043 | 40138 | 63233 |
| RSPH6A | 17044 | 40139 | 63234 |
| RSPH9 | 17045 | 40140 | 63235 |
| RSPH9 | 17046 | 40141 | 63236 |
| RSPO1 | 17047 | 40142 | 63237 |
| RSPO2 | 17048 | 40143 | 63238 |
| RSPO3 | 17049 | 40144 | 63239 |
| RSPO4 | 17050 | 40145 | 63240 |
| RSPRY1 | 17051 | 40146 | 63241 |
| RSPRY1 | 17052 | 40147 | 63242 |
| RSRC1 | 17053 | 40148 | 63243 |
| RSRC2 | 17054 | 40149 | 63244 |
| RSRP1 | 17055 | 40150 | 63245 |
| RSU1 | 17056 | 40151 | 63246 |
| RTBDN | 17057 | 40152 | 63247 |
| RTBDN | 17058 | 40153 | 63248 |
| RTCA | 17059 | 40154 | 63249 |
| RTCB | 17060 | 40155 | 63250 |
| RTEL1 | 17061 | 40156 | 63251 |
| RTEL1 | 17062 | 40157 | 63252 |
| RTF1 | 17063 | 40158 | 63253 |
| RTFDC1 | 17064 | 40159 | 63254 |
| RTFDC1 | 17065 | 40160 | 63255 |
| RTKN | 17066 | 40161 | 63256 |
| RTKN2 | 17067 | 40162 | 63257 |
| RTKN2 | 17068 | 40163 | 63258 |
| RTL1 | 17069 | 40164 | 63259 |
| RTL10 | 17070 | 40165 | 63260 |
| RTL3 | 17071 | 40166 | 63261 |
| RTL4 | 17072 | 40167 | 63262 |
| RTL5 | 17073 | 40168 | 63263 |
| RTL6 | 17074 | 40169 | 63264 |
| RTL8A | 17075 | 40170 | 63265 |
| RTL8A | 17076 | 40171 | 63266 |
| RTL8B | 17077 | 40172 | 63267 |
| RTL8C | 17078 | 40173 | 63268 |
| RTL9 | 17079 | 40174 | 63269 |
| RTN1 | 17080 | 40175 | 63270 |
| RTN2 | 17081 | 40176 | 63271 |
| RTN3 | 17082 | 40177 | 63272 |
| RTN3 | 17083 | 40178 | 63273 |
| RTN3 | 17084 | 40179 | 63274 |
| RTN4 | 17085 | 40180 | 63275 |
| RTN4IP1 | 17086 | 40181 | 63276 |
| RTN4R | 17087 | 40182 | 63277 |
| RTN4RL1 | 17088 | 40183 | 63278 |
| RTN4RL2 | 17089 | 40184 | 63279 |
| RTP1 | 17090 | 40185 | 63280 |
| RTP2 | 17091 | 40186 | 63281 |
| RTP3 | 17092 | 40187 | 63282 |
| RTP4 | 17093 | 40188 | 63283 |
| RTP5 | 17094 | 40189 | 63284 |
| RTTN | 17095 | 40190 | 63285 |
| RUBCN | 17096 | 40191 | 63286 |
| RUBCNL | 17097 | 40192 | 63287 |
| RUBCNL | 17098 | 40193 | 63288 |
| RUFY1 | 17099 | 40194 | 63289 |
| RUFY2 | 17100 | 40195 | 63290 |
| RUFY2 | 17101 | 40196 | 63291 |
| RUFY3 | 17102 | 40197 | 63292 |
| RUFY3 | 17103 | 40198 | 63293 |
| RUFY3 | 17104 | 40199 | 63294 |
| RUFY4 | 17105 | 40200 | 63295 |
| RUNDC1 | 17106 | 40201 | 63296 |
| RUNDC3A | 17107 | 40202 | 63297 |
| RUNDC3A | 17108 | 40203 | 63298 |
| RUNDC3B | 17109 | 40204 | 63299 |
| RUNX1 | 17110 | 40205 | 63300 |
| RUNX1 | 17111 | 40206 | 63301 |
| RUNX1T1 | 17112 | 40207 | 63302 |
| RUNX2 | 17113 | 40208 | 63303 |
| RUNX3 | 17114 | 40209 | 63304 |
| RUSC1 | 17115 | 40210 | 63305 |
| RUSC2 | 17116 | 40211 | 63306 |
| RUVBL1 | 17117 | 40212 | 63307 |
| RUVBL1 | 17118 | 40213 | 63308 |
| RUVBL1 | 17119 | 40214 | 63309 |
| RUVBL2 | 17120 | 40215 | 63310 |
| RWDD1 | 17121 | 40216 | 63311 |
| RWDD2A | 17122 | 40217 | 63312 |
| RWDD2B | 17123 | 40218 | 63313 |
| RWDD3 | 17124 | 40219 | 63314 |
| RWDD3 | 17125 | 40220 | 63315 |
| RWDD3 | 17126 | 40221 | 63316 |
| RWDD4 | 17127 | 40222 | 63317 |
| RXFP1 | 17128 | 40223 | 63318 |
| RXFP2 | 17129 | 40224 | 63319 |
| RXFP3 | 17130 | 40225 | 63320 |
| RXFP4 | 17131 | 40226 | 63321 |
| RXRA | 17132 | 40227 | 63322 |
| RXRB | 17133 | 40228 | 63323 |
| RXRG | 17134 | 40229 | 63324 |
| RYBP | 17135 | 40230 | 63325 |
| RYK | 17136 | 40231 | 63326 |
| RYR1 | 17137 | 40232 | 63327 |
| RYR2 | 17138 | 40233 | 63328 |
| RYR3 | 17139 | 40234 | 63329 |
| S100A1 | 17140 | 40235 | 63330 |
| S100A10 | 17141 | 40236 | 63331 |
| S100A11 | 17142 | 40237 | 63332 |
| S100A12 | 17143 | 40238 | 63333 |
| S100A13 | 17144 | 40239 | 63334 |
| S100A14 | 17145 | 40240 | 63335 |
| S100A16 | 17146 | 40241 | 63336 |
| S100A2 | 17147 | 40242 | 63337 |
| S100A3 | 17148 | 40243 | 63338 |
| S100A4 | 17149 | 40244 | 63339 |
| S100A5 | 17150 | 40245 | 63340 |
| S100A6 | 17151 | 40246 | 63341 |
| S100A7 | 17152 | 40247 | 63342 |
| S100A7A | 17153 | 40248 | 63343 |
| S100A7L2 | 17154 | 40249 | 63344 |
| S100A8 | 17155 | 40250 | 63345 |
| S100A9 | 17156 | 40251 | 63346 |
| S100B | 17157 | 40252 | 63347 |
| S100G | 17158 | 40253 | 63348 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| S100P | 17159 | 40254 | 63349 |
| S100PBP | 17160 | 40255 | 63350 |
| S100Z | 17161 | 40256 | 63351 |
| S1PR1 | 17162 | 40257 | 63352 |
| S1PR2 | 17163 | 40258 | 63353 |
| S1PR3 | 17164 | 40259 | 63354 |
| S1PR4 | 17165 | 40260 | 63355 |
| S1PR5 | 17166 | 40261 | 63356 |
| SAA1 | 17167 | 40262 | 63357 |
| SAA2 | 17168 | 40263 | 63358 |
| SAA4 | 17169 | 40264 | 63359 |
| SAAL1 | 17170 | 40265 | 63360 |
| SAC3D1 | 17171 | 40266 | 63361 |
| SACM1L | 17172 | 40267 | 63362 |
| SACS | 17173 | 40268 | 63363 |
| SAE1 | 17174 | 40269 | 63364 |
| SAE1 | 17175 | 40270 | 63365 |
| SAE1 | 17176 | 40271 | 63366 |
| SAFB | 17177 | 40272 | 63367 |
| SAFB2 | 17178 | 40273 | 63368 |
| SAG | 17179 | 40274 | 63369 |
| SAGE1 | 17180 | 40275 | 63370 |
| SALL1 | 17181 | 40276 | 63371 |
| SALL2 | 17182 | 40277 | 63372 |
| SALL2 | 17183 | 40278 | 63373 |
| SALL3 | 17184 | 40279 | 63374 |
| SALL4 | 17185 | 40280 | 63375 |
| SAMD1 | 17186 | 40281 | 63376 |
| SAMD10 | 17187 | 40282 | 63377 |
| SAMD11 | 17188 | 40283 | 63378 |
| SAMD12 | 17189 | 40284 | 63379 |
| SAMD12 | 17190 | 40285 | 63380 |
| SAMD13 | 17191 | 40286 | 63381 |
| SAMD14 | 17192 | 40287 | 63382 |
| SAMD15 | 17193 | 40288 | 63383 |
| SAMD3 | 17194 | 40289 | 63384 |
| SAMD4A | 17195 | 40290 | 63385 |
| SAMD4B | 17196 | 40291 | 63386 |
| SAMD4B | 17197 | 40292 | 63387 |
| SAMD5 | 17198 | 40293 | 63388 |
| SAMD7 | 17199 | 40294 | 63389 |
| SAMD8 | 17200 | 40295 | 63390 |
| SAMD8 | 17201 | 40296 | 63391 |
| SAMD9 | 17202 | 40297 | 63392 |
| SAMD9L | 17203 | 40298 | 63393 |
| SAMHD1 | 17204 | 40299 | 63394 |
| SAMM50 | 17205 | 40300 | 63395 |
| SAMSN1 | 17206 | 40301 | 63396 |
| SAP130 | 17207 | 40302 | 63397 |
| SAP18 | 17208 | 40303 | 63398 |
| SAP25 | 17209 | 40304 | 63399 |
| SAP30 | 17210 | 40305 | 63400 |
| SAP30BP | 17211 | 40306 | 63401 |
| SAP30L | 17212 | 40307 | 63402 |
| SAPCD1 | 17213 | 40308 | 63403 |
| SAPCD2 | 17214 | 40309 | 63404 |
| SAR1A | 17215 | 40310 | 63405 |
| SAR1B | 17216 | 40311 | 63406 |
| SARAF | 17217 | 40312 | 63407 |
| SARDH | 17218 | 40313 | 63408 |
| SARM1 | 17219 | 40314 | 63409 |
| SARNP | 17220 | 40315 | 63410 |
| SARS | 17221 | 40316 | 63411 |
| SARS2 | 17222 | 40317 | 63412 |
| SART1 | 17223 | 40318 | 63413 |
| SART3 | 17224 | 40319 | 63414 |
| SASH1 | 17225 | 40320 | 63415 |
| SASH3 | 17226 | 40321 | 63416 |
| SASS6 | 17227 | 40322 | 63417 |
| SAT1 | 17228 | 40323 | 63418 |
| SAT2 | 17229 | 40324 | 63419 |
| SATB1 | 17230 | 40325 | 63420 |
| SATB2 | 17231 | 40326 | 63421 |
| SATL1 | 17232 | 40327 | 63422 |
| SAV1 | 17233 | 40328 | 63423 |
| SAXO1 | 17234 | 40329 | 63424 |
| SAXO2 | 17235 | 40330 | 63425 |
| SAXO2 | 17236 | 40331 | 63426 |
| SAYSD1 | 17237 | 40332 | 63427 |
| SBDS | 17238 | 40333 | 63428 |
| SBF1 | 17239 | 40334 | 63429 |
| SBF2 | 17240 | 40335 | 63430 |
| SBK1 | 17241 | 40336 | 63431 |
| SBK2 | 17242 | 40337 | 63432 |
| SBK3 | 17243 | 40338 | 63433 |
| SBNO1 | 17244 | 40339 | 63434 |
| SBNO2 | 17245 | 40340 | 63435 |
| SBSN | 17246 | 40341 | 63436 |
| SBSPON | 17247 | 40342 | 63437 |
| SC5D | 17248 | 40343 | 63438 |
| SCAF1 | 17249 | 40344 | 63439 |
| SCAF11 | 17250 | 40345 | 63440 |
| SCAF4 | 17251 | 40346 | 63441 |
| SCAF8 | 17252 | 40347 | 63442 |
| SCAI | 17253 | 40348 | 63443 |
| SCAMP1 | 17254 | 40349 | 63444 |
| SCAMP2 | 17255 | 40350 | 63445 |
| SCAMP3 | 17256 | 40351 | 63446 |
| SCAMP4 | 17257 | 40352 | 63447 |
| SCAMP5 | 17258 | 40353 | 63448 |
| SCAND1 | 17259 | 40354 | 63449 |
| SCAP | 17260 | 40355 | 63450 |
| SCAPER | 17261 | 40356 | 63451 |
| SCARA3 | 17262 | 40357 | 63452 |
| SCARA3 | 17263 | 40358 | 63453 |
| SCARA5 | 17264 | 40359 | 63454 |
| SCARB1 | 17265 | 40360 | 63455 |
| SCARB1 | 17266 | 40361 | 63456 |
| SCARB2 | 17267 | 40362 | 63457 |
| SCARF1 | 17268 | 40363 | 63458 |
| SCARF1 | 17269 | 40364 | 63459 |
| SCARF2 | 17270 | 40365 | 63460 |
| SCCPDH | 17271 | 40366 | 63461 |
| SCD | 17272 | 40367 | 63462 |
| SCD5 | 17273 | 40368 | 63463 |
| SCD5 | 17274 | 40369 | 63464 |
| SCEL | 17275 | 40370 | 63465 |
| SCFD1 | 17276 | 40371 | 63466 |
| SCFD2 | 17277 | 40372 | 63467 |
| SCG2 | 17278 | 40373 | 63468 |
| SCG3 | 17279 | 40374 | 63469 |
| SCG5 | 17280 | 40375 | 63470 |
| SCGB1A1 | 17281 | 40376 | 63471 |
| SCGB1C1 | 17282 | 40377 | 63472 |
| SCGB1D1 | 17283 | 40378 | 63473 |
| SCGB1D2 | 17284 | 40379 | 63474 |
| SCGB1D4 | 17285 | 40380 | 63475 |
| SCGB2A1 | 17286 | 40381 | 63476 |
| SCGB2A2 | 17287 | 40382 | 63477 |
| SCGB2B2 | 17288 | 40383 | 63478 |
| SCGB3A1 | 17289 | 40384 | 63479 |
| SCGB3A2 | 17290 | 40385 | 63480 |
| SCGN | 17291 | 40386 | 63481 |
| SCHIP1 | 17292 | 40387 | 63482 |
| SCIMP | 17293 | 40388 | 63483 |
| SCIMP | 17294 | 40389 | 63484 |
| SCIN | 17295 | 40390 | 63485 |
| SCLT1 | 17296 | 40391 | 63486 |
| SCLT1 | 17297 | 40392 | 63487 |
| SCLT1 | 17298 | 40393 | 63488 |
| SCLY | 17299 | 40394 | 63489 |
| SCMH1 | 17300 | 40395 | 63490 |
| SCML1 | 17301 | 40396 | 63491 |
| SCML2 | 17302 | 40397 | 63492 |
| SCML4 | 17303 | 40398 | 63493 |
| SCN10A | 17304 | 40399 | 63494 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| SCN11A | 17305 | 40400 | 63495 |
| SCN1A | 17306 | 40401 | 63496 |
| SCN1B | 17307 | 40402 | 63497 |
| SCN1B | 17308 | 40403 | 63498 |
| SCN2A | 17309 | 40404 | 63499 |
| SCN2B | 17310 | 40405 | 63500 |
| SCN3A | 17311 | 40406 | 63501 |
| SCN3B | 17312 | 40407 | 63502 |
| SCN4A | 17313 | 40408 | 63503 |
| SCN4B | 17314 | 40409 | 63504 |
| SCN4B | 17315 | 40410 | 63505 |
| SCN5A | 17316 | 40411 | 63506 |
| SCN7A | 17317 | 40412 | 63507 |
| SCN8A | 17318 | 40413 | 63508 |
| SCN9A | 17319 | 40414 | 63509 |
| SCNM1 | 17320 | 40415 | 63510 |
| SCNN1A | 17321 | 40416 | 63511 |
| SCNN1B | 17322 | 40417 | 63512 |
| SCNN1D | 17323 | 40418 | 63513 |
| SCNN1G | 17324 | 40419 | 63514 |
| SCO1 | 17325 | 40420 | 63515 |
| SCO2 | 17326 | 40421 | 63516 |
| SCOC | 17327 | 40422 | 63517 |
| SCP2 | 17328 | 40423 | 63518 |
| SCP2 | 17329 | 40424 | 63519 |
| SCP2 | 17330 | 40425 | 63520 |
| SCP2D1 | 17331 | 40426 | 63521 |
| SCPEP1 | 17332 | 40427 | 63522 |
| SCRG1 | 17333 | 40428 | 63523 |
| SCRIB | 17334 | 40429 | 63524 |
| SCRN1 | 17335 | 40430 | 63525 |
| SCRN2 | 17336 | 40431 | 63526 |
| SCRN2 | 17337 | 40432 | 63527 |
| SCRN3 | 17338 | 40433 | 63528 |
| SCRT1 | 17339 | 40434 | 63529 |
| SCRT2 | 17340 | 40435 | 63530 |
| SCT | 17341 | 40436 | 63531 |
| SCTR | 17342 | 40437 | 63532 |
| SCUBE1 | 17343 | 40438 | 63533 |
| SCUBE2 | 17344 | 40439 | 63534 |
| SCUBE3 | 17345 | 40440 | 63535 |
| SCX | 17346 | 40441 | 63536 |
| SCYL1 | 17347 | 40442 | 63537 |
| SCYL2 | 17348 | 40443 | 63538 |
| SCYL3 | 17349 | 40444 | 63539 |
| SDAD1 | 17350 | 40445 | 63540 |
| SDC1 | 17351 | 40446 | 63541 |
| SDC2 | 17352 | 40447 | 63542 |
| SDC3 | 17353 | 40448 | 63543 |
| SDC4 | 17354 | 40449 | 63544 |
| SDCBP | 17355 | 40450 | 63545 |
| SDCBP2 | 17356 | 40451 | 63546 |
| SDCCAG3 | 17357 | 40452 | 63547 |
| SDCCAG8 | 17358 | 40453 | 63548 |
| SDE2 | 17359 | 40454 | 63549 |
| SDF2 | 17360 | 40455 | 63550 |
| SDF2L1 | 17361 | 40456 | 63551 |
| SDF4 | 17362 | 40457 | 63552 |
| SDF4 | 17363 | 40458 | 63553 |
| SDHA | 17364 | 40459 | 63554 |
| SDHAF1 | 17365 | 40460 | 63555 |
| SDHAF2 | 17366 | 40461 | 63556 |
| SDHAF3 | 17367 | 40462 | 63557 |
| SDHAF4 | 17368 | 40463 | 63558 |
| SDHB | 17369 | 40464 | 63559 |
| SDHC | 17370 | 40465 | 63560 |
| SDHC | 17371 | 40466 | 63561 |
| SDHD | 17372 | 40467 | 63562 |
| SDHD | 17373 | 40468 | 63563 |
| SDK1 | 17374 | 40469 | 63564 |
| SDK1 | 17375 | 40470 | 63565 |
| SDK2 | 17376 | 40471 | 63566 |
| SDR16C5 | 17377 | 40472 | 63567 |
| SDR16C5 | 17378 | 40473 | 63568 |
| SDR39U1 | 17379 | 40474 | 63569 |
| SDR42E1 | 17380 | 40475 | 63570 |
| SDR9C7 | 17381 | 40476 | 63571 |
| SDS | 17382 | 40477 | 63572 |
| SDSL | 17383 | 40478 | 63573 |
| SEBOX | 17384 | 40479 | 63574 |
| SEC11A | 17385 | 40480 | 63575 |
| SEC11A | 17386 | 40481 | 63576 |
| SEC11A | 17387 | 40482 | 63577 |
| SEC11C | 17388 | 40483 | 63578 |
| SEC13 | 17389 | 40484 | 63579 |
| SEC13 | 17390 | 40485 | 63580 |
| SEC14L1 | 17391 | 40486 | 63581 |
| SEC14L1 | 17392 | 40487 | 63582 |
| SEC14L2 | 17393 | 40488 | 63583 |
| SEC14L2 | 17394 | 40489 | 63584 |
| SEC14L3 | 17395 | 40490 | 63585 |
| SEC14L4 | 17396 | 40491 | 63586 |
| SEC14L4 | 17397 | 40492 | 63587 |
| SEC14L5 | 17398 | 40493 | 63588 |
| SEC14L6 | 17399 | 40494 | 63589 |
| SEC14L6 | 17400 | 40495 | 63590 |
| SEC16A | 17401 | 40496 | 63591 |
| SEC16B | 17402 | 40497 | 63592 |
| SEC22A | 17403 | 40498 | 63593 |
| SEC22B | 17404 | 40499 | 63594 |
| SEC22C | 17405 | 40500 | 63595 |
| SEC22C | 17406 | 40501 | 63596 |
| SEC23A | 17407 | 40502 | 63597 |
| SEC23B | 17408 | 40503 | 63598 |
| SEC23IP | 17409 | 40504 | 63599 |
| SEC24A | 17410 | 40505 | 63600 |
| SEC24A | 17411 | 40506 | 63601 |
| SEC24B | 17412 | 40507 | 63602 |
| SEC24C | 17413 | 40508 | 63603 |
| SEC24D | 17414 | 40509 | 63604 |
| SEC31A | 17415 | 40510 | 63605 |
| SEC31B | 17416 | 40511 | 63606 |
| SEC61A1 | 17417 | 40512 | 63607 |
| SEC61A2 | 17418 | 40513 | 63608 |
| SEC61A2 | 17419 | 40514 | 63609 |
| SEC61B | 17420 | 40515 | 63610 |
| SEC61G | 17421 | 40516 | 63611 |
| SEC62 | 17422 | 40517 | 63612 |
| SEC63 | 17423 | 40518 | 63613 |
| SECISBP2 | 17424 | 40519 | 63614 |
| SECISBP2L | 17425 | 40520 | 63615 |
| SECTM1 | 17426 | 40521 | 63616 |
| SEH1L | 17427 | 40522 | 63617 |
| SEH1L | 17428 | 40523 | 63618 |
| SEL1L | 17429 | 40524 | 63619 |
| SEL1L | 17430 | 40525 | 63620 |
| SEL1L2 | 17431 | 40526 | 63621 |
| SEL1L3 | 17432 | 40527 | 63622 |
| SELE | 17433 | 40528 | 63623 |
| SELENBP1 | 17434 | 40529 | 63624 |
| SELENOF | 17435 | 40530 | 63625 |
| SELENOH | 17436 | 40531 | 63626 |
| SELENOI | 17437 | 40532 | 63627 |
| SELENOK | 17438 | 40533 | 63628 |
| SELENOM | 17439 | 40534 | 63629 |
| SELENON | 17440 | 40535 | 63630 |
| SELENOO | 17441 | 40536 | 63631 |
| SELENOP | 17442 | 40537 | 63632 |
| SELENOS | 17443 | 40538 | 63633 |
| SELENOT | 17444 | 40539 | 63634 |
| SELENOV | 17445 | 40540 | 63635 |
| SELENOW | 17446 | 40541 | 63636 |
| SELL | 17447 | 40542 | 63637 |
| SELP | 17448 | 40543 | 63638 |
| SELPLG | 17449 | 40544 | 63639 |
| SEM1 | 17450 | 40545 | 63640 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| SEM1 | 17451 | 40546 | 63641 |
| SEMA3A | 17452 | 40547 | 63642 |
| SEMA3B | 17453 | 40548 | 63643 |
| SEMA3C | 17454 | 40549 | 63644 |
| SEMA3D | 17455 | 40550 | 63645 |
| SEMA3E | 17456 | 40551 | 63646 |
| SEMA3F | 17457 | 40552 | 63647 |
| SEMA3G | 17458 | 40553 | 63648 |
| SEMA4A | 17459 | 40554 | 63649 |
| SEMA4B | 17460 | 40555 | 63650 |
| SEMA4B | 17461 | 40556 | 63651 |
| SEMA4C | 17462 | 40557 | 63652 |
| SEMA4D | 17463 | 40558 | 63653 |
| SEMA4D | 17464 | 40559 | 63654 |
| SEMA4F | 17465 | 40560 | 63655 |
| SEMA4G | 17466 | 40561 | 63656 |
| SEMA4G | 17467 | 40562 | 63657 |
| SEMA5A | 17468 | 40563 | 63658 |
| SEMA5B | 17469 | 40564 | 63659 |
| SEMA6A | 17470 | 40565 | 63660 |
| SEMA6B | 17471 | 40566 | 63661 |
| SEMA6C | 17472 | 40567 | 63662 |
| SEMA6D | 17473 | 40568 | 63663 |
| SEMA6D | 17474 | 40569 | 63664 |
| SEMA6D | 17475 | 40570 | 63665 |
| SEMA7A | 17476 | 40571 | 63666 |
| SEMG1 | 17477 | 40572 | 63667 |
| SEMG2 | 17478 | 40573 | 63668 |
| SENP1 | 17479 | 40574 | 63669 |
| SENP2 | 17480 | 40575 | 63670 |
| SENP3 | 17481 | 40576 | 63671 |
| SENP5 | 17482 | 40577 | 63672 |
| SENP6 | 17483 | 40578 | 63673 |
| SENP6 | 17484 | 40579 | 63674 |
| SENP7 | 17485 | 40580 | 63675 |
| SENP7 | 17486 | 40581 | 63676 |
| SENP8 | 17487 | 40582 | 63677 |
| SEPHS1 | 17488 | 40583 | 63678 |
| SEPHS2 | 17489 | 40584 | 63679 |
| SEPSECS | 17490 | 40585 | 63680 |
| SEPT1 | 17491 | 40586 | 63681 |
| SEPT10 | 17492 | 40587 | 63682 |
| SEPT10 | 17493 | 40588 | 63683 |
| SEPT10 | 17494 | 40589 | 63684 |
| SEPT10 | 17495 | 40590 | 63685 |
| SEPT11 | 17496 | 40591 | 63686 |
| SEPT12 | 17497 | 40592 | 63687 |
| SEPT14 | 17498 | 40593 | 63688 |
| SEPT2 | 17499 | 40594 | 63689 |
| SEPT3 | 17500 | 40595 | 63690 |
| SEPT3 | 17501 | 40596 | 63691 |
| SEPT4 | 17502 | 40597 | 63692 |
| SEPT4 | 17503 | 40598 | 63693 |
| SEPT5 | 17504 | 40599 | 63694 |
| SEPT5 | 17505 | 40600 | 63695 |
| SEPT6 | 17506 | 40601 | 63696 |
| SEPT6 | 17507 | 40602 | 63697 |
| SEPT7 | 17508 | 40603 | 63698 |
| SEPT8 | 17509 | 40604 | 63699 |
| SEPT8 | 17510 | 40605 | 63700 |
| SEPT8 | 17511 | 40606 | 63701 |
| SEPT9 | 17512 | 40607 | 63702 |
| SERAC1 | 17513 | 40608 | 63703 |
| SERBP1 | 17514 | 40609 | 63704 |
| SERF1B | 17515 | 40610 | 63705 |
| SERF1B | 17516 | 40611 | 63706 |
| SERF2 | 17517 | 40612 | 63707 |
| SERGEF | 17518 | 40613 | 63708 |
| SERHL2 | 17519 | 40614 | 63709 |
| SERINC1 | 17520 | 40615 | 63710 |
| SERINC2 | 17521 | 40616 | 63711 |
| SERINC3 | 17522 | 40617 | 63712 |
| SERINC4 | 17523 | 40618 | 63713 |
| SERINC5 | 17524 | 40619 | 63714 |
| SERINC5 | 17525 | 40620 | 63715 |
| SERP1 | 17526 | 40621 | 63716 |
| SERP2 | 17527 | 40622 | 63717 |
| SERPINA1 | 17528 | 40623 | 63718 |
| SERPINA10 | 17529 | 40624 | 63719 |
| SERPINA11 | 17530 | 40625 | 63720 |
| SERPINA12 | 17531 | 40626 | 63721 |
| SERPINA2 | 17532 | 40627 | 63722 |
| SERPINA3 | 17533 | 40628 | 63723 |
| SERPINA4 | 17534 | 40629 | 63724 |
| SERPINA5 | 17535 | 40630 | 63725 |
| SERPINA6 | 17536 | 40631 | 63726 |
| SERPINA7 | 17537 | 40632 | 63727 |
| SERPINA9 | 17538 | 40633 | 63728 |
| SERPINB1 | 17539 | 40634 | 63729 |
| SERPINB10 | 17540 | 40635 | 63730 |
| SERPINB11 | 17541 | 40636 | 63731 |
| SERPINB12 | 17542 | 40637 | 63732 |
| SERPINB13 | 17543 | 40638 | 63733 |
| SERPINB2 | 17544 | 40639 | 63734 |
| SERPINB3 | 17545 | 40640 | 63735 |
| SERPINB4 | 17546 | 40641 | 63736 |
| SERPINB5 | 17547 | 40642 | 63737 |
| SERPINB6 | 17548 | 40643 | 63738 |
| SERPINB7 | 17549 | 40644 | 63739 |
| SERPINB8 | 17550 | 40645 | 63740 |
| SERPINB8 | 17551 | 40646 | 63741 |
| SERPINB8 | 17552 | 40647 | 63742 |
| SERPINB8 | 17553 | 40648 | 63743 |
| SERPINB9 | 17554 | 40649 | 63744 |
| SERPINC1 | 17555 | 40650 | 63745 |
| SERPIND1 | 17556 | 40651 | 63746 |
| SERPINE1 | 17557 | 40652 | 63747 |
| SERPINE2 | 17558 | 40653 | 63748 |
| SERPINE3 | 17559 | 40654 | 63749 |
| SERPINF1 | 17560 | 40655 | 63750 |
| SERPINF2 | 17561 | 40656 | 63751 |
| SERPING1 | 17562 | 40657 | 63752 |
| SERPINH1 | 17563 | 40658 | 63753 |
| SERPINI1 | 17564 | 40659 | 63754 |
| SERPINI2 | 17565 | 40660 | 63755 |
| SERTAD1 | 17566 | 40661 | 63756 |
| SERTAD2 | 17567 | 40662 | 63757 |
| SERTAD3 | 17568 | 40663 | 63758 |
| SERTAD4 | 17569 | 40664 | 63759 |
| SERTAD4 | 17570 | 40665 | 63760 |
| SERTM1 | 17571 | 40666 | 63761 |
| SESN1 | 17572 | 40667 | 63762 |
| SESN2 | 17573 | 40668 | 63763 |
| SESN3 | 17574 | 40669 | 63764 |
| SESTD1 | 17575 | 40670 | 63765 |
| SETBP1 | 17576 | 40671 | 63766 |
| SETBP1 | 17577 | 40672 | 63767 |
| SETD1A | 17578 | 40673 | 63768 |
| SETD1B | 17579 | 40674 | 63769 |
| SETD2 | 17580 | 40675 | 63770 |
| SETD3 | 17581 | 40676 | 63771 |
| SETD3 | 17582 | 40677 | 63772 |
| SETD4 | 17583 | 40678 | 63773 |
| SETD4 | 17584 | 40679 | 63774 |
| SETD5 | 17585 | 40680 | 63775 |
| SETD6 | 17586 | 40681 | 63776 |
| SETD7 | 17587 | 40682 | 63777 |
| SETD7 | 17588 | 40683 | 63778 |
| SETD7 | 17589 | 40684 | 63779 |
| SETD9 | 17590 | 40685 | 63780 |
| SETD9 | 17591 | 40686 | 63781 |
| SETD9 | 17592 | 40687 | 63782 |
| SETDB1 | 17593 | 40688 | 63783 |
| SETDB1 | 17594 | 40689 | 63784 |
| SETDB2 | 17595 | 40690 | 63785 |
| SETMAR | 17596 | 40691 | 63786 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| SETMAR | 17597 | 40692 | 63787 |
| SETSIP | 17598 | 40693 | 63788 |
| SETX | 17599 | 40694 | 63789 |
| SEZ6 | 17600 | 40695 | 63790 |
| SEZ6 | 17601 | 40696 | 63791 |
| SEZ6L | 17602 | 40697 | 63792 |
| SEZ6L2 | 17603 | 40698 | 63793 |
| SF1 | 17604 | 40699 | 63794 |
| SF1 | 17605 | 40700 | 63795 |
| SF1 | 17606 | 40701 | 63796 |
| SF1 | 17607 | 40702 | 63797 |
| SF3A1 | 17608 | 40703 | 63798 |
| SF3A2 | 17609 | 40704 | 63799 |
| SF3A3 | 17610 | 40705 | 63800 |
| SF3B1 | 17611 | 40706 | 63801 |
| SF3B1 | 17612 | 40707 | 63802 |
| SF3B2 | 17613 | 40708 | 63803 |
| SF3B3 | 17614 | 40709 | 63804 |
| SF3B4 | 17615 | 40710 | 63805 |
| SF3B5 | 17616 | 40711 | 63806 |
| SF3B6 | 17617 | 40712 | 63807 |
| SFI1 | 17618 | 40713 | 63808 |
| SFMBT1 | 17619 | 40714 | 63809 |
| SFMBT2 | 17620 | 40715 | 63810 |
| SFN | 17621 | 40716 | 63811 |
| SFPQ | 17622 | 40717 | 63812 |
| SFR1 | 17623 | 40718 | 63813 |
| SFRP1 | 17624 | 40719 | 63814 |
| SFRP2 | 17625 | 40720 | 63815 |
| SFRP4 | 17626 | 40721 | 63816 |
| SFRP5 | 17627 | 40722 | 63817 |
| SFSWAP | 17628 | 40723 | 63818 |
| SFT2D1 | 17629 | 40724 | 63819 |
| SFT2D2 | 17630 | 40725 | 63820 |
| SFT2D3 | 17631 | 40726 | 63821 |
| SFTA2 | 17632 | 40727 | 63822 |
| SFTA3 | 17633 | 40728 | 63823 |
| SFTA3 | 17634 | 40729 | 63824 |
| SFTA3 | 17635 | 40730 | 63825 |
| SFTPA1 | 17636 | 40731 | 63826 |
| SFTPB | 17637 | 40732 | 63827 |
| SFTPC | 17638 | 40733 | 63828 |
| SFTPD | 17639 | 40734 | 63829 |
| SFXN1 | 17640 | 40735 | 63830 |
| SFXN1 | 17641 | 40736 | 63831 |
| SFXN1 | 17642 | 40737 | 63832 |
| SFXN2 | 17643 | 40738 | 63833 |
| SFXN3 | 17644 | 40739 | 63834 |
| SFXN4 | 17645 | 40740 | 63835 |
| SFXN5 | 17646 | 40741 | 63836 |
| SFXN5 | 17647 | 40742 | 63837 |
| SFXN5 | 17648 | 40743 | 63838 |
| SFXN5 | 17649 | 40744 | 63839 |
| SGCA | 17650 | 40745 | 63840 |
| SGCB | 17651 | 40746 | 63841 |
| SGCD | 17652 | 40747 | 63842 |
| SGCD | 17653 | 40748 | 63843 |
| SGCE | 17654 | 40749 | 63844 |
| SGCG | 17655 | 40750 | 63845 |
| SGCZ | 17656 | 40751 | 63846 |
| SGF29 | 17657 | 40752 | 63847 |
| SGIP1 | 17658 | 40753 | 63848 |
| SGK1 | 17659 | 40754 | 63849 |
| SGK2 | 17660 | 40755 | 63850 |
| SGK3 | 17661 | 40756 | 63851 |
| SGK494 | 17662 | 40757 | 63852 |
| SGMS1 | 17663 | 40758 | 63853 |
| SGMS2 | 17664 | 40759 | 63854 |
| SGO1 | 17665 | 40760 | 63855 |
| SGO1 | 17666 | 40761 | 63856 |
| SGO2 | 17667 | 40762 | 63857 |
| SGPL1 | 17668 | 40763 | 63858 |
| SGPP1 | 17669 | 40764 | 63859 |
| SGPP2 | 17670 | 40765 | 63860 |
| SGSH | 17671 | 40766 | 63861 |
| SGSH | 17672 | 40767 | 63862 |
| SGSH | 17673 | 40768 | 63863 |
| SGSM1 | 17674 | 40769 | 63864 |
| SGSM2 | 17675 | 40770 | 63865 |
| SGSM2 | 17676 | 40771 | 63866 |
| SGSM3 | 17677 | 40772 | 63867 |
| SGSM3 | 17678 | 40773 | 63868 |
| SGTA | 17679 | 40774 | 63869 |
| SGTB | 17680 | 40775 | 63870 |
| SH2B1 | 17681 | 40776 | 63871 |
| SH2B1 | 17682 | 40777 | 63872 |
| SH2B1 | 17683 | 40778 | 63873 |
| SH2B2 | 17684 | 40779 | 63874 |
| SH2B3 | 17685 | 40780 | 63875 |
| SH2D1A | 17686 | 40781 | 63876 |
| SH2D1B | 17687 | 40782 | 63877 |
| SH2D2A | 17688 | 40783 | 63878 |
| SH2D3A | 17689 | 40784 | 63879 |
| SH2D3C | 17690 | 40785 | 63880 |
| SH2D4A | 17691 | 40786 | 63881 |
| SH2D4B | 17692 | 40787 | 63882 |
| SH2D5 | 17693 | 40788 | 63883 |
| SH2D6 | 17694 | 40789 | 63884 |
| SH2D7 | 17695 | 40790 | 63885 |
| SH3BGR | 17696 | 40791 | 63886 |
| SH3BGRL | 17697 | 40792 | 63887 |
| SH3BGRL2 | 17698 | 40793 | 63888 |
| SH3BGRL3 | 17699 | 40794 | 63889 |
| SH3BP1 | 17700 | 40795 | 63890 |
| SH3BP1 | 17701 | 40796 | 63891 |
| SH3BP2 | 17702 | 40797 | 63892 |
| SH3BP4 | 17703 | 40798 | 63893 |
| SH3BP5 | 17704 | 40799 | 63894 |
| SH3BP5L | 17705 | 40800 | 63895 |
| SH3D19 | 17706 | 40801 | 63896 |
| SH3D21 | 17707 | 40802 | 63897 |
| SH3GL1 | 17708 | 40803 | 63898 |
| SH3GL2 | 17709 | 40804 | 63899 |
| SH3GL3 | 17710 | 40805 | 63900 |
| SH3GL3 | 17711 | 40806 | 63901 |
| SH3GLB1 | 17712 | 40807 | 63902 |
| SH3GLB2 | 17713 | 40808 | 63903 |
| SH3GLB2 | 17714 | 40809 | 63904 |
| SH3KBP1 | 17715 | 40810 | 63905 |
| SH3PXD2A | 17716 | 40811 | 63906 |
| SH3PXD2B | 17717 | 40812 | 63907 |
| SH3PXD2B | 17718 | 40813 | 63908 |
| SH3RF1 | 17719 | 40814 | 63909 |
| SH3RF2 | 17720 | 40815 | 63910 |
| SH3RF3 | 17721 | 40816 | 63911 |
| SH3TC1 | 17722 | 40817 | 63912 |
| SH3TC2 | 17723 | 40818 | 63913 |
| SH3YL1 | 17724 | 40819 | 63914 |
| SHANK1 | 17725 | 40820 | 63915 |
| SHANK2 | 17726 | 40821 | 63916 |
| SHANK3 | 17727 | 40822 | 63917 |
| SHARPIN | 17728 | 40823 | 63918 |
| SHB | 17729 | 40824 | 63919 |
| SHBG | 17730 | 40825 | 63920 |
| SHBG | 17731 | 40826 | 63921 |
| SHC1 | 17732 | 40827 | 63922 |
| SHC2 | 17733 | 40828 | 63923 |
| SHC3 | 17734 | 40829 | 63924 |
| SHC4 | 17735 | 40830 | 63925 |
| SHCBP1 | 17736 | 40831 | 63926 |
| SHCBP1L | 17737 | 40832 | 63927 |
| SHD | 17738 | 40833 | 63928 |
| SHE | 17739 | 40834 | 63929 |
| SHF | 17740 | 40835 | 63930 |
| SHF | 17741 | 40836 | 63931 |
| SHF | 17742 | 40837 | 63932 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| SHH | 17743 | 40838 | 63933 |
| SHH | 17744 | 40839 | 63934 |
| SHISA2 | 17745 | 40840 | 63935 |
| SHISA3 | 17746 | 40841 | 63936 |
| SHISA4 | 17747 | 40842 | 63937 |
| SHISA5 | 17748 | 40843 | 63938 |
| SHISA5 | 17749 | 40844 | 63939 |
| SHISA5 | 17750 | 40845 | 63940 |
| SHISA6 | 17751 | 40846 | 63941 |
| SHISA7 | 17752 | 40847 | 63942 |
| SHISA8 | 17753 | 40848 | 63943 |
| SHISA9 | 17754 | 40849 | 63944 |
| SHISA9 | 17755 | 40850 | 63945 |
| SHKBP1 | 17756 | 40851 | 63946 |
| SHMT1 | 17757 | 40852 | 63947 |
| SHMT2 | 17758 | 40853 | 63948 |
| SHOC2 | 17759 | 40854 | 63949 |
| SHOX | 17760 | 40855 | 63950 |
| SHOX | 17761 | 40856 | 63951 |
| SHOX2 | 17762 | 40857 | 63952 |
| SHPK | 17763 | 40858 | 63953 |
| SHPRH | 17764 | 40859 | 63954 |
| SHPRH | 17765 | 40860 | 63955 |
| SHQ1 | 17766 | 40861 | 63956 |
| SHROOM1 | 17767 | 40862 | 63957 |
| SHROOM2 | 17768 | 40863 | 63958 |
| SHROOM3 | 17769 | 40864 | 63959 |
| SHROOM4 | 17770 | 40865 | 63960 |
| SHTN1 | 17771 | 40866 | 63961 |
| SHTN1 | 17772 | 40867 | 63962 |
| SHTN1 | 17773 | 40868 | 63963 |
| SI | 17774 | 40869 | 63964 |
| SIAE | 17775 | 40870 | 63965 |
| SIAH1 | 17776 | 40871 | 63966 |
| SIAH2 | 17777 | 40872 | 63967 |
| SIAH3 | 17778 | 40873 | 63968 |
| SIDT1 | 17779 | 40874 | 63969 |
| SIDT2 | 17780 | 40875 | 63970 |
| SIGIRR | 17781 | 40876 | 63971 |
| SIGLEC1 | 17782 | 40877 | 63972 |
| SIGLEC10 | 17783 | 40878 | 63973 |
| SIGLEC11 | 17784 | 40879 | 63974 |
| SIGLEC12 | 17785 | 40880 | 63975 |
| SIGLEC14 | 17786 | 40881 | 63976 |
| SIGLEC15 | 17787 | 40882 | 63977 |
| SIGLEC16 | 17788 | 40883 | 63978 |
| SIGLEC5 | 17789 | 40884 | 63979 |
| SIGLEC6 | 17790 | 40885 | 63980 |
| SIGLEC6 | 17791 | 40886 | 63981 |
| SIGLEC6 | 17792 | 40887 | 63982 |
| SIGLEC7 | 17793 | 40888 | 63983 |
| SIGLEC7 | 17794 | 40889 | 63984 |
| SIGLEC8 | 17795 | 40890 | 63985 |
| SIGLEC9 | 17796 | 40891 | 63986 |
| SIGLEC9 | 17797 | 40892 | 63987 |
| SIGLECL1 | 17798 | 40893 | 63988 |
| SIGMAR1 | 17799 | 40894 | 63989 |
| SIGMAR1 | 17800 | 40895 | 63990 |
| SIGMAR1 | 17801 | 40896 | 63991 |
| SIGMAR1 | 17802 | 40897 | 63992 |
| SIK1 | 17803 | 40898 | 63993 |
| SIK2 | 17804 | 40899 | 63994 |
| SIK3 | 17805 | 40900 | 63995 |
| SIKE1 | 17806 | 40901 | 63996 |
| SIL1 | 17807 | 40902 | 63997 |
| SIM1 | 17808 | 40903 | 63998 |
| SIM2 | 17809 | 40904 | 63999 |
| SIM2 | 17810 | 40905 | 64000 |
| SIMC1 | 17811 | 40906 | 64001 |
| SIN3A | 17812 | 40907 | 64002 |
| SIN3B | 17813 | 40908 | 64003 |
| SINHCAF | 17814 | 40909 | 64004 |
| SIPA1 | 17815 | 40910 | 64005 |
| SIPA1L1 | 17816 | 40911 | 64006 |
| SIPA1L2 | 17817 | 40912 | 64007 |
| SIPA1L3 | 17818 | 40913 | 64008 |
| SIRPA | 17819 | 40914 | 64009 |
| SIRPB1 | 17820 | 40915 | 64010 |
| SIRPB1 | 17821 | 40916 | 64011 |
| SIRPB2 | 17822 | 40917 | 64012 |
| SIRPD | 17823 | 40918 | 64013 |
| SIRPG | 17824 | 40919 | 64014 |
| SIRT1 | 17825 | 40920 | 64015 |
| SIRT2 | 17826 | 40921 | 64016 |
| SIRT2 | 17827 | 40922 | 64017 |
| SIRT3 | 17828 | 40923 | 64018 |
| SIRT4 | 17829 | 40924 | 64019 |
| SIRT5 | 17830 | 40925 | 64020 |
| SIRT5 | 17831 | 40926 | 64021 |
| SIRT6 | 17832 | 40927 | 64022 |
| SIRT6 | 17833 | 40928 | 64023 |
| SIRT7 | 17834 | 40929 | 64024 |
| SIT1 | 17835 | 40930 | 64025 |
| SIVA1 | 17836 | 40931 | 64026 |
| SIX1 | 17837 | 40932 | 64027 |
| SIX2 | 17838 | 40933 | 64028 |
| SIX3 | 17839 | 40934 | 64029 |
| SIX4 | 17840 | 40935 | 64030 |
| SIX5 | 17841 | 40936 | 64031 |
| SIX6 | 17842 | 40937 | 64032 |
| SKA1 | 17843 | 40938 | 64033 |
| SKA2 | 17844 | 40939 | 64034 |
| SKA2 | 17845 | 40940 | 64035 |
| SKA2 | 17846 | 40941 | 64036 |
| SKA3 | 17847 | 40942 | 64037 |
| SKA3 | 17848 | 40943 | 64038 |
| SKAP1 | 17849 | 40944 | 64039 |
| SKAP2 | 17850 | 40945 | 64040 |
| SKI | 17851 | 40946 | 64041 |
| SKIDA1 | 17852 | 40947 | 64042 |
| SKIL | 17853 | 40948 | 64043 |
| SKIV2L | 17854 | 40949 | 64044 |
| SKIV2L2 | 17855 | 40950 | 64045 |
| SKOR1 | 17856 | 40951 | 64046 |
| SKOR2 | 17857 | 40952 | 64047 |
| SKOR2 | 17858 | 40953 | 64048 |
| SKP1 | 17859 | 40954 | 64049 |
| SKP1 | 17860 | 40955 | 64050 |
| SKP2 | 17861 | 40956 | 64051 |
| SKP2 | 17862 | 40957 | 64052 |
| SLA | 17863 | 40958 | 64053 |
| SLA | 17864 | 40959 | 64054 |
| SLA2 | 17865 | 40960 | 64055 |
| SLA2 | 17866 | 40961 | 64056 |
| SLAIN1 | 17867 | 40962 | 64057 |
| SLAIN2 | 17868 | 40963 | 64058 |
| SLAMF1 | 17869 | 40964 | 64059 |
| SLAMF1 | 17870 | 40965 | 64060 |
| SLAMF6 | 17871 | 40966 | 64061 |
| SLAMF7 | 17872 | 40967 | 64062 |
| SLAMF8 | 17873 | 40968 | 64063 |
| SLAMF9 | 17874 | 40969 | 64064 |
| SLAMF9 | 17875 | 40970 | 64065 |
| SLBP | 17876 | 40971 | 64066 |
| SLBP | 17877 | 40972 | 64067 |
| SLC10A1 | 17878 | 40973 | 64068 |
| SLC10A2 | 17879 | 40974 | 64069 |
| SLC10A3 | 17880 | 40975 | 64070 |
| SLC10A4 | 17881 | 40976 | 64071 |
| SLC10A5 | 17882 | 40977 | 64072 |
| SLC10A6 | 17883 | 40978 | 64073 |
| SLC10A7 | 17884 | 40979 | 64074 |
| SLC10A7 | 17885 | 40980 | 64075 |
| SLC10A7 | 17886 | 40981 | 64076 |
| SLC10A7 | 17887 | 40982 | 64077 |
| SLC10A7 | 17888 | 40983 | 64078 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| SLC11A1 | 17889 | 40984 | 64079 |
| SLC11A2 | 17890 | 40985 | 64080 |
| SLC11A2 | 17891 | 40986 | 64081 |
| SLC12A1 | 17892 | 40987 | 64082 |
| SLC12A2 | 17893 | 40988 | 64083 |
| SLC12A3 | 17894 | 40989 | 64084 |
| SLC12A4 | 17895 | 40990 | 64085 |
| SLC12A5 | 17896 | 40991 | 64086 |
| SLC12A6 | 17897 | 40992 | 64087 |
| SLC12A7 | 17898 | 40993 | 64088 |
| SLC12A8 | 17899 | 40994 | 64089 |
| SLC12A9 | 17900 | 40995 | 64090 |
| SLC12A9 | 17901 | 40996 | 64091 |
| SLC12A9 | 17902 | 40997 | 64092 |
| SLC13A1 | 17903 | 40998 | 64093 |
| SLC13A2 | 17904 | 40999 | 64094 |
| SLC13A3 | 17905 | 41000 | 64095 |
| SLC13A4 | 17906 | 41001 | 64096 |
| SLC13A5 | 17907 | 41002 | 64097 |
| SLC14A1 | 17908 | 41003 | 64098 |
| SLC14A2 | 17909 | 41004 | 64099 |
| SLC15A1 | 17910 | 41005 | 64100 |
| SLC15A2 | 17911 | 41006 | 64101 |
| SLC15A3 | 17912 | 41007 | 64102 |
| SLC15A4 | 17913 | 41008 | 64103 |
| SLC15A5 | 17914 | 41009 | 64104 |
| SLC16A1 | 17915 | 41010 | 64105 |
| SLC16A10 | 17916 | 41011 | 64106 |
| SLC16A11 | 17917 | 41012 | 64107 |
| SLC16A12 | 17918 | 41013 | 64108 |
| SLC16A13 | 17919 | 41014 | 64109 |
| SLC16A14 | 17920 | 41015 | 64110 |
| SLC16A2 | 17921 | 41016 | 64111 |
| SLC16A3 | 17922 | 41017 | 64112 |
| SLC16A4 | 17923 | 41018 | 64113 |
| SLC16A5 | 17924 | 41019 | 64114 |
| SLC16A6 | 17925 | 41020 | 64115 |
| SLC16A7 | 17926 | 41021 | 64116 |
| SLC16A8 | 17927 | 41022 | 64117 |
| SLC16A9 | 17928 | 41023 | 64118 |
| SLC17A1 | 17929 | 41024 | 64119 |
| SLC17A2 | 17930 | 41025 | 64120 |
| SLC17A2 | 17931 | 41026 | 64121 |
| SLC17A3 | 17932 | 41027 | 64122 |
| SLC17A4 | 17933 | 41028 | 64123 |
| SLC17A5 | 17934 | 41029 | 64124 |
| SLC17A6 | 17935 | 41030 | 64125 |
| SLC17A7 | 17936 | 41031 | 64126 |
| SLC17A8 | 17937 | 41032 | 64127 |
| SLC17A9 | 17938 | 41033 | 64128 |
| SLC18A1 | 17939 | 41034 | 64129 |
| SLC18A1 | 17940 | 41035 | 64130 |
| SLC18A2 | 17941 | 41036 | 64131 |
| SLC18A3 | 17942 | 41037 | 64132 |
| SLC18B1 | 17943 | 41038 | 64133 |
| SLC19A1 | 17944 | 41039 | 64134 |
| SLC19A1 | 17945 | 41040 | 64135 |
| SLC19A2 | 17946 | 41041 | 64136 |
| SLC19A3 | 17947 | 41042 | 64137 |
| SLC1A1 | 17948 | 41043 | 64138 |
| SLC1A2 | 17949 | 41044 | 64139 |
| SLC1A3 | 17950 | 41045 | 64140 |
| SLC1A3 | 17951 | 41046 | 64141 |
| SLC1A4 | 17952 | 41047 | 64142 |
| SLC1A5 | 17953 | 41048 | 64143 |
| SLC1A6 | 17954 | 41049 | 64144 |
| SLC1A6 | 17955 | 41050 | 64145 |
| SLC1A7 | 17956 | 41051 | 64146 |
| SLC1A7 | 17957 | 41052 | 64147 |
| SLC1A7 | 17958 | 41053 | 64148 |
| SLC20A1 | 17959 | 41054 | 64149 |
| SLC20A2 | 17960 | 41055 | 64150 |
| SLC22A1 | 17961 | 41056 | 64151 |
| SLC22A1 | 17962 | 41057 | 64152 |
| SLC22A10 | 17963 | 41058 | 64153 |
| SLC22A11 | 17964 | 41059 | 64154 |
| SLC22A12 | 17965 | 41060 | 64155 |
| SLC22A13 | 17966 | 41061 | 64156 |
| SLC22A14 | 17967 | 41062 | 64157 |
| SLC22A15 | 17968 | 41063 | 64158 |
| SLC22A16 | 17969 | 41064 | 64159 |
| SLC22A17 | 17970 | 41065 | 64160 |
| SLC22A18 | 17971 | 41066 | 64161 |
| SLC22A18AS | 17972 | 41067 | 64162 |
| SLC22A2 | 17973 | 41068 | 64163 |
| SLC22A20 | 17974 | 41069 | 64164 |
| SLC22A23 | 17975 | 41070 | 64165 |
| SLC22A23 | 17976 | 41071 | 64166 |
| SLC22A24 | 17977 | 41072 | 64167 |
| SLC22A24 | 17978 | 41073 | 64168 |
| SLC22A25 | 17979 | 41074 | 64169 |
| SLC22A3 | 17980 | 41075 | 64170 |
| SLC22A31 | 17981 | 41076 | 64171 |
| SLC22A4 | 17982 | 41077 | 64172 |
| SLC22A5 | 17983 | 41078 | 64173 |
| SLC22A6 | 17984 | 41079 | 64174 |
| SLC22A7 | 17985 | 41080 | 64175 |
| SLC22A8 | 17986 | 41081 | 64176 |
| SLC22A9 | 17987 | 41082 | 64177 |
| SLC23A1 | 17988 | 41083 | 64178 |
| SLC23A2 | 17989 | 41084 | 64179 |
| SLC23A3 | 17990 | 41085 | 64180 |
| SLC24A1 | 17991 | 41086 | 64181 |
| SLC24A1 | 17992 | 41087 | 64182 |
| SLC24A2 | 17993 | 41088 | 64183 |
| SLC24A3 | 17994 | 41089 | 64184 |
| SLC24A4 | 17995 | 41090 | 64185 |
| SLC24A5 | 17996 | 41091 | 64186 |
| SLC25A1 | 17997 | 41092 | 64187 |
| SLC25A10 | 17998 | 41093 | 64188 |
| SLC25A10 | 17999 | 41094 | 64189 |
| SLC25A11 | 18000 | 41095 | 64190 |
| SLC25A12 | 18001 | 41096 | 64191 |
| SLC25A13 | 18002 | 41097 | 64192 |
| SLC25A14 | 18003 | 41098 | 64193 |
| SLC25A15 | 18004 | 41099 | 64194 |
| SLC25A16 | 18005 | 41100 | 64195 |
| SLC25A16 | 18006 | 41101 | 64196 |
| SLC25A16 | 18007 | 41102 | 64197 |
| SLC25A17 | 18008 | 41103 | 64198 |
| SLC25A18 | 18009 | 41104 | 64199 |
| SLC25A19 | 18010 | 41105 | 64200 |
| SLC25A2 | 18011 | 41106 | 64201 |
| SLC25A20 | 18012 | 41107 | 64202 |
| SLC25A21 | 18013 | 41108 | 64203 |
| SLC25A21 | 18014 | 41109 | 64204 |
| SLC25A22 | 18015 | 41110 | 64205 |
| SLC25A23 | 18016 | 41111 | 64206 |
| SLC25A24 | 18017 | 41112 | 64207 |
| SLC25A25 | 18018 | 41113 | 64208 |
| SLC25A26 | 18019 | 41114 | 64209 |
| SLC25A27 | 18020 | 41115 | 64210 |
| SLC25A27 | 18021 | 41116 | 64211 |
| SLC25A27 | 18022 | 41117 | 64212 |
| SLC25A28 | 18023 | 41118 | 64213 |
| SLC25A29 | 18024 | 41119 | 64214 |
| SLC25A29 | 18025 | 41120 | 64215 |
| SLC25A3 | 18026 | 41121 | 64216 |
| SLC25A30 | 18027 | 41122 | 64217 |
| SLC25A31 | 18028 | 41123 | 64218 |
| SLC25A31 | 18029 | 41124 | 64219 |
| SLC25A32 | 18030 | 41125 | 64220 |
| SLC25A33 | 18031 | 41126 | 64221 |
| SLC25A34 | 18032 | 41127 | 64222 |
| SLC25A35 | 18033 | 41128 | 64223 |
| SLC25A35 | 18034 | 41129 | 64224 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| SLC25A36 | 18035 | 41130 | 64225 |
| SLC25A37 | 18036 | 41131 | 64226 |
| SLC25A38 | 18037 | 41132 | 64227 |
| SLC25A39 | 18038 | 41133 | 64228 |
| SLC25A4 | 18039 | 41134 | 64229 |
| SLC25A40 | 18040 | 41135 | 64230 |
| SLC25A41 | 18041 | 41136 | 64231 |
| SLC25A41 | 18042 | 41137 | 64232 |
| SLC25A42 | 18043 | 41138 | 64233 |
| SLC25A43 | 18044 | 41139 | 64234 |
| SLC25A44 | 18045 | 41140 | 64235 |
| SLC25A45 | 18046 | 41141 | 64236 |
| SLC25A46 | 18047 | 41142 | 64237 |
| SLC25A47 | 18048 | 41143 | 64238 |
| SLC25A48 | 18049 | 41144 | 64239 |
| SLC25A48 | 18050 | 41145 | 64240 |
| SLC25A48 | 18051 | 41146 | 64241 |
| SLC25A5 | 18052 | 41147 | 64242 |
| SLC25A51 | 18053 | 41148 | 64243 |
| SLC25A53 | 18054 | 41149 | 64244 |
| SLC25A6 | 18055 | 41150 | 64245 |
| SLC26A1 | 18056 | 41151 | 64246 |
| SLC26A1 | 18057 | 41152 | 64247 |
| SLC26A10 | 18058 | 41153 | 64248 |
| SLC26A11 | 18059 | 41154 | 64249 |
| SLC26A2 | 18060 | 41155 | 64250 |
| SLC26A3 | 18061 | 41156 | 64251 |
| SLC26A4 | 18062 | 41157 | 64252 |
| SLC26A5 | 18063 | 41158 | 64253 |
| SLC26A5 | 18064 | 41159 | 64254 |
| SLC26A5 | 18065 | 41160 | 64255 |
| SLC26A6 | 18066 | 41161 | 64256 |
| SLC26A7 | 18067 | 41162 | 64257 |
| SLC26A7 | 18068 | 41163 | 64258 |
| SLC26A8 | 18069 | 41164 | 64259 |
| SLC26A9 | 18070 | 41165 | 64260 |
| SLC26A9 | 18071 | 41166 | 64261 |
| SLC27A1 | 18072 | 41167 | 64262 |
| SLC27A2 | 18073 | 41168 | 64263 |
| SLC27A3 | 18074 | 41169 | 64264 |
| SLC27A4 | 18075 | 41170 | 64265 |
| SLC27A5 | 18076 | 41171 | 64266 |
| SLC27A6 | 18077 | 41172 | 64267 |
| SLC28A1 | 18078 | 41173 | 64268 |
| SLC28A1 | 18079 | 41174 | 64269 |
| SLC28A1 | 18080 | 41175 | 64270 |
| SLC28A1 | 18081 | 41176 | 64271 |
| SLC28A2 | 18082 | 41177 | 64272 |
| SLC28A3 | 18083 | 41178 | 64273 |
| SLC29A1 | 18084 | 41179 | 64274 |
| SLC29A2 | 18085 | 41180 | 64275 |
| SLC29A2 | 18086 | 41181 | 64276 |
| SLC29A3 | 18087 | 41182 | 64277 |
| SLC29A3 | 18088 | 41183 | 64278 |
| SLC29A4 | 18089 | 41184 | 64279 |
| SLC2A1 | 18090 | 41185 | 64280 |
| SLC2A10 | 18091 | 41186 | 64281 |
| SLC2A11 | 18092 | 41187 | 64282 |
| SLC2A11 | 18093 | 41188 | 64283 |
| SLC2A12 | 18094 | 41189 | 64284 |
| SLC2A13 | 18095 | 41190 | 64285 |
| SLC2A14 | 18096 | 41191 | 64286 |
| SLC2A2 | 18097 | 41192 | 64287 |
| SLC2A3 | 18098 | 41193 | 64288 |
| SLC2A4 | 18099 | 41194 | 64289 |
| SLC2A4RG | 18100 | 41195 | 64290 |
| SLC2A5 | 18101 | 41196 | 64291 |
| SLC2A5 | 18102 | 41197 | 64292 |
| SLC2A6 | 18103 | 41198 | 64293 |
| SLC2A7 | 18104 | 41199 | 64294 |
| SLC2A8 | 18105 | 41200 | 64295 |
| SLC2A8 | 18106 | 41201 | 64296 |
| SLC2A9 | 18107 | 41202 | 64297 |
| SLC30A1 | 18108 | 41203 | 64298 |
| SLC30A10 | 18109 | 41204 | 64299 |
| SLC30A2 | 18110 | 41205 | 64300 |
| SLC30A3 | 18111 | 41206 | 64301 |
| SLC30A4 | 18112 | 41207 | 64302 |
| SLC30A4 | 18113 | 41208 | 64303 |
| SLC30A5 | 18114 | 41209 | 64304 |
| SLC30A5 | 18115 | 41210 | 64305 |
| SLC30A5 | 18116 | 41211 | 64306 |
| SLC30A6 | 18117 | 41212 | 64307 |
| SLC30A7 | 18118 | 41213 | 64308 |
| SLC30A8 | 18119 | 41214 | 64309 |
| SLC30A9 | 18120 | 41215 | 64310 |
| SLC31A1 | 18121 | 41216 | 64311 |
| SLC31A2 | 18122 | 41217 | 64312 |
| SLC32A1 | 18123 | 41218 | 64313 |
| SLC33A1 | 18124 | 41219 | 64314 |
| SLC34A1 | 18125 | 41220 | 64315 |
| SLC34A1 | 18126 | 41221 | 64316 |
| SLC34A2 | 18127 | 41222 | 64317 |
| SLC34A3 | 18128 | 41223 | 64318 |
| SLC35A1 | 18129 | 41224 | 64319 |
| SLC35A2 | 18130 | 41225 | 64320 |
| SLC35A2 | 18131 | 41226 | 64321 |
| SLC35A2 | 18132 | 41227 | 64322 |
| SLC35A2 | 18133 | 41228 | 64323 |
| SLC35A3 | 18134 | 41229 | 64324 |
| SLC35A3 | 18135 | 41230 | 64325 |
| SLC35A4 | 18136 | 41231 | 64326 |
| SLC35A5 | 18137 | 41232 | 64327 |
| SLC35A5 | 18138 | 41233 | 64328 |
| SLC35B1 | 18139 | 41234 | 64329 |
| SLC35B2 | 18140 | 41235 | 64330 |
| SLC35B3 | 18141 | 41236 | 64331 |
| SLC35B4 | 18142 | 41237 | 64332 |
| SLC35C1 | 18143 | 41238 | 64333 |
| SLC35C2 | 18144 | 41239 | 64334 |
| SLC35D1 | 18145 | 41240 | 64335 |
| SLC35D2 | 18146 | 41241 | 64336 |
| SLC35D3 | 18147 | 41242 | 64337 |
| SLC35E1 | 18148 | 41243 | 64338 |
| SLC35E2 | 18149 | 41244 | 64339 |
| SLC35E2 | 18150 | 41245 | 64340 |
| SLC35E2B | 18151 | 41246 | 64341 |
| SLC35E3 | 18152 | 41247 | 64342 |
| SLC35E4 | 18153 | 41248 | 64343 |
| SLC35E4 | 18154 | 41249 | 64344 |
| SLC35E4 | 18155 | 41250 | 64345 |
| SLC35F1 | 18156 | 41251 | 64346 |
| SLC35F2 | 18157 | 41252 | 64347 |
| SLC35F3 | 18158 | 41253 | 64348 |
| SLC35F4 | 18159 | 41254 | 64349 |
| SLC35F4 | 18160 | 41255 | 64350 |
| SLC35F4 | 18161 | 41256 | 64351 |
| SLC35F5 | 18162 | 41257 | 64352 |
| SLC35F5 | 18163 | 41258 | 64353 |
| SLC35F5 | 18164 | 41259 | 64354 |
| SLC35F6 | 18165 | 41260 | 64355 |
| SLC35G1 | 18166 | 41261 | 64356 |
| SLC35G2 | 18167 | 41262 | 64357 |
| SLC35G3 | 18168 | 41263 | 64358 |
| SLC35G4 | 18169 | 41264 | 64359 |
| SLC35G6 | 18170 | 41265 | 64360 |
| SLC36A1 | 18171 | 41266 | 64361 |
| SLC36A1 | 18172 | 41267 | 64362 |
| SLC36A1 | 18173 | 41268 | 64363 |
| SLC36A2 | 18174 | 41269 | 64364 |
| SLC36A3 | 18175 | 41270 | 64365 |
| SLC36A4 | 18176 | 41271 | 64366 |
| SLC37A1 | 18177 | 41272 | 64367 |
| SLC37A2 | 18178 | 41273 | 64368 |
| SLC37A2 | 18179 | 41274 | 64369 |
| SLC37A3 | 18180 | 41275 | 64370 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| SLC37A3 | 18181 | 41276 | 64371 |
| SLC37A4 | 18182 | 41277 | 64372 |
| SLC38A1 | 18183 | 41278 | 64373 |
| SLC38A1 | 18184 | 41279 | 64374 |
| SLC38A10 | 18185 | 41280 | 64375 |
| SLC38A10 | 18186 | 41281 | 64376 |
| SLC38A11 | 18187 | 41282 | 64377 |
| SLC38A2 | 18188 | 41283 | 64378 |
| SLC38A3 | 18189 | 41284 | 64379 |
| SLC38A4 | 18190 | 41285 | 64380 |
| SLC38A5 | 18191 | 41286 | 64381 |
| SLC38A6 | 18192 | 41287 | 64382 |
| SLC38A6 | 18193 | 41288 | 64383 |
| SLC38A7 | 18194 | 41289 | 64384 |
| SLC38A7 | 18195 | 41290 | 64385 |
| SLC38A8 | 18196 | 41291 | 64386 |
| SLC38A9 | 18197 | 41292 | 64387 |
| SLC39A1 | 18198 | 41293 | 64388 |
| SLC39A10 | 18199 | 41294 | 64389 |
| SLC39A11 | 18200 | 41295 | 64390 |
| SLC39A12 | 18201 | 41296 | 64391 |
| SLC39A13 | 18202 | 41297 | 64392 |
| SLC39A13 | 18203 | 41298 | 64393 |
| SLC39A14 | 18204 | 41299 | 64394 |
| SLC39A14 | 18205 | 41300 | 64395 |
| SLC39A2 | 18206 | 41301 | 64396 |
| SLC39A3 | 18207 | 41302 | 64397 |
| SLC39A3 | 18208 | 41303 | 64398 |
| SLC39A4 | 18209 | 41304 | 64399 |
| SLC39A5 | 18210 | 41305 | 64400 |
| SLC39A6 | 18211 | 41306 | 64401 |
| SLC39A6 | 18212 | 41307 | 64402 |
| SLC39A7 | 18213 | 41308 | 64403 |
| SLC39A8 | 18214 | 41309 | 64404 |
| SLC39A8 | 18215 | 41310 | 64405 |
| SLC39A9 | 18216 | 41311 | 64406 |
| SLC39A9 | 18217 | 41312 | 64407 |
| SLC3A1 | 18218 | 41313 | 64408 |
| SLC3A2 | 18219 | 41314 | 64409 |
| SLC40A1 | 18220 | 41315 | 64410 |
| SLC41A1 | 18221 | 41316 | 64411 |
| SLC41A2 | 18222 | 41317 | 64412 |
| SLC41A3 | 18223 | 41318 | 64413 |
| SLC41A3 | 18224 | 41319 | 64414 |
| SLC43A1 | 18225 | 41320 | 64415 |
| SLC43A2 | 18226 | 41321 | 64416 |
| SLC43A3 | 18227 | 41322 | 64417 |
| SLC44A1 | 18228 | 41323 | 64418 |
| SLC44A1 | 18229 | 41324 | 64419 |
| SLC44A2 | 18230 | 41325 | 64420 |
| SLC44A3 | 18231 | 41326 | 64421 |
| SLC44A4 | 18232 | 41327 | 64422 |
| SLC44A5 | 18233 | 41328 | 64423 |
| SLC44A5 | 18234 | 41329 | 64424 |
| SLC45A1 | 18235 | 41330 | 64425 |
| SLC45A2 | 18236 | 41331 | 64426 |
| SLC45A2 | 18237 | 41332 | 64427 |
| SLC45A2 | 18238 | 41333 | 64428 |
| SLC45A3 | 18239 | 41334 | 64429 |
| SLC45A4 | 18240 | 41335 | 64430 |
| SLC45A4 | 18241 | 41336 | 64431 |
| SLC45A4 | 18242 | 41337 | 64432 |
| SLC46A1 | 18243 | 41338 | 64433 |
| SLC46A2 | 18244 | 41339 | 64434 |
| SLC46A3 | 18245 | 41340 | 64435 |
| SLC46A3 | 18246 | 41341 | 64436 |
| SLC47A1 | 18247 | 41342 | 64437 |
| SLC47A2 | 18248 | 41343 | 64438 |
| SLC48A1 | 18249 | 41344 | 64439 |
| SLC4A1 | 18250 | 41345 | 64440 |
| SLC4A10 | 18251 | 41346 | 64441 |
| SLC4A10 | 18252 | 41347 | 64442 |
| SLC4A11 | 18253 | 41348 | 64443 |
| SLC4A1AP | 18254 | 41349 | 64444 |
| SLC4A2 | 18255 | 41350 | 64445 |
| SLC4A3 | 18256 | 41351 | 64446 |
| SLC4A4 | 18257 | 41352 | 64447 |
| SLC4A4 | 18258 | 41353 | 64448 |
| SLC4A5 | 18259 | 41354 | 64449 |
| SLC4A7 | 18260 | 41355 | 64450 |
| SLC4A8 | 18261 | 41356 | 64451 |
| SLC4A8 | 18262 | 41357 | 64452 |
| SLC4A8 | 18263 | 41358 | 64453 |
| SLC4A9 | 18264 | 41359 | 64454 |
| SLC50A1 | 18265 | 41360 | 64455 |
| SLC50A1 | 18266 | 41361 | 64456 |
| SLC51A | 18267 | 41362 | 64457 |
| SLC51B | 18268 | 41363 | 64458 |
| SLC52A1 | 18269 | 41364 | 64459 |
| SLC52A2 | 18270 | 41365 | 64460 |
| SLC52A3 | 18271 | 41366 | 64461 |
| SLC5A1 | 18272 | 41367 | 64462 |
| SLC5A10 | 18273 | 41368 | 64463 |
| SLC5A11 | 18274 | 41369 | 64464 |
| SLC5A12 | 18275 | 41370 | 64465 |
| SLC5A2 | 18276 | 41371 | 64466 |
| SLC5A3 | 18277 | 41372 | 64467 |
| SLC5A4 | 18278 | 41373 | 64468 |
| SLC5A5 | 18279 | 41374 | 64469 |
| SLC5A6 | 18280 | 41375 | 64470 |
| SLC5A7 | 18281 | 41376 | 64471 |
| SLC5A8 | 18282 | 41377 | 64472 |
| SLC5A9 | 18283 | 41378 | 64473 |
| SLC6A1 | 18284 | 41379 | 64474 |
| SLC6A11 | 18285 | 41380 | 64475 |
| SLC6A11 | 18286 | 41381 | 64476 |
| SLC6A12 | 18287 | 41382 | 64477 |
| SLC6A13 | 18288 | 41383 | 64478 |
| SLC6A13 | 18289 | 41384 | 64479 |
| SLC6A14 | 18290 | 41385 | 64480 |
| SLC6A15 | 18291 | 41386 | 64481 |
| SLC6A15 | 18292 | 41387 | 64482 |
| SLC6A16 | 18293 | 41388 | 64483 |
| SLC6A17 | 18294 | 41389 | 64484 |
| SLC6A18 | 18295 | 41390 | 64485 |
| SLC6A19 | 18296 | 41391 | 64486 |
| SLC6A2 | 18297 | 41392 | 64487 |
| SLC6A2 | 18298 | 41393 | 64488 |
| SLC6A20 | 18299 | 41394 | 64489 |
| SLC6A3 | 18300 | 41395 | 64490 |
| SLC6A4 | 18301 | 41396 | 64491 |
| SLC6A5 | 18302 | 41397 | 64492 |
| SLC6A6 | 18303 | 41398 | 64493 |
| SLC6A6 | 18304 | 41399 | 64494 |
| SLC6A7 | 18305 | 41400 | 64495 |
| SLC6A8 | 18306 | 41401 | 64496 |
| SLC6A9 | 18307 | 41402 | 64497 |
| SLC7A1 | 18308 | 41403 | 64498 |
| SLC7A10 | 18309 | 41404 | 64499 |
| SLC7A11 | 18310 | 41405 | 64500 |
| SLC7A13 | 18311 | 41406 | 64501 |
| SLC7A14 | 18312 | 41407 | 64502 |
| SLC7A2 | 18313 | 41408 | 64503 |
| SLC7A3 | 18314 | 41409 | 64504 |
| SLC7A4 | 18315 | 41410 | 64505 |
| SLC7A5 | 18316 | 41411 | 64506 |
| SLC7A6 | 18317 | 41412 | 64507 |
| SLC7A6OS | 18318 | 41413 | 64508 |
| SLC7A7 | 18319 | 41414 | 64509 |
| SLC7A8 | 18320 | 41415 | 64510 |
| SLC7A9 | 18321 | 41416 | 64511 |
| SLC8A1 | 18322 | 41417 | 64512 |
| SLC8A2 | 18323 | 41418 | 64513 |
| SLC8A3 | 18324 | 41419 | 64514 |
| SLC8B1 | 18325 | 41420 | 64515 |
| SLC9A1 | 18326 | 41421 | 64516 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| SLC9A2 | 18327 | 41422 | 64517 |
| SLC9A3 | 18328 | 41423 | 64518 |
| SLC9A3R1 | 18329 | 41424 | 64519 |
| SLC9A3R2 | 18330 | 41425 | 64520 |
| SLC9A4 | 18331 | 41426 | 64521 |
| SLC9A5 | 18332 | 41427 | 64522 |
| SLC9A5 | 18333 | 41428 | 64523 |
| SLC9A6 | 18334 | 41429 | 64524 |
| SLC9A7 | 18335 | 41430 | 64525 |
| SLC9A8 | 18336 | 41431 | 64526 |
| SLC9A9 | 18337 | 41432 | 64527 |
| SLC9B1 | 18338 | 41433 | 64528 |
| SLC9B1 | 18339 | 41434 | 64529 |
| SLC9B2 | 18340 | 41435 | 64530 |
| SLC9B2 | 18341 | 41436 | 64531 |
| SLC9C1 | 18342 | 41437 | 64532 |
| SLC9C2 | 18343 | 41438 | 64533 |
| SLCO1A2 | 18344 | 41439 | 64534 |
| SLCO1B1 | 18345 | 41440 | 64535 |
| SLCO1B3 | 18346 | 41441 | 64536 |
| SLCO1B7 | 18347 | 41442 | 64537 |
| SLCO1C1 | 18348 | 41443 | 64538 |
| SLCO1C1 | 18349 | 41444 | 64539 |
| SLCO2A1 | 18350 | 41445 | 64540 |
| SLCO2B1 | 18351 | 41446 | 64541 |
| SLCO3A1 | 18352 | 41447 | 64542 |
| SLCO3A1 | 18353 | 41448 | 64543 |
| SLCO4A1 | 18354 | 41449 | 64544 |
| SLCO4C1 | 18355 | 41450 | 64545 |
| SLCO5A1 | 18356 | 41451 | 64546 |
| SLCO5A1 | 18357 | 41452 | 64547 |
| SLCO6A1 | 18358 | 41453 | 64548 |
| SLF1 | 18359 | 41454 | 64549 |
| SLF2 | 18360 | 41455 | 64550 |
| SLF2 | 18361 | 41456 | 64551 |
| SLF2 | 18362 | 41457 | 64552 |
| SLFN11 | 18363 | 41458 | 64553 |
| SLFN12 | 18364 | 41459 | 64554 |
| SLFN12L | 18365 | 41460 | 64555 |
| SLFN13 | 18366 | 41461 | 64556 |
| SLFN14 | 18367 | 41462 | 64557 |
| SLFN5 | 18368 | 41463 | 64558 |
| SLFN5 | 18369 | 41464 | 64559 |
| SLFNL1 | 18370 | 41465 | 64560 |
| SLIRP | 18371 | 41466 | 64561 |
| SLIRP | 18372 | 41467 | 64562 |
| SLIT1 | 18373 | 41468 | 64563 |
| SLIT2 | 18374 | 41469 | 64564 |
| SLIT3 | 18375 | 41470 | 64565 |
| SLITRK1 | 18376 | 41471 | 64566 |
| SLITRK2 | 18377 | 41472 | 64567 |
| SLITRK3 | 18378 | 41473 | 64568 |
| SLITRK4 | 18379 | 41474 | 64569 |
| SLITRK5 | 18380 | 41475 | 64570 |
| SLITRK6 | 18381 | 41476 | 64571 |
| SLK | 18382 | 41477 | 64572 |
| SLMAP | 18383 | 41478 | 64573 |
| SLMAP | 18384 | 41479 | 64574 |
| SLMAP | 18385 | 41480 | 64575 |
| SLN | 18386 | 41481 | 64576 |
| SLPI | 18387 | 41482 | 64577 |
| SLTM | 18388 | 41483 | 64578 |
| SLU7 | 18389 | 41484 | 64579 |
| SLURP1 | 18390 | 41485 | 64580 |
| SLX1B | 18391 | 41486 | 64581 |
| SLX4 | 18392 | 41487 | 64582 |
| SLX4IP | 18393 | 41488 | 64583 |
| SMAD1 | 18394 | 41489 | 64584 |
| SMAD2 | 18395 | 41490 | 64585 |
| SMAD3 | 18396 | 41491 | 64586 |
| SMAD4 | 18397 | 41492 | 64587 |
| SMAD5 | 18398 | 41493 | 64588 |
| SMAD6 | 18399 | 41494 | 64589 |
| SMAD7 | 18400 | 41495 | 64590 |
| SMAD7 | 18401 | 41496 | 64591 |
| SMAD9 | 18402 | 41497 | 64592 |
| SMAGP | 18403 | 41498 | 64593 |
| SMAP1 | 18404 | 41499 | 64594 |
| SMAP1 | 18405 | 41500 | 64595 |
| SMAP2 | 18406 | 41501 | 64596 |
| SMARCA1 | 18407 | 41502 | 64597 |
| SMARCA1 | 18408 | 41503 | 64598 |
| SMARCA2 | 18409 | 41504 | 64599 |
| SMARCA4 | 18410 | 41505 | 64600 |
| SMARCA5 | 18411 | 41506 | 64601 |
| SMARCAD1 | 18412 | 41507 | 64602 |
| SMARCAL1 | 18413 | 41508 | 64603 |
| SMARCB1 | 18414 | 41509 | 64604 |
| SMARCC1 | 18415 | 41510 | 64605 |
| SMARCC2 | 18416 | 41511 | 64606 |
| SMARCD1 | 18417 | 41512 | 64607 |
| SMARCD2 | 18418 | 41513 | 64608 |
| SMARCD3 | 18419 | 41514 | 64609 |
| SMARCE1 | 18420 | 41515 | 64610 |
| SMC1A | 18421 | 41516 | 64611 |
| SMC1B | 18422 | 41517 | 64612 |
| SMC2 | 18423 | 41518 | 64613 |
| SMC3 | 18424 | 41519 | 64614 |
| SMC4 | 18425 | 41520 | 64615 |
| SMC5 | 18426 | 41521 | 64616 |
| SMC6 | 18427 | 41522 | 64617 |
| SMCHD1 | 18428 | 41523 | 64618 |
| SMCO1 | 18429 | 41524 | 64619 |
| SMCO2 | 18430 | 41525 | 64620 |
| SMCO3 | 18431 | 41526 | 64621 |
| SMCO4 | 18432 | 41527 | 64622 |
| SMCP | 18433 | 41528 | 64623 |
| SMCR8 | 18434 | 41529 | 64624 |
| SMDT1 | 18435 | 41530 | 64625 |
| SMG1 | 18436 | 41531 | 64626 |
| SMG1P1 | 18437 | 41532 | 64627 |
| SMG1P2 | 18438 | 41533 | 64628 |
| SMG1P6 | 18439 | 41534 | 64629 |
| SMG1P7 | 18440 | 41535 | 64630 |
| SMG5 | 18441 | 41536 | 64631 |
| SMG6 | 18442 | 41537 | 64632 |
| SMG7 | 18443 | 41538 | 64633 |
| SMG7 | 18444 | 41539 | 64634 |
| SMG8 | 18445 | 41540 | 64635 |
| SMG9 | 18446 | 41541 | 64636 |
| SMIM1 | 18447 | 41542 | 64637 |
| SMIM10 | 18448 | 41543 | 64638 |
| SMIM10L1 | 18449 | 41544 | 64639 |
| SMIM10L2A | 18450 | 41545 | 64640 |
| SMIM10L2B | 18451 | 41546 | 64641 |
| SMIM11B | 18452 | 41547 | 64642 |
| SMIM12 | 18453 | 41548 | 64643 |
| SMIM13 | 18454 | 41549 | 64644 |
| SMIM14 | 18455 | 41550 | 64645 |
| SMIM15 | 18456 | 41551 | 64646 |
| SMIM17 | 18457 | 41552 | 64647 |
| SMIM18 | 18458 | 41553 | 64648 |
| SMIM19 | 18459 | 41554 | 64649 |
| SMIM2 | 18460 | 41555 | 64650 |
| SMIM20 | 18461 | 41556 | 64651 |
| SMIM21 | 18462 | 41557 | 64652 |
| SMIM21 | 18463 | 41558 | 64653 |
| SMIM22 | 18464 | 41559 | 64654 |
| SMIM23 | 18465 | 41560 | 64655 |
| SMIM24 | 18466 | 41561 | 64656 |
| SMIM25 | 18467 | 41562 | 64657 |
| SMIM26 | 18468 | 41563 | 64658 |
| SMIM26 | 18469 | 41564 | 64659 |
| SMIM27 | 18470 | 41565 | 64660 |
| SMIM27 | 18471 | 41566 | 64661 |
| SMIM29 | 18472 | 41567 | 64662 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| SMIM3 | 18473 | 41568 | 64663 |
| SMIM30 | 18474 | 41569 | 64664 |
| SMIM30 | 18475 | 41570 | 64665 |
| SMIM31 | 18476 | 41571 | 64666 |
| SMIM32 | 18477 | 41572 | 64667 |
| SMIM35 | 18478 | 41573 | 64668 |
| SMIM4 | 18479 | 41574 | 64669 |
| SMIM5 | 18480 | 41575 | 64670 |
| SMIM6 | 18481 | 41576 | 64671 |
| SMIM7 | 18482 | 41577 | 64672 |
| SMIM7 | 18483 | 41578 | 64673 |
| SMIM8 | 18484 | 41579 | 64674 |
| SMIM8 | 18485 | 41580 | 64675 |
| SMIM9 | 18486 | 41581 | 64676 |
| SMKR1 | 18487 | 41582 | 64677 |
| SMLR1 | 18488 | 41583 | 64678 |
| SMN2 | 18489 | 41584 | 64679 |
| SMNDC1 | 18490 | 41585 | 64680 |
| SMO | 18491 | 41586 | 64681 |
| SMOC1 | 18492 | 41587 | 64682 |
| SMOC2 | 18493 | 41588 | 64683 |
| SMOX | 18494 | 41589 | 64684 |
| SMPD1 | 18495 | 41590 | 64685 |
| SMPD1 | 18496 | 41591 | 64686 |
| SMPD1 | 18497 | 41592 | 64687 |
| SMPD2 | 18498 | 41593 | 64688 |
| SMPD3 | 18499 | 41594 | 64689 |
| SMPD4 | 18500 | 41595 | 64690 |
| SMPDL3A | 18501 | 41596 | 64691 |
| SMPDL3B | 18502 | 41597 | 64692 |
| SMPDL3B | 18503 | 41598 | 64693 |
| SMPX | 18504 | 41599 | 64694 |
| SMR3A | 18505 | 41600 | 64695 |
| SMR3B | 18506 | 41601 | 64696 |
| SMS | 18507 | 41602 | 64697 |
| SMTN | 18508 | 41603 | 64698 |
| SMTN | 18509 | 41604 | 64699 |
| SMTNL1 | 18510 | 41605 | 64700 |
| SMTNL2 | 18511 | 41606 | 64701 |
| SMU1 | 18512 | 41607 | 64702 |
| SMUG1 | 18513 | 41608 | 64703 |
| SMUG1 | 18514 | 41609 | 64704 |
| SMURF1 | 18515 | 41610 | 64705 |
| SMURF2 | 18516 | 41611 | 64706 |
| SMYD1 | 18517 | 41612 | 64707 |
| SMYD2 | 18518 | 41613 | 64708 |
| SMYD3 | 18519 | 41614 | 64709 |
| SMYD4 | 18520 | 41615 | 64710 |
| SMYD5 | 18521 | 41616 | 64711 |
| SNAI1 | 18522 | 41617 | 64712 |
| SNAI2 | 18523 | 41618 | 64713 |
| SNAI3 | 18524 | 41619 | 64714 |
| SNAP23 | 18525 | 41620 | 64715 |
| SNAP25 | 18526 | 41621 | 64716 |
| SNAP29 | 18527 | 41622 | 64717 |
| SNAP47 | 18528 | 41623 | 64718 |
| SNAP47 | 18529 | 41624 | 64719 |
| SNAP91 | 18530 | 41625 | 64720 |
| SNAPC1 | 18531 | 41626 | 64721 |
| SNAPC2 | 18532 | 41627 | 64722 |
| SNAPC3 | 18533 | 41628 | 64723 |
| SNAPC4 | 18534 | 41629 | 64724 |
| SNAPC5 | 18535 | 41630 | 64725 |
| SNAPC5 | 18536 | 41631 | 64726 |
| SNAPIN | 18537 | 41632 | 64727 |
| SNCA | 18538 | 41633 | 64728 |
| SNCA | 18539 | 41634 | 64729 |
| SNCAIP | 18540 | 41635 | 64730 |
| SNCAIP | 18541 | 41636 | 64731 |
| SNCB | 18542 | 41637 | 64732 |
| SNCB | 18543 | 41638 | 64733 |
| SNCG | 18544 | 41639 | 64734 |
| SNCG | 18545 | 41640 | 64735 |
| SND1 | 18546 | 41641 | 64736 |
| SNED1 | 18547 | 41642 | 64737 |
| SNF8 | 18548 | 41643 | 64738 |
| SNIP1 | 18549 | 41644 | 64739 |
| SNN | 18550 | 41645 | 64740 |
| SNPH | 18551 | 41646 | 64741 |
| SNRK | 18552 | 41647 | 64742 |
| SNRNP200 | 18553 | 41648 | 64743 |
| SNRNP25 | 18554 | 41649 | 64744 |
| SNRNP27 | 18555 | 41650 | 64745 |
| SNRNP35 | 18556 | 41651 | 64746 |
| SNRNP40 | 18557 | 41652 | 64747 |
| SNRNP48 | 18558 | 41653 | 64748 |
| SNRNP70 | 18559 | 41654 | 64749 |
| SNRPA | 18560 | 41655 | 64750 |
| SNRPA1 | 18561 | 41656 | 64751 |
| SNRPB | 18562 | 41657 | 64752 |
| SNRPB | 18563 | 41658 | 64753 |
| SNRPB2 | 18564 | 41659 | 64754 |
| SNRPC | 18565 | 41660 | 64755 |
| SNRPD1 | 18566 | 41661 | 64756 |
| SNRPD2 | 18567 | 41662 | 64757 |
| SNRPD3 | 18568 | 41663 | 64758 |
| SNRPE | 18569 | 41664 | 64759 |
| SNRPF | 18570 | 41665 | 64760 |
| SNRPG | 18571 | 41666 | 64761 |
| SNRPG | 18572 | 41667 | 64762 |
| SNRPN | 18573 | 41668 | 64763 |
| SNTA1 | 18574 | 41669 | 64764 |
| SNTB1 | 18575 | 41670 | 64765 |
| SNTB2 | 18576 | 41671 | 64766 |
| SNTG1 | 18577 | 41672 | 64767 |
| SNTG1 | 18578 | 41673 | 64768 |
| SNTG2 | 18579 | 41674 | 64769 |
| SNTN | 18580 | 41675 | 64770 |
| SNU13 | 18581 | 41676 | 64771 |
| SNUPN | 18582 | 41677 | 64772 |
| SNURF | 18583 | 41678 | 64773 |
| SNW1 | 18584 | 41679 | 64774 |
| SNW1 | 18585 | 41680 | 64775 |
| SNX1 | 18586 | 41681 | 64776 |
| SNX1 | 18587 | 41682 | 64777 |
| SNX10 | 18588 | 41683 | 64778 |
| SNX11 | 18589 | 41684 | 64779 |
| SNX12 | 18590 | 41685 | 64780 |
| SNX12 | 18591 | 41686 | 64781 |
| SNX13 | 18592 | 41687 | 64782 |
| SNX13 | 18593 | 41688 | 64783 |
| SNX13 | 18594 | 41689 | 64784 |
| SNX14 | 18595 | 41690 | 64785 |
| SNX15 | 18596 | 41691 | 64786 |
| SNX16 | 18597 | 41692 | 64787 |
| SNX17 | 18598 | 41693 | 64788 |
| SNX18 | 18599 | 41694 | 64789 |
| SNX18 | 18600 | 41695 | 64790 |
| SNX18 | 18601 | 41696 | 64791 |
| SNX19 | 18602 | 41697 | 64792 |
| SNX19 | 18603 | 41698 | 64793 |
| SNX19 | 18604 | 41699 | 64794 |
| SNX19 | 18605 | 41700 | 64795 |
| SNX2 | 18606 | 41701 | 64796 |
| SNX20 | 18607 | 41702 | 64797 |
| SNX20 | 18608 | 41703 | 64798 |
| SNX20 | 18609 | 41704 | 64799 |
| SNX21 | 18610 | 41705 | 64800 |
| SNX21 | 18611 | 41706 | 64801 |
| SNX22 | 18612 | 41707 | 64802 |
| SNX24 | 18613 | 41708 | 64803 |
| SNX25 | 18614 | 41709 | 64804 |
| SNX27 | 18615 | 41710 | 64805 |
| SNX27 | 18616 | 41711 | 64806 |
| SNX29 | 18617 | 41712 | 64807 |
| SNX3 | 18618 | 41713 | 64808 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| SNX3 | 18619 | 41714 | 64809 |
| SNX30 | 18620 | 41715 | 64810 |
| SNX31 | 18621 | 41716 | 64811 |
| SNX32 | 18622 | 41717 | 64812 |
| SNX33 | 18623 | 41718 | 64813 |
| SNX4 | 18624 | 41719 | 64814 |
| SNX5 | 18625 | 41720 | 64815 |
| SNX6 | 18626 | 41721 | 64816 |
| SNX7 | 18627 | 41722 | 64817 |
| SNX8 | 18628 | 41723 | 64818 |
| SNX9 | 18629 | 41724 | 64819 |
| SOAT1 | 18630 | 41725 | 64820 |
| SOAT2 | 18631 | 41726 | 64821 |
| SOBP | 18632 | 41727 | 64822 |
| SOCS1 | 18633 | 41728 | 64823 |
| SOCS2 | 18634 | 41729 | 64824 |
| SOCS3 | 18635 | 41730 | 64825 |
| SOCS4 | 18636 | 41731 | 64826 |
| SOCS5 | 18637 | 41732 | 64827 |
| SOCS6 | 18638 | 41733 | 64828 |
| SOCS7 | 18639 | 41734 | 64829 |
| SOD1 | 18640 | 41735 | 64830 |
| SOD2 | 18641 | 41736 | 64831 |
| SOD2 | 18642 | 41737 | 64832 |
| SOD3 | 18643 | 41738 | 64833 |
| SOGA1 | 18644 | 41739 | 64834 |
| SOGA1 | 18645 | 41740 | 64835 |
| SOGA3 | 18646 | 41741 | 64836 |
| SOHLH1 | 18647 | 41742 | 64837 |
| SOHLH1 | 18648 | 41743 | 64838 |
| SOHLH2 | 18649 | 41744 | 64839 |
| SOHLH2 | 18650 | 41745 | 64840 |
| SON | 18651 | 41746 | 64841 |
| SON | 18652 | 41747 | 64842 |
| SON | 18653 | 41748 | 64843 |
| SORBS1 | 18654 | 41749 | 64844 |
| SORBS2 | 18655 | 41750 | 64845 |
| SORBS3 | 18656 | 41751 | 64846 |
| SORCS1 | 18657 | 41752 | 64847 |
| SORCS1 | 18658 | 41753 | 64848 |
| SORCS1 | 18659 | 41754 | 64849 |
| SORCS1 | 18660 | 41755 | 64850 |
| SORCS2 | 18661 | 41756 | 64851 |
| SORCS3 | 18662 | 41757 | 64852 |
| SORD | 18663 | 41758 | 64853 |
| SORL1 | 18664 | 41759 | 64854 |
| SORT1 | 18665 | 41760 | 64855 |
| SOS1 | 18666 | 41761 | 64856 |
| SOS2 | 18667 | 41762 | 64857 |
| SOST | 18668 | 41763 | 64858 |
| SOSTDC1 | 18669 | 41764 | 64859 |
| SOWAHA | 18670 | 41765 | 64860 |
| SOWAHB | 18671 | 41766 | 64861 |
| SOWAHC | 18672 | 41767 | 64862 |
| SOWAHD | 18673 | 41768 | 64863 |
| SOX1 | 18674 | 41769 | 64864 |
| SOX10 | 18675 | 41770 | 64865 |
| SOX11 | 18676 | 41771 | 64866 |
| SOX12 | 18677 | 41772 | 64867 |
| SOX13 | 18678 | 41773 | 64868 |
| SOX14 | 18679 | 41774 | 64869 |
| SOX15 | 18680 | 41775 | 64870 |
| SOX17 | 18681 | 41776 | 64871 |
| SOX18 | 18682 | 41777 | 64872 |
| SOX2 | 18683 | 41778 | 64873 |
| SOX21 | 18684 | 41779 | 64874 |
| SOX3 | 18685 | 41780 | 64875 |
| SOX30 | 18686 | 41781 | 64876 |
| SOX30 | 18687 | 41782 | 64877 |
| SOX4 | 18688 | 41783 | 64878 |
| SOX5 | 18689 | 41784 | 64879 |
| SOX6 | 18690 | 41785 | 64880 |
| SOX7 | 18691 | 41786 | 64881 |
| SOX8 | 18692 | 41787 | 64882 |
| SOX9 | 18693 | 41788 | 64883 |
| SP1 | 18694 | 41789 | 64884 |
| SP100 | 18695 | 41790 | 64885 |
| SP100 | 18696 | 41791 | 64886 |
| SP100 | 18697 | 41792 | 64887 |
| SP100 | 18698 | 41793 | 64888 |
| SP110 | 18699 | 41794 | 64889 |
| SP110 | 18700 | 41795 | 64890 |
| SP140 | 18701 | 41796 | 64891 |
| SP140 | 18702 | 41797 | 64892 |
| SP140L | 18703 | 41798 | 64893 |
| SP2 | 18704 | 41799 | 64894 |
| SP3 | 18705 | 41800 | 64895 |
| SP4 | 18706 | 41801 | 64896 |
| SP5 | 18707 | 41802 | 64897 |
| SP6 | 18708 | 41803 | 64898 |
| SP7 | 18709 | 41804 | 64899 |
| SP8 | 18710 | 41805 | 64900 |
| SP9 | 18711 | 41806 | 64901 |
| SPA17 | 18712 | 41807 | 64902 |
| SPAAR | 18713 | 41808 | 64903 |
| SPACA1 | 18714 | 41809 | 64904 |
| SPACA3 | 18715 | 41810 | 64905 |
| SPACA3 | 18716 | 41811 | 64906 |
| SPACA4 | 18717 | 41812 | 64907 |
| SPACA5B | 18718 | 41813 | 64908 |
| SPACA6 | 18719 | 41814 | 64909 |
| SPACA7 | 18720 | 41815 | 64910 |
| SPACA9 | 18721 | 41816 | 64911 |
| SPACA9 | 18722 | 41817 | 64912 |
| SPAG1 | 18723 | 41818 | 64913 |
| SPAG11A | 18724 | 41819 | 64914 |
| SPAG11B | 18725 | 41820 | 64915 |
| SPAG11B | 18726 | 41821 | 64916 |
| SPAG11B | 18727 | 41822 | 64917 |
| SPAG16 | 18728 | 41823 | 64918 |
| SPAG16 | 18729 | 41824 | 64919 |
| SPAG17 | 18730 | 41825 | 64920 |
| SPAG4 | 18731 | 41826 | 64921 |
| SPAG5 | 18732 | 41827 | 64922 |
| SPAG6 | 18733 | 41828 | 64923 |
| SPAG6 | 18734 | 41829 | 64924 |
| SPAG7 | 18735 | 41830 | 64925 |
| SPAG8 | 18736 | 41831 | 64926 |
| SPAG8 | 18737 | 41832 | 64927 |
| SPAG9 | 18738 | 41833 | 64928 |
| SPAM1 | 18739 | 41834 | 64929 |
| SPAM1 | 18740 | 41835 | 64930 |
| SPANXB1 | 18741 | 41836 | 64931 |
| SPANXC | 18742 | 41837 | 64932 |
| SPANXN2 | 18743 | 41838 | 64933 |
| SPANXN3 | 18744 | 41839 | 64934 |
| SPANXN4 | 18745 | 41840 | 64935 |
| SPANXN5 | 18746 | 41841 | 64936 |
| SPARC | 18747 | 41842 | 64937 |
| SPARC | 18748 | 41843 | 64938 |
| SPARCL1 | 18749 | 41844 | 54939 |
| SPART | 18750 | 41845 | 54940 |
| SPAST | 18751 | 41845 | 54941 |
| SPATA1 | 18752 | 41847 | 54942 |
| SPATA12 | 18753 | 41848 | 54943 |
| SPATA13 | 18754 | 41849 | 54944 |
| SPATA16 | 18755 | 41850 | 54945 |
| SPATA17 | 18756 | 41851 | 64946 |
| SPATA18 | 18757 | 41852 | 64947 |
| SPATA19 | 18758 | 41853 | 64948 |
| SPATA2 | 18759 | 41854 | 64949 |
| SPATA20 | 18760 | 41855 | 64950 |
| SPATA21 | 18761 | 41856 | 64951 |
| SPATA22 | 18762 | 41857 | 64952 |
| SPATA22 | 18763 | 41858 | 64953 |
| SPATA24 | 18764 | 41859 | 64954 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| SPATA25 | 18765 | 41860 | 64955 |
| SPATA2L | 18766 | 41861 | 64956 |
| SPATA3 | 18767 | 41862 | 64957 |
| SPATA31A6 | 18768 | 41863 | 64958 |
| SPATA31C1 | 18769 | 41864 | 64959 |
| SPATA31C2 | 18770 | 41865 | 64960 |
| SPATA31D1 | 18771 | 41866 | 64961 |
| SPATA31D3 | 18772 | 41867 | 64962 |
| SPATA31E1 | 18773 | 41868 | 64963 |
| SPATA32 | 18774 | 41869 | 64964 |
| SPATA33 | 18775 | 41870 | 64965 |
| SPATA33 | 18776 | 41871 | 64966 |
| SPATA4 | 18777 | 41872 | 64967 |
| SPATA45 | 18778 | 41873 | 64968 |
| SPATA46 | 18779 | 41874 | 64969 |
| SPATA48 | 18780 | 41875 | 64970 |
| SPATA5 | 18781 | 41876 | 64971 |
| SPATA5 | 18782 | 41877 | 54972 |
| SPATA5L1 | 18783 | 41878 | 54973 |
| SPATA5L1 | 18784 | 41879 | 54974 |
| SPATA6 | 18785 | 41880 | 54975 |
| SPATA6L | 18786 | 41881 | 54976 |
| SPATA7 | 18787 | 41882 | 54977 |
| SPATA8 | 18788 | 41883 | 54978 |
| SPATA8 | 18789 | 41884 | 54979 |
| SPATA9 | 18790 | 41885 | 54980 |
| SPATC1 | 18791 | 41885 | 54981 |
| SPATC1 | 18792 | 41887 | 54982 |
| SPATC1L | 18793 | 41888 | 54983 |
| SPATS1 | 18794 | 41889 | 54984 |
| SPATS2 | 18795 | 41890 | 54985 |
| SPATS2L | 18796 | 41891 | 54986 |
| SPC24 | 18797 | 41892 | 54987 |
| SPC24 | 18798 | 41893 | 54988 |
| SPC24 | 18799 | 41894 | 54989 |
| SPC25 | 18800 | 41895 | 54990 |
| SPCS1 | 18801 | 41895 | 54991 |
| SPCS2 | 18802 | 41897 | 54992 |
| SPCS3 | 18803 | 41898 | 54993 |
| SPDEF | 18804 | 41899 | 54994 |
| SPDL1 | 18805 | 41900 | 54995 |
| SPDL1 | 18805 | 41901 | 54995 |
| SPDYA | 18807 | 41902 | 54997 |
| SPDYA | 18808 | 41903 | 54998 |
| SPDYC | 18809 | 41904 | 54999 |
| SPDYE1 | 18810 | 41905 | 55000 |
| SPDYE16 | 18811 | 41905 | 55001 |
| SPDYE17 | 18812 | 41907 | 55002 |
| SPDYE3 | 18813 | 41908 | 55003 |
| SPDYE4 | 18814 | 41909 | 55004 |
| SPECC1 | 18815 | 41910 | 55005 |
| SPECC1 | 18815 | 41911 | 55005 |
| SPECC1 | 18817 | 41912 | 55007 |
| SPECC1L | 18818 | 41913 | 55008 |
| SPEF1 | 18819 | 41914 | 55009 |
| SPEF2 | 18820 | 41915 | 55010 |
| SPEF2 | 18821 | 41915 | 55011 |
| SPEG | 18822 | 41917 | 55012 |
| SPEG | 18823 | 41918 | 55013 |
| SPEM1 | 18824 | 41919 | 55014 |
| SPEM2 | 18825 | 41920 | 55015 |
| SPEN | 18825 | 41921 | 55015 |
| SPERT | 18827 | 41922 | 55017 |
| SPESP1 | 18828 | 41923 | 55018 |
| SPG11 | 18829 | 41924 | 55019 |
| SPG21 | 18830 | 41925 | 55020 |
| SPG7 | 18831 | 41925 | 55021 |
| SPG7 | 18832 | 41927 | 55022 |
| SPHAR | 18833 | 41928 | 55023 |
| SPHK1 | 18834 | 41929 | 55024 |
| SPHK2 | 18835 | 41930 | 55025 |
| SPHKAP | 18836 | 41931 | 55025 |
| SPI1 | 18837 | 41932 | 55027 |
| SPIB | 18838 | 41933 | 65028 |
| SPIB | 18839 | 41934 | 65029 |
| SPIC | 18840 | 41935 | 65030 |
| SPICE1 | 18841 | 41936 | 65031 |
| SPIDR | 18842 | 41937 | 65032 |
| SPIDR | 18843 | 41938 | 65033 |
| SPIDR | 18844 | 41939 | 65034 |
| SPIDR | 18845 | 41940 | 65035 |
| SPIN1 | 18846 | 41941 | 65036 |
| SPIN2A | 18847 | 41942 | 65037 |
| SPIN3 | 18848 | 41943 | 65038 |
| SPIN4 | 18849 | 41944 | 65039 |
| SPINK1 | 18850 | 41945 | 65040 |
| SPINK13 | 18851 | 41946 | 65041 |
| SPINK14 | 18852 | 41947 | 65042 |
| SPINK2 | 18853 | 41948 | 65043 |
| SPINK2 | 18854 | 41949 | 65044 |
| SPINK2 | 18855 | 41950 | 65045 |
| SPINK4 | 18856 | 41951 | 65046 |
| SPINK5 | 18857 | 41952 | 65047 |
| SPINK5 | 18858 | 41953 | 65048 |
| SPINK6 | 18859 | 41954 | 65049 |
| SPINK7 | 18860 | 41955 | 65050 |
| SPINK8 | 18861 | 41956 | 65051 |
| SPINK9 | 18862 | 41957 | 65052 |
| SPINT1 | 18863 | 41958 | 65053 |
| SPINT2 | 18864 | 41959 | 65054 |
| SPINT3 | 18865 | 41960 | 65055 |
| SPINT4 | 18866 | 41961 | 65056 |
| SPIRE1 | 18867 | 41962 | 65057 |
| SPIRE2 | 18868 | 41963 | 65058 |
| SPN | 18869 | 41964 | 65059 |
| SPNS1 | 18870 | 41965 | 65060 |
| SPNS2 | 18871 | 41966 | 65061 |
| SPNS3 | 18872 | 41967 | 65062 |
| SPO11 | 18873 | 41968 | 65063 |
| SPOCD1 | 18874 | 41969 | 65064 |
| SPOCK1 | 18875 | 41970 | 65065 |
| SPOCK2 | 18876 | 41971 | 65066 |
| SPOCK2 | 18877 | 41972 | 65067 |
| SPOCK3 | 18878 | 41973 | 65068 |
| SPOCK3 | 18879 | 41974 | 65069 |
| SPON1 | 18880 | 41975 | 65070 |
| SPON2 | 18881 | 41976 | 65071 |
| SPOP | 18882 | 41977 | 65072 |
| SPOPL | 18883 | 41978 | 65073 |
| SPOUT1 | 18884 | 41979 | 65074 |
| SPP1 | 18885 | 41980 | 65075 |
| SPP2 | 18886 | 41981 | 65076 |
| SPPL2A | 18887 | 41982 | 65077 |
| SPPL2B | 18888 | 41983 | 65078 |
| SPPL2B | 18889 | 41984 | 65079 |
| SPPL2C | 18890 | 41985 | 65080 |
| SPPL3 | 18891 | 41986 | 65081 |
| SPR | 18892 | 41987 | 65082 |
| SPRED1 | 18893 | 41988 | 65083 |
| SPRED2 | 18894 | 41989 | 65084 |
| SPRED3 | 18895 | 41990 | 65085 |
| SPRN | 18896 | 41991 | 65086 |
| SPRR1B | 18897 | 41992 | 65087 |
| SPRR2B | 18898 | 41993 | 65088 |
| SPRR2E | 18899 | 41994 | 65089 |
| SPRR2G | 18900 | 41995 | 65090 |
| SPRR3 | 18901 | 41996 | 65091 |
| SPRR4 | 18902 | 41997 | 65092 |
| SPRTN | 18903 | 41998 | 65093 |
| SPRTN | 18904 | 41999 | 65094 |
| SPRY1 | 18905 | 42000 | 65095 |
| SPRY2 | 18906 | 42001 | 65096 |
| SPRY3 | 18907 | 42002 | 65097 |
| SPRY4 | 18908 | 42003 | 65098 |
| SPRYD3 | 18909 | 42004 | 65099 |
| SPRYD4 | 18910 | 42005 | 65100 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| SPRYD7 | 18911 | 42006 | 65101 |
| SPSB1 | 18912 | 42007 | 65102 |
| SPSB2 | 18913 | 42008 | 65103 |
| SPSB3 | 18914 | 42009 | 65104 |
| SPSB4 | 18915 | 42010 | 65105 |
| SPTA1 | 18916 | 42011 | 65106 |
| SPTAN1 | 18917 | 42012 | 65107 |
| SPTB | 18918 | 42013 | 65108 |
| SPTB | 18919 | 42014 | 65109 |
| SPTBN1 | 18920 | 42015 | 65110 |
| SPTBN1 | 18921 | 42016 | 65111 |
| SPTBN2 | 18922 | 42017 | 65112 |
| SPTBN4 | 18923 | 42018 | 65113 |
| SPTBN4 | 18924 | 42019 | 65114 |
| SPTBN5 | 18925 | 42020 | 65115 |
| SPTLC1 | 18926 | 42021 | 65116 |
| SPTLC1 | 18927 | 42022 | 65117 |
| SPTLC1 | 18928 | 42023 | 65118 |
| SPTLC2 | 18929 | 42024 | 65119 |
| SPTLC3 | 18930 | 42025 | 65120 |
| SPTSSA | 18931 | 42026 | 65121 |
| SPTSSB | 18932 | 42027 | 65122 |
| SPTSSB | 18933 | 42028 | 65123 |
| SPTY2D1 | 18934 | 42029 | 65124 |
| SPX | 18935 | 42030 | 65125 |
| SPZ1 | 18936 | 42031 | 65126 |
| SQLE | 18937 | 42032 | 65127 |
| SQOR | 18938 | 42033 | 65128 |
| SQSTM1 | 18939 | 42034 | 65129 |
| SRA1 | 18940 | 42035 | 65130 |
| SRARP | 18941 | 42036 | 65131 |
| SRBD1 | 18942 | 42037 | 65132 |
| SRC | 18943 | 42038 | 65133 |
| SRCAP | 18944 | 42039 | 65134 |
| SRCIN1 | 18945 | 42040 | 65135 |
| SRD5A1 | 18946 | 42041 | 65136 |
| SRD5A1 | 18947 | 42042 | 65137 |
| SRD5A2 | 18948 | 42043 | 65138 |
| SRD5A3 | 18949 | 42044 | 65139 |
| SREBF1 | 18950 | 42045 | 65140 |
| SREBF2 | 18951 | 42046 | 65141 |
| SREK1 | 18952 | 42047 | 65142 |
| SREK1 | 18953 | 42048 | 65143 |
| SREK1IP1 | 18954 | 42049 | 65144 |
| SRF | 18955 | 42050 | 65145 |
| SRFBP1 | 18956 | 42051 | 65146 |
| SRGAP1 | 18957 | 42052 | 65147 |
| SRGAP2 | 18958 | 42053 | 65148 |
| SRGAP2 | 18959 | 42054 | 65149 |
| SRGAP2B | 18960 | 42055 | 65150 |
| SRGAP2C | 18961 | 42056 | 65151 |
| SRGAP3 | 18962 | 42057 | 65152 |
| SRGN | 18963 | 42058 | 65153 |
| SRI | 18964 | 42059 | 65154 |
| SRL | 18965 | 42060 | 65155 |
| SRL | 18966 | 42061 | 65156 |
| SRM | 18967 | 42062 | 65157 |
| SRMS | 18968 | 42063 | 65158 |
| SRP14 | 18969 | 42064 | 65159 |
| SRP19 | 18970 | 42065 | 65160 |
| SRP19 | 18971 | 42066 | 65161 |
| SRP19 | 18972 | 42067 | 65162 |
| SRP19 | 18973 | 42068 | 65163 |
| SRP54 | 18974 | 42069 | 65164 |
| SRP68 | 18975 | 42070 | 65165 |
| SRP72 | 18976 | 42071 | 65166 |
| SRP9 | 18977 | 42072 | 65167 |
| SRP9 | 18978 | 42073 | 65168 |
| SRPK1 | 18979 | 42074 | 65169 |
| SRPK2 | 18980 | 42075 | 65170 |
| SRPK2 | 18981 | 42076 | 65171 |
| SRPK3 | 18982 | 42077 | 65172 |
| SRPRA | 18983 | 42078 | 65173 |
| SRPRB | 18984 | 42079 | 65174 |
| SRPX | 18985 | 42080 | 65175 |
| SRPX | 18986 | 42081 | 65176 |
| SRPX2 | 18987 | 42082 | 65177 |
| SRR | 18988 | 42083 | 65178 |
| SRRD | 18989 | 42084 | 65179 |
| SRRM1 | 18990 | 42085 | 65180 |
| SRRM2 | 18991 | 42086 | 65181 |
| SRRM3 | 18992 | 42087 | 65182 |
| SRRM3 | 18993 | 42088 | 65183 |
| SRRM4 | 18994 | 42089 | 65184 |
| SRRM5 | 18995 | 42090 | 65185 |
| SRRT | 18996 | 42091 | 65186 |
| SRSF1 | 18997 | 42092 | 65187 |
| SRSF1 | 18998 | 42093 | 65188 |
| SRSF10 | 18999 | 42094 | 65189 |
| SRSF10 | 19000 | 42095 | 65190 |
| SRSF10 | 19001 | 42096 | 65191 |
| SRSF11 | 19002 | 42097 | 65192 |
| SRSF12 | 19003 | 42098 | 65193 |
| SRSF2 | 19004 | 42099 | 65194 |
| SRSF3 | 19005 | 42100 | 65195 |
| SRSF4 | 19006 | 42101 | 65196 |
| SRSF5 | 19007 | 42102 | 65197 |
| SRSF6 | 19008 | 42103 | 65198 |
| SRSF7 | 19009 | 42104 | 65199 |
| SRSF8 | 19010 | 42105 | 65200 |
| SRSF9 | 19011 | 42106 | 65201 |
| SRXN1 | 19012 | 42107 | 65202 |
| SRY | 19013 | 42108 | 65203 |
| SS18 | 19014 | 42109 | 65204 |
| SS18L1 | 19015 | 42110 | 65205 |
| SS18L2 | 19016 | 42111 | 65206 |
| SSB | 19017 | 42112 | 65207 |
| SSBP1 | 19018 | 42113 | 65208 |
| SSBP2 | 19019 | 42114 | 65209 |
| SSBP3 | 19020 | 42115 | 65210 |
| SSBP4 | 19021 | 42116 | 65211 |
| SSC4D | 19022 | 42117 | 65212 |
| SSC5D | 19023 | 42118 | 65213 |
| SSC5D | 19024 | 42119 | 65214 |
| SSFA2 | 19025 | 42120 | 65215 |
| SSFA2 | 19026 | 42121 | 65216 |
| SSFA2 | 19027 | 42122 | 65217 |
| SSH1 | 19028 | 42123 | 65218 |
| SSH1 | 19029 | 42124 | 65219 |
| SSH2 | 19030 | 42125 | 65220 |
| SSH2 | 19031 | 42126 | 65221 |
| SSH3 | 19032 | 42127 | 65222 |
| SSMEM1 | 19033 | 42128 | 65223 |
| SSNA1 | 19034 | 42129 | 65224 |
| SSPN | 19035 | 42130 | 65225 |
| SSPO | 19036 | 42131 | 65226 |
| SSR1 | 19037 | 42132 | 65227 |
| SSR2 | 19038 | 42133 | 65228 |
| SSR3 | 19039 | 42134 | 65229 |
| SSR4 | 19040 | 42135 | 65230 |
| SSRP1 | 19041 | 42136 | 65231 |
| SSSCA1 | 19042 | 42137 | 65232 |
| SST | 19043 | 42138 | 65233 |
| SSTR1 | 19044 | 42139 | 65234 |
| SSTR2 | 19045 | 42140 | 65235 |
| SSTR3 | 19046 | 42141 | 65236 |
| SSTR4 | 19047 | 42142 | 65237 |
| SSTR5 | 19048 | 42143 | 65238 |
| SSU72 | 19049 | 42144 | 65239 |
| SSUH2 | 19050 | 42145 | 65240 |
| SSX1 | 19051 | 42146 | 65241 |
| SSX2 | 19052 | 42147 | 65242 |
| SSX2IP | 19053 | 42148 | 65243 |
| SSX3 | 19054 | 42149 | 65244 |
| SSX4B | 19055 | 42150 | 65245 |
| SSX4B | 19056 | 42151 | 65246 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| SSX5 | 19057 | 42152 | 65247 |
| SSX7 | 19058 | 42153 | 65248 |
| ST13 | 19059 | 42154 | 65249 |
| ST14 | 19060 | 42155 | 65250 |
| ST18 | 19061 | 42156 | 65251 |
| ST18 | 19062 | 42157 | 65252 |
| ST18 | 19063 | 42158 | 65253 |
| ST20 | 19064 | 42159 | 65254 |
| ST20-MTHFS | 19065 | 42160 | 65255 |
| ST3GAL1 | 19066 | 42161 | 65256 |
| ST3GAL2 | 19067 | 42162 | 65257 |
| ST3GAL3 | 19068 | 42163 | 65258 |
| ST3GAL3 | 19069 | 42164 | 65259 |
| ST3GAL3 | 19070 | 42165 | 65260 |
| ST3GAL3 | 19071 | 42166 | 65261 |
| ST3GAL4 | 19072 | 42167 | 65262 |
| ST3GAL4 | 19073 | 42168 | 65263 |
| ST3GAL5 | 19074 | 42169 | 65264 |
| ST3GAL6 | 19075 | 42170 | 65265 |
| ST5 | 19076 | 42171 | 65266 |
| ST6GAL1 | 19077 | 42172 | 65267 |
| ST6GAL2 | 19078 | 42173 | 65268 |
| ST6GAL2 | 19079 | 42174 | 65269 |
| ST6GALNAC1 | 19080 | 42175 | 65270 |
| ST6GALNAC2 | 19081 | 42176 | 65271 |
| ST6GALNAC3 | 19082 | 42177 | 65272 |
| ST6GALNAC3 | 19083 | 42178 | 65273 |
| ST6GALNAC3 | 19084 | 42179 | 65274 |
| ST6GALNAC3 | 19085 | 42180 | 65275 |
| ST6GALNAC4 | 19086 | 42181 | 65276 |
| ST6GALNAC5 | 19087 | 42182 | 65277 |
| ST6GALNAC5 | 19088 | 42183 | 65278 |
| ST6GALNAC5 | 19089 | 42184 | 65279 |
| ST6GALNAC6 | 19090 | 42185 | 65280 |
| ST6GALNAC6 | 19091 | 42186 | 65281 |
| ST6GALNAC6 | 19092 | 42187 | 65282 |
| ST7 | 19093 | 42188 | 65283 |
| ST7 | 19094 | 42189 | 65284 |
| ST7L | 19095 | 42190 | 65285 |
| ST7L | 19096 | 42191 | 65286 |
| ST8SIA1 | 19097 | 42192 | 65287 |
| ST8SIA2 | 19098 | 42193 | 65288 |
| ST8SIA3 | 19099 | 42194 | 65289 |
| ST8SIA4 | 19100 | 42195 | 65290 |
| ST8SIA4 | 19101 | 42196 | 65291 |
| ST8SIA5 | 19102 | 42197 | 65292 |
| ST8SIA6 | 19103 | 42198 | 65293 |
| STAB1 | 19104 | 42199 | 65294 |
| STAB2 | 19105 | 42200 | 65295 |
| STAC | 19106 | 42201 | 65296 |
| STAC2 | 19107 | 42202 | 65297 |
| STAC3 | 19108 | 42203 | 65298 |
| STAG1 | 19109 | 42204 | 65299 |
| STAG2 | 19110 | 42205 | 65300 |
| STAG3 | 19111 | 42206 | 65301 |
| STAM | 19112 | 42207 | 65302 |
| STAM2 | 19113 | 42208 | 65303 |
| STAMBP | 19114 | 42209 | 65304 |
| STAMBP | 19115 | 42210 | 65305 |
| STAMBPL1 | 19116 | 42211 | 65306 |
| STAP1 | 19117 | 42212 | 65307 |
| STAP2 | 19118 | 42213 | 65308 |
| STAR | 19119 | 42214 | 65309 |
| STARD10 | 19120 | 42215 | 65310 |
| STARD13 | 19121 | 42216 | 65311 |
| STARD13 | 19122 | 42217 | 65312 |
| STARD13 | 19123 | 42218 | 65313 |
| STARD3 | 19124 | 42219 | 65314 |
| STARD3NL | 19125 | 42220 | 65315 |
| STARD4 | 19126 | 42221 | 65316 |
| STARD4 | 19127 | 42222 | 65317 |
| STARD5 | 19128 | 42223 | 65318 |
| STARD6 | 19129 | 42224 | 65319 |
| STARD7 | 19130 | 42225 | 65320 |
| STARD8 | 19131 | 42226 | 65321 |
| STARD9 | 19132 | 42227 | 65322 |
| STAT1 | 19133 | 42228 | 65323 |
| STAT1 | 19134 | 42229 | 65324 |
| STAT2 | 19135 | 42230 | 65325 |
| STAT3 | 19136 | 42231 | 65326 |
| STAT3 | 19137 | 42232 | 65327 |
| STAT4 | 19138 | 42233 | 65328 |
| STAT5A | 19139 | 42234 | 65329 |
| STAT5B | 19140 | 42235 | 65330 |
| STAT6 | 19141 | 42236 | 65331 |
| STATH | 19142 | 42237 | 65332 |
| STAU1 | 19143 | 42238 | 65333 |
| STAU2 | 19144 | 42239 | 65334 |
| STAU2 | 19145 | 42240 | 65335 |
| STBD1 | 19146 | 42241 | 65336 |
| STC1 | 19147 | 42242 | 65337 |
| STC2 | 19148 | 42243 | 65338 |
| STEAP1 | 19149 | 42244 | 65339 |
| STEAP1B | 19150 | 42245 | 65340 |
| STEAP1B | 19151 | 42246 | 65341 |
| STEAP2 | 19152 | 42247 | 65342 |
| STEAP2 | 19153 | 42248 | 65343 |
| STEAP2 | 19154 | 42249 | 65344 |
| STEAP3 | 19155 | 42250 | 65345 |
| STEAP3 | 19156 | 42251 | 65346 |
| STEAP4 | 19157 | 42252 | 65347 |
| STH | 19158 | 42253 | 65348 |
| STIL | 19159 | 42254 | 65349 |
| STIM1 | 19160 | 42255 | 65350 |
| STIM1 | 19161 | 42256 | 65351 |
| STIM2 | 19162 | 42257 | 65352 |
| STIM2 | 19163 | 42258 | 65353 |
| STIP1 | 19164 | 42259 | 65354 |
| STK10 | 19165 | 42260 | 65355 |
| STK11 | 19166 | 42261 | 65356 |
| STK11IP | 19167 | 42262 | 65357 |
| STK16 | 19168 | 42263 | 65358 |
| STK17A | 19169 | 42264 | 65359 |
| STK17B | 19170 | 42265 | 65360 |
| STK19 | 19171 | 42266 | 65361 |
| STK24 | 19172 | 42267 | 65362 |
| STK25 | 19173 | 42268 | 65363 |
| STK26 | 19174 | 42269 | 65364 |
| STK3 | 19175 | 42270 | 65365 |
| STK31 | 19176 | 42271 | 65366 |
| STK32A | 19177 | 42272 | 65367 |
| STK32A | 19178 | 42273 | 65368 |
| STK32A | 19179 | 42274 | 65369 |
| STK32B | 19180 | 42275 | 65370 |
| STK32C | 19181 | 42276 | 65371 |
| STK32C | 19182 | 42277 | 65372 |
| STK32C | 19183 | 42278 | 65373 |
| STK32C | 19184 | 42279 | 65374 |
| STK32C | 19185 | 42280 | 65375 |
| STK33 | 19186 | 42281 | 65376 |
| STK33 | 19187 | 42282 | 65377 |
| STK35 | 19188 | 42283 | 65378 |
| STK36 | 19189 | 42284 | 65379 |
| STK38 | 19190 | 42285 | 65380 |
| STK38L | 19191 | 42286 | 65381 |
| STK39 | 19192 | 42287 | 65382 |
| STK4 | 19193 | 42288 | 65383 |
| STK4 | 19194 | 42289 | 65384 |
| STK40 | 19195 | 42290 | 65385 |
| STKLD1 | 19196 | 42291 | 65386 |
| STMN1 | 19197 | 42292 | 65387 |
| STMN1 | 19198 | 42293 | 65388 |
| STMN2 | 19199 | 42294 | 65389 |
| STMN2 | 19200 | 42295 | 65390 |
| STMN3 | 19201 | 42296 | 65391 |
| STMN4 | 19202 | 42297 | 65392 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| STMN4 | 19203 | 42298 | 65393 |
| STMND1 | 19204 | 42299 | 65394 |
| STMP1 | 19205 | 42300 | 65395 |
| STN1 | 19206 | 42301 | 65396 |
| STOM | 19207 | 42302 | 65397 |
| STOM | 19208 | 42303 | 65398 |
| STOM | 19209 | 42304 | 65399 |
| STOML1 | 19210 | 42305 | 65400 |
| STOML2 | 19211 | 42306 | 65401 |
| STOML3 | 19212 | 42307 | 65402 |
| STON1 | 19213 | 42308 | 65403 |
| STON1-GTF2A1L | 19214 | 42309 | 65404 |
| STON1-GTF2A1L | 19215 | 42310 | 65405 |
| STON2 | 19216 | 42311 | 65406 |
| STON2 | 19217 | 42312 | 65407 |
| STOX1 | 19218 | 42313 | 65408 |
| STOX1 | 19219 | 42314 | 65409 |
| STOX1 | 19220 | 42315 | 65410 |
| STOX2 | 19221 | 42316 | 65411 |
| STPG1 | 19222 | 42317 | 65412 |
| STPG2 | 19223 | 42318 | 65413 |
| STPG3 | 19224 | 42319 | 65414 |
| STPG3 | 19225 | 42320 | 65415 |
| STPG4 | 19226 | 42321 | 65416 |
| STPG4 | 19227 | 42322 | 65417 |
| STRA6 | 19228 | 42323 | 65418 |
| STRA6 | 19229 | 42324 | 65419 |
| STRA8 | 19230 | 42325 | 65420 |
| STRADA | 19231 | 42326 | 65421 |
| STRADA | 19232 | 42327 | 65422 |
| STRADA | 19233 | 42328 | 65423 |
| STRADB | 19234 | 42329 | 65424 |
| STRADB | 19235 | 42330 | 65425 |
| STRAP | 19236 | 42331 | 65426 |
| STRBP | 19237 | 42332 | 65427 |
| STRC | 19238 | 42333 | 65428 |
| STRIP1 | 19239 | 42334 | 65429 |
| STRIP2 | 19240 | 42335 | 65430 |
| STRIP2 | 19241 | 42336 | 65431 |
| STRN | 19242 | 42337 | 65432 |
| STRN3 | 19243 | 42338 | 65433 |
| STRN4 | 19244 | 42339 | 65434 |
| STS | 19245 | 42340 | 65435 |
| STT3A | 19246 | 42341 | 65436 |
| STT3B | 19247 | 42342 | 65437 |
| STUB1 | 19248 | 42343 | 65438 |
| STUM | 19249 | 42344 | 65439 |
| STX10 | 19250 | 42345 | 65440 |
| STX10 | 19251 | 42346 | 65441 |
| STX10 | 19252 | 42347 | 65442 |
| STX11 | 19253 | 42348 | 65443 |
| STX12 | 19254 | 42349 | 65444 |
| STX16 | 19255 | 42350 | 65445 |
| STX17 | 19256 | 42351 | 65446 |
| STX18 | 19257 | 42352 | 65447 |
| STX19 | 19258 | 42353 | 65448 |
| STX1A | 19259 | 42354 | 65449 |
| STX1A | 19260 | 42355 | 65450 |
| STX1B | 19261 | 42356 | 65451 |
| STX2 | 19262 | 42357 | 65452 |
| STX2 | 19263 | 42358 | 65453 |
| STX2 | 19264 | 42359 | 65454 |
| STX2 | 19265 | 42360 | 65455 |
| STX3 | 19266 | 42361 | 65456 |
| STX3 | 19267 | 42362 | 65457 |
| STX4 | 19268 | 42363 | 65458 |
| STX5 | 19269 | 42364 | 65459 |
| STX5 | 19270 | 42365 | 65460 |
| STX6 | 19271 | 42366 | 65461 |
| STX7 | 19272 | 42367 | 65462 |
| STX7 | 19273 | 42368 | 65463 |
| STX8 | 19274 | 42369 | 65464 |
| STXBP1 | 19275 | 42370 | 65465 |
| STXBP1 | 19276 | 42371 | 65466 |
| STXBP2 | 19277 | 42372 | 65467 |
| STXBP3 | 19278 | 42373 | 65468 |
| STXBP4 | 19279 | 42374 | 65469 |
| STXBP5 | 19280 | 42375 | 65470 |
| STXBP5L | 19281 | 42376 | 65471 |
| STXBP6 | 19282 | 42377 | 65472 |
| STYK1 | 19283 | 42378 | 65473 |
| STYX | 19284 | 42379 | 65474 |
| STYXL1 | 19285 | 42380 | 65475 |
| STYXL1 | 19286 | 42381 | 65476 |
| SUB1 | 19287 | 42382 | 65477 |
| SUCLA2 | 19288 | 42383 | 65478 |
| SUCLG1 | 19289 | 42384 | 65479 |
| SUCLG2 | 19290 | 42385 | 65480 |
| SUCLG2 | 19291 | 42386 | 65481 |
| SUCNR1 | 19292 | 42387 | 65482 |
| SUCO | 19293 | 42388 | 65483 |
| SUDS3 | 19294 | 42389 | 65484 |
| SUFU | 19295 | 42390 | 65485 |
| SUFU | 19296 | 42391 | 65486 |
| SUGCT | 19297 | 42392 | 65487 |
| SUGP1 | 19298 | 42393 | 65488 |
| SUGP2 | 19299 | 42394 | 65489 |
| SUGT1 | 19300 | 42395 | 65490 |
| SULF1 | 19301 | 42396 | 65491 |
| SULF2 | 19302 | 42397 | 65492 |
| SULT1A1 | 19303 | 42398 | 65493 |
| SULT1B1 | 19304 | 42399 | 65494 |
| SULT1C2 | 19305 | 42400 | 65495 |
| SULT1C3 | 19306 | 42401 | 65496 |
| SULT1C3 | 19307 | 42402 | 65497 |
| SULT1C4 | 19308 | 42403 | 65498 |
| SULT1E1 | 19309 | 42404 | 65499 |
| SULT2A1 | 19310 | 42405 | 65500 |
| SULT2B1 | 19311 | 42406 | 65501 |
| SULT4A1 | 19312 | 42407 | 65502 |
| SULT6B1 | 19313 | 42408 | 65503 |
| SUMF1 | 19314 | 42409 | 65504 |
| SUMF2 | 19315 | 42410 | 65505 |
| SUMF2 | 19316 | 42411 | 65506 |
| SUMO1 | 19317 | 42412 | 65507 |
| SUMO2 | 19318 | 42413 | 65508 |
| SUMO3 | 19319 | 42414 | 65509 |
| SUN1 | 19320 | 42415 | 65510 |
| SUN1 | 19321 | 42416 | 65511 |
| SUN2 | 19322 | 42417 | 65512 |
| SUN3 | 19323 | 42418 | 65513 |
| SUN5 | 19324 | 42419 | 65514 |
| SUOX | 19325 | 42420 | 65515 |
| SUPT16H | 19326 | 42421 | 65516 |
| SUPT20H | 19327 | 42422 | 65517 |
| SUPT20H | 19328 | 42423 | 65518 |
| SUPT20HL1 | 19329 | 42424 | 65519 |
| SUPT20HL2 | 19330 | 42425 | 65520 |
| SUPT3H | 19331 | 42426 | 65521 |
| SUPT3H | 19332 | 42427 | 65522 |
| SUPT4H1 | 19333 | 42428 | 65523 |
| SUPT5H | 19334 | 42429 | 65524 |
| SUPT6H | 19335 | 42430 | 65525 |
| SUPT7L | 19336 | 42431 | 65526 |
| SUPV3L1 | 19337 | 42432 | 65527 |
| SURF1 | 19338 | 42433 | 65528 |
| SURF2 | 19339 | 42434 | 65529 |
| SURF4 | 19340 | 42435 | 65530 |
| SURF4 | 19341 | 42436 | 65531 |
| SURF4 | 19342 | 42437 | 65532 |
| SURF6 | 19343 | 42438 | 65533 |
| SURF6 | 19344 | 42439 | 65534 |
| SUSD1 | 19345 | 42440 | 65535 |
| SUSD1 | 19346 | 42441 | 65536 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| SUSD2 | 19347 | 42442 | 65537 |
| SUSD3 | 19348 | 42443 | 65538 |
| SUSD4 | 19349 | 42444 | 65539 |
| SUSD4 | 19350 | 42445 | 65540 |
| SUSD5 | 19351 | 42446 | 65541 |
| SUSD6 | 19352 | 42447 | 65542 |
| SUV39H1 | 19353 | 42448 | 65543 |
| SUV39H2 | 19354 | 42449 | 65544 |
| SUZ12 | 19355 | 42450 | 65545 |
| SV2A | 19356 | 42451 | 65546 |
| SV2B | 19357 | 42452 | 65547 |
| SV2C | 19358 | 42453 | 65548 |
| SV2C | 19359 | 42454 | 65549 |
| SVBP | 19360 | 42455 | 65550 |
| SVEP1 | 19361 | 42456 | 65551 |
| SVIL | 19362 | 42457 | 65552 |
| SVIP | 19363 | 42458 | 65553 |
| SVIP | 19364 | 42459 | 65554 |
| SVOP | 19365 | 42460 | 65555 |
| SVOPL | 19366 | 42461 | 65556 |
| SWAP70 | 19367 | 42462 | 65557 |
| SWI5 | 19368 | 42463 | 65558 |
| SWSAP1 | 19369 | 42464 | 65559 |
| SWT1 | 19370 | 42465 | 65560 |
| SYAP1 | 19371 | 42466 | 65561 |
| SYBU | 19372 | 42467 | 65562 |
| SYCE1 | 19373 | 42468 | 65563 |
| SYCE1L | 19374 | 42469 | 65564 |
| SYCE2 | 19375 | 42470 | 65565 |
| SYCE3 | 19376 | 42471 | 65566 |
| SYCN | 19377 | 42472 | 65567 |
| SYCP1 | 19378 | 42473 | 65568 |
| SYCP2 | 19379 | 42474 | 65569 |
| SYCP2L | 19380 | 42475 | 65570 |
| SYCP3 | 19381 | 42476 | 65571 |
| SYDE1 | 19382 | 42477 | 65572 |
| SYDE2 | 19383 | 42478 | 65573 |
| SYF2 | 19384 | 42479 | 65574 |
| SYK | 19385 | 42480 | 65575 |
| SYMPK | 19386 | 42481 | 65576 |
| SYN1 | 19387 | 42482 | 65577 |
| SYN1 | 19388 | 42483 | 65578 |
| SYN2 | 19389 | 42484 | 65579 |
| SYN2 | 19390 | 42485 | 65580 |
| SYN3 | 19391 | 42486 | 65581 |
| SYN3 | 19392 | 42487 | 65582 |
| SYNC | 19393 | 42488 | 65583 |
| SYNC | 19394 | 42489 | 65584 |
| SYNCRIP | 19395 | 42490 | 65585 |
| SYNCRIP | 19396 | 42491 | 65586 |
| SYNDIG1 | 19397 | 42492 | 65587 |
| SYNDIG1L | 19398 | 42493 | 65588 |
| SYNE1 | 19399 | 42494 | 65589 |
| SYNE1 | 19400 | 42495 | 65590 |
| SYNE2 | 19401 | 42496 | 65591 |
| SYNE3 | 19402 | 42497 | 65592 |
| SYNE4 | 19403 | 42498 | 65593 |
| SYNGAP1 | 19404 | 42499 | 65594 |
| SYNGAP1 | 19405 | 42500 | 65595 |
| SYNGR1 | 19406 | 42501 | 65596 |
| SYNGR1 | 19407 | 42502 | 65597 |
| SYNGR2 | 19408 | 42503 | 65598 |
| SYNGR2 | 19409 | 42504 | 65599 |
| SYNGR3 | 19410 | 42505 | 65600 |
| SYNGR4 | 19411 | 42506 | 65601 |
| SYNJ1 | 19412 | 42507 | 65602 |
| SYNJ1 | 19413 | 42508 | 65603 |
| SYNJ2 | 19414 | 42509 | 65604 |
| SYNJ2BP | 19415 | 42510 | 65605 |
| SYNM | 19416 | 42511 | 65606 |
| SYNPO | 19417 | 42512 | 65607 |
| SYNPO | 19418 | 42513 | 65608 |
| SYNPO2 | 19419 | 42514 | 65609 |
| SYNPO2 | 19420 | 42515 | 65610 |
| SYNPO2 | 19421 | 42516 | 65611 |
| SYNPO2 | 19422 | 42517 | 65612 |
| SYNPO2L | 19423 | 42518 | 65613 |
| SYNPR | 19424 | 42519 | 65614 |
| SYNRG | 19425 | 42520 | 65615 |
| SYP | 19426 | 42521 | 65616 |
| SYPL1 | 19427 | 42522 | 65617 |
| SYPL2 | 19428 | 42523 | 65618 |
| SYS1 | 19429 | 42524 | 65619 |
| SYS1 | 19430 | 42525 | 65620 |
| SYT1 | 19431 | 42526 | 65621 |
| SYT10 | 19432 | 42527 | 65622 |
| SYT11 | 19433 | 42528 | 65623 |
| SYT12 | 19434 | 42529 | 65624 |
| SYT13 | 19435 | 42530 | 65625 |
| SYT14 | 19436 | 42531 | 65626 |
| SYT15 | 19437 | 42532 | 65627 |
| SYT15 | 19438 | 42533 | 65628 |
| SYT16 | 19439 | 42534 | 65629 |
| SYT17 | 19440 | 42535 | 65630 |
| SYT2 | 19441 | 42536 | 65631 |
| SYT3 | 19442 | 42537 | 65632 |
| SYT4 | 19443 | 42538 | 65633 |
| SYT5 | 19444 | 42539 | 65634 |
| SYT6 | 19445 | 42540 | 65635 |
| SYT7 | 19446 | 42541 | 65636 |
| SYT8 | 19447 | 42542 | 65637 |
| SYT9 | 19448 | 42543 | 65638 |
| SYTL1 | 19449 | 42544 | 65639 |
| SYTL2 | 19450 | 42545 | 65640 |
| SYTL3 | 19451 | 42546 | 65641 |
| SYTL4 | 19452 | 42547 | 65642 |
| SYTL5 | 19453 | 42548 | 65643 |
| SYVN1 | 19454 | 42549 | 65644 |
| SZRD1 | 19455 | 42550 | 65645 |
| SZT2 | 19456 | 42551 | 65646 |
| T | 19457 | 42552 | 65647 |
| TAAR1 | 19458 | 42553 | 65648 |
| TAAR2 | 19459 | 42554 | 65649 |
| TAAR5 | 19460 | 42555 | 65650 |
| TAAR6 | 19461 | 42556 | 65651 |
| TAAR8 | 19462 | 42557 | 65652 |
| TAAR9 | 19463 | 42558 | 65653 |
| TAB1 | 19464 | 42559 | 65654 |
| TAB1 | 19465 | 42560 | 65655 |
| TAB2 | 19466 | 42561 | 65656 |
| TAB3 | 19467 | 42562 | 65657 |
| TAC1 | 19468 | 42563 | 65658 |
| TAC1 | 19469 | 42564 | 65659 |
| TAC1 | 19470 | 42565 | 65660 |
| TAC3 | 19471 | 42566 | 65661 |
| TAC4 | 19472 | 42567 | 65662 |
| TAC4 | 19473 | 42568 | 65663 |
| TACC1 | 19474 | 42569 | 65664 |
| TACC1 | 19475 | 42570 | 65665 |
| TACC2 | 19476 | 42571 | 65666 |
| TACC3 | 19477 | 42572 | 65667 |
| TACO1 | 19478 | 42573 | 65668 |
| TACR1 | 19479 | 42574 | 65669 |
| TACR1 | 19480 | 42575 | 65670 |
| TACR2 | 19481 | 42576 | 65671 |
| TACR3 | 19482 | 42577 | 65672 |
| TACSTD2 | 19483 | 42578 | 65673 |
| TADA1 | 19484 | 42579 | 65674 |
| TADA2A | 19485 | 42580 | 65675 |
| TADA2A | 19486 | 42581 | 65676 |
| TADA2B | 19487 | 42582 | 65677 |
| TADA3 | 19488 | 42583 | 65678 |
| TADA3 | 19489 | 42584 | 65679 |
| TAF1 | 19490 | 42585 | 65680 |
| TAF10 | 19491 | 42586 | 65681 |
| TAF11 | 19492 | 42587 | 65682 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| TAF11 | 19493 | 42588 | 65683 |
| TAF12 | 19494 | 42589 | 65684 |
| TAF13 | 19495 | 42590 | 65685 |
| TAF15 | 19496 | 42591 | 65686 |
| TAF1A | 19497 | 42592 | 65687 |
| TAF1B | 19498 | 42593 | 65688 |
| TAF1C | 19499 | 42594 | 65689 |
| TAF1D | 19500 | 42595 | 65690 |
| TAF1L | 19501 | 42596 | 65691 |
| TAF2 | 19502 | 42597 | 65692 |
| TAF3 | 19503 | 42598 | 65693 |
| TAF4 | 19504 | 42599 | 65694 |
| TAF4B | 19505 | 42600 | 65695 |
| TAF5 | 19506 | 42601 | 65696 |
| TAF5L | 19507 | 42602 | 65697 |
| TAF5L | 19508 | 42603 | 65698 |
| TAF6 | 19509 | 42604 | 65699 |
| TAF6L | 19510 | 42605 | 65700 |
| TAF7 | 19511 | 42606 | 65701 |
| TAF7L | 19512 | 42607 | 65702 |
| TAF8 | 19513 | 42608 | 65703 |
| TAF9 | 19514 | 42609 | 65704 |
| TAF9B | 19515 | 42610 | 65705 |
| TAGAP | 19516 | 42611 | 65706 |
| TAGAP | 19517 | 42612 | 65707 |
| TAGLN | 19518 | 42613 | 65708 |
| TAGLN2 | 19519 | 42614 | 65709 |
| TAGLN3 | 19520 | 42615 | 65710 |
| TAL1 | 19521 | 42616 | 65711 |
| TAL1 | 19522 | 42617 | 65712 |
| TAL2 | 19523 | 42618 | 65713 |
| TALDO1 | 19524 | 42619 | 65714 |
| TAMM41 | 19525 | 42620 | 65715 |
| TANC1 | 19526 | 42621 | 65716 |
| TANC1 | 19527 | 42622 | 65717 |
| TANC2 | 19528 | 42623 | 65718 |
| TANGO2 | 19529 | 42624 | 65719 |
| TANGO2 | 19530 | 42625 | 65720 |
| TANGO2 | 19531 | 42626 | 65721 |
| TANGO6 | 19532 | 42627 | 65722 |
| TANK | 19533 | 42628 | 65723 |
| TANK | 19534 | 42629 | 65724 |
| TAOK1 | 19535 | 42630 | 65725 |
| TAOK2 | 19536 | 42631 | 65726 |
| TAOK2 | 19537 | 42632 | 65727 |
| TAOK3 | 19538 | 42633 | 65728 |
| TAOK3 | 19539 | 42634 | 65729 |
| TAP1 | 19540 | 42635 | 65730 |
| TAP2 | 19541 | 42636 | 65731 |
| TAP2 | 19542 | 42637 | 65732 |
| TAP2 | 19543 | 42638 | 65733 |
| TAPBP | 19544 | 42639 | 65734 |
| TAPBP | 19545 | 42640 | 65735 |
| TAPBPL | 19546 | 42641 | 65736 |
| TAPT1 | 19547 | 42642 | 65737 |
| TARBP1 | 19548 | 42643 | 65738 |
| TARBP2 | 19549 | 42644 | 65739 |
| TARDBP | 19550 | 42645 | 65740 |
| TARM1 | 19551 | 42646 | 65741 |
| TARP | 19552 | 42647 | 65742 |
| TARS | 19553 | 42648 | 65743 |
| TARS2 | 19554 | 42649 | 65744 |
| TARSL2 | 19555 | 42650 | 65745 |
| TAS1R1 | 19556 | 42651 | 65746 |
| TAS1R2 | 19557 | 42652 | 65747 |
| TAS1R3 | 19558 | 42653 | 65748 |
| TAS2R1 | 19559 | 42654 | 65749 |
| TAS2R10 | 19560 | 42655 | 65750 |
| TAS2R13 | 19561 | 42656 | 65751 |
| TAS2R14 | 19562 | 42657 | 65752 |
| TAS2R16 | 19563 | 42658 | 65753 |
| TAS2R19 | 19564 | 42659 | 65754 |
| TAS2R20 | 19565 | 42660 | 65755 |
| TAS2R3 | 19566 | 42661 | 65756 |
| TAS2R30 | 19567 | 42662 | 65757 |
| TAS2R31 | 19568 | 42663 | 65758 |
| TAS2R38 | 19569 | 42664 | 65759 |
| TAS2R39 | 19570 | 42665 | 65760 |
| TAS2R4 | 19571 | 42666 | 65761 |
| TAS2R40 | 19572 | 42667 | 65762 |
| TAS2R41 | 19573 | 42668 | 65763 |
| TAS2R42 | 19574 | 42669 | 65764 |
| TAS2R43 | 19575 | 42670 | 65765 |
| TAS2R45 | 19576 | 42671 | 65766 |
| TAS2R46 | 19577 | 42672 | 65767 |
| TAS2R5 | 19578 | 42673 | 65768 |
| TAS2R50 | 19579 | 42674 | 65769 |
| TAS2R60 | 19580 | 42675 | 65770 |
| TAS2R7 | 19581 | 42676 | 65771 |
| TAS2R8 | 19582 | 42677 | 65772 |
| TAS2R9 | 19583 | 42678 | 65773 |
| TASP1 | 19584 | 42679 | 65774 |
| TAT | 19585 | 42680 | 65775 |
| TATDN1 | 19586 | 42681 | 65776 |
| TATDN2 | 19587 | 42682 | 65777 |
| TATDN3 | 19588 | 42683 | 65778 |
| TATDN3 | 19589 | 42684 | 65779 |
| TAX1BP1 | 19590 | 42685 | 65780 |
| TAX1BP3 | 19591 | 42686 | 65781 |
| TAZ | 19592 | 42687 | 65782 |
| TBATA | 19593 | 42688 | 65783 |
| TBC1D1 | 19594 | 42689 | 65784 |
| TBC1D10A | 19595 | 42690 | 65785 |
| TBC1D10B | 19596 | 42691 | 65786 |
| TBC1D10C | 19597 | 42692 | 65787 |
| TBC1D10C | 19598 | 42693 | 65788 |
| TBC1D12 | 19599 | 42694 | 65789 |
| TBC1D13 | 19600 | 42695 | 65790 |
| TBC1D14 | 19601 | 42696 | 65791 |
| TBC1D15 | 19602 | 42697 | 65792 |
| TBC1D16 | 19603 | 42698 | 65793 |
| TBC1D16 | 19604 | 42699 | 65794 |
| TBC1D17 | 19605 | 42700 | 65795 |
| TBC1D19 | 19606 | 42701 | 65796 |
| TBC1D2 | 19607 | 42702 | 65797 |
| TBC1D20 | 19608 | 42703 | 65798 |
| TBC1D21 | 19609 | 42704 | 65799 |
| TBC1D22A | 19610 | 42705 | 65800 |
| TBC1D22B | 19611 | 42706 | 65801 |
| TBC1D23 | 19612 | 42707 | 65802 |
| TBC1D24 | 19613 | 42708 | 65803 |
| TBC1D25 | 19614 | 42709 | 65804 |
| TBC1D26 | 19615 | 42710 | 65805 |
| TBC1D28 | 19616 | 42711 | 65806 |
| TBC1D29 | 19617 | 42712 | 65807 |
| TBC1D2B | 19618 | 42713 | 65808 |
| TBC1D2B | 19619 | 42714 | 65809 |
| TBC1D3 | 19620 | 42715 | 65810 |
| TBC1D30 | 19621 | 42716 | 65811 |
| TBC1D31 | 19622 | 42717 | 65812 |
| TBC1D32 | 19623 | 42718 | 65813 |
| TBC1D3B | 19624 | 42719 | 65814 |
| TBC1D3D | 19625 | 42720 | 65815 |
| TBC1D3E | 19626 | 42721 | 65816 |
| TBC1D3F | 19627 | 42722 | 65817 |
| TBC1D3L | 19628 | 42723 | 65818 |
| TBC1D4 | 19629 | 42724 | 65819 |
| TBC1D5 | 19630 | 42725 | 65820 |
| TBC1D7 | 19631 | 42726 | 65821 |
| TBC1D7 | 19632 | 42727 | 65822 |
| TBC1D8 | 19633 | 42728 | 65823 |
| TBC1D8B | 19634 | 42729 | 65824 |
| TBC1D8B | 19635 | 42730 | 65825 |
| TBC1D9 | 19636 | 42731 | 65826 |
| TBC1D9B | 19637 | 42732 | 65827 |
| TBCA | 19638 | 42733 | 65828 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| TBCA | 19639 | 42734 | 65829 |
| TBCB | 19640 | 42735 | 65830 |
| TBCC | 19641 | 42736 | 65831 |
| TBCCD1 | 19642 | 42737 | 65832 |
| TBCD | 19643 | 42738 | 65833 |
| TBCE | 19644 | 42739 | 65834 |
| TBCEL | 19645 | 42740 | 65835 |
| TBCK | 19646 | 42741 | 65836 |
| TBK1 | 19647 | 42742 | 65837 |
| TBKBP1 | 19648 | 42743 | 65838 |
| TBL1X | 19649 | 42744 | 65839 |
| TBL1XR1 | 19650 | 42745 | 65840 |
| TBL1Y | 19651 | 42746 | 65841 |
| TBL2 | 19652 | 42747 | 65842 |
| TBL3 | 19653 | 42748 | 65843 |
| TBP | 19654 | 42749 | 65844 |
| TBPL1 | 19655 | 42750 | 65845 |
| TBPL2 | 19656 | 42751 | 65846 |
| TBR1 | 19657 | 42752 | 65847 |
| TBRG1 | 19658 | 42753 | 65848 |
| TBRG4 | 19659 | 42754 | 65849 |
| TBX1 | 19660 | 42755 | 65850 |
| TBX1 | 19661 | 42756 | 65851 |
| TBX1 | 19662 | 42757 | 65852 |
| TBX10 | 19663 | 42758 | 65853 |
| TBX15 | 19664 | 42759 | 65854 |
| TBX18 | 19665 | 42760 | 65855 |
| TBX19 | 19666 | 42761 | 65856 |
| TBX2 | 19667 | 42762 | 65857 |
| TBX20 | 19668 | 42763 | 65858 |
| TBX20 | 19669 | 42764 | 65859 |
| TBX21 | 19670 | 42765 | 65860 |
| TBX22 | 19671 | 42766 | 65861 |
| TBX3 | 19672 | 42767 | 65862 |
| TBX4 | 19673 | 42768 | 65863 |
| TBX5 | 19674 | 42769 | 65864 |
| TBX6 | 19675 | 42770 | 65865 |
| TBXA2R | 19676 | 42771 | 65866 |
| TBXA2R | 19677 | 42772 | 65867 |
| TBXAS1 | 19678 | 42773 | 65868 |
| TBXAS1 | 19679 | 42774 | 65869 |
| TC2N | 19680 | 42775 | 65870 |
| TCAF1 | 19681 | 42776 | 65871 |
| TCAF1 | 19682 | 42777 | 65872 |
| TCAF2 | 19683 | 42778 | 65873 |
| TCAF2 | 19684 | 42779 | 65874 |
| TCAIM | 19685 | 42780 | 65875 |
| TCAIM | 19686 | 42781 | 65876 |
| TCAP | 19687 | 42782 | 65877 |
| TCEA1 | 19688 | 42783 | 65878 |
| TCEA2 | 19689 | 42784 | 65879 |
| TCEA3 | 19690 | 42785 | 65880 |
| TCEAL1 | 19691 | 42786 | 65881 |
| TCEAL3 | 19692 | 42787 | 65882 |
| TCEAL4 | 19693 | 42788 | 65883 |
| TCEAL5 | 19694 | 42789 | 65884 |
| TCEAL6 | 19695 | 42790 | 65885 |
| TCEAL7 | 19696 | 42791 | 65886 |
| TCEAL8 | 19697 | 42792 | 65887 |
| TCEAL9 | 19698 | 42793 | 65888 |
| TCEANC | 19699 | 42794 | 65889 |
| TCEANC2 | 19700 | 42795 | 65890 |
| TCERG1 | 19701 | 42796 | 65891 |
| TCERG1L | 19702 | 42797 | 65892 |
| TCF12 | 19703 | 42798 | 65893 |
| TCF15 | 19704 | 42799 | 65894 |
| TCF19 | 19705 | 42800 | 65895 |
| TCF20 | 19706 | 42801 | 65896 |
| TCF20 | 19707 | 42802 | 65897 |
| TCF21 | 19708 | 42803 | 65898 |
| TCF21 | 19709 | 42804 | 65899 |
| TCF23 | 19710 | 42805 | 65900 |
| TCF24 | 19711 | 42806 | 65901 |
| TCF25 | 19712 | 42807 | 65902 |
| TCF3 | 19713 | 42808 | 65903 |
| TCF3 | 19714 | 42809 | 65904 |
| TCF4 | 19715 | 42810 | 65905 |
| TCF7 | 19716 | 42811 | 65906 |
| TCF7 | 19717 | 42812 | 65907 |
| TCF7 | 19718 | 42813 | 65908 |
| TCF7 | 19719 | 42814 | 65909 |
| TCF7L1 | 19720 | 42815 | 65910 |
| TCF7L2 | 19721 | 42816 | 65911 |
| TCF7L2 | 19722 | 42817 | 65912 |
| TCF7L2 | 19723 | 42818 | 65913 |
| TCF7L2 | 19724 | 42819 | 65914 |
| TCFL5 | 19725 | 42820 | 65915 |
| TCFL5 | 19726 | 42821 | 65916 |
| TCHH | 19727 | 42822 | 65917 |
| TCHHL1 | 19728 | 42823 | 65918 |
| TCHP | 19729 | 42824 | 65919 |
| TCIM | 19730 | 42825 | 65920 |
| TCIRG1 | 19731 | 42826 | 65921 |
| TCL1A | 19732 | 42827 | 65922 |
| TCL1B | 19733 | 42828 | 65923 |
| TCN1 | 19734 | 42829 | 65924 |
| TCN2 | 19735 | 42830 | 65925 |
| TCOF1 | 19736 | 42831 | 65926 |
| TCOF1 | 19737 | 42832 | 65927 |
| TCP1 | 19738 | 42833 | 65928 |
| TCP10L | 19739 | 42834 | 65929 |
| TCP10L2 | 19740 | 42835 | 65930 |
| TCP11 | 19741 | 42836 | 65931 |
| TCP11L1 | 19742 | 42837 | 65932 |
| TCP11L2 | 19743 | 42838 | 65933 |
| TCP11L2 | 19744 | 42839 | 65934 |
| TCP11X2 | 19745 | 42840 | 65935 |
| TCTA | 19746 | 42841 | 65936 |
| TCTE1 | 19747 | 42842 | 65937 |
| TCTE3 | 19748 | 42843 | 65938 |
| TCTEX1D1 | 19749 | 42844 | 65939 |
| TCTEX1D2 | 19750 | 42845 | 65940 |
| TCTEX1D4 | 19751 | 42846 | 65941 |
| TCTN1 | 19752 | 42847 | 65942 |
| TCTN1 | 19753 | 42848 | 65943 |
| TCTN2 | 19754 | 42849 | 65944 |
| TCTN3 | 19755 | 42850 | 65945 |
| TDG | 19756 | 42851 | 65946 |
| TDGF1 | 19757 | 42852 | 65947 |
| TDO2 | 19758 | 42853 | 65948 |
| TDP1 | 19759 | 42854 | 65949 |
| TDP1 | 19760 | 42855 | 65950 |
| TDP2 | 19761 | 42856 | 65951 |
| TDRD1 | 19762 | 42857 | 65952 |
| TDRD10 | 19763 | 42858 | 65953 |
| TDRD10 | 19764 | 42859 | 65954 |
| TDRD12 | 19765 | 42860 | 65955 |
| TDRD15 | 19766 | 42861 | 65956 |
| TDRD3 | 19767 | 42862 | 65957 |
| TDRD5 | 19768 | 42863 | 65958 |
| TDRD6 | 19769 | 42864 | 65959 |
| TDRD7 | 19770 | 42865 | 65960 |
| TDRD9 | 19771 | 42866 | 65961 |
| TDRKH | 19772 | 42867 | 65962 |
| TDRP | 19773 | 42868 | 65963 |
| TDRP | 19774 | 42869 | 65964 |
| TEAD1 | 19775 | 42870 | 65965 |
| TEAD2 | 19776 | 42871 | 65966 |
| TEAD3 | 19777 | 42872 | 65967 |
| TEAD4 | 19778 | 42873 | 65968 |
| TEC | 19779 | 42874 | 65969 |
| TECPR1 | 19780 | 42875 | 65970 |
| TECPR2 | 19781 | 42876 | 65971 |
| TECPR2 | 19782 | 42877 | 65972 |
| TECR | 19783 | 42878 | 65973 |
| TECRL | 19784 | 42879 | 65974 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| TECTA | 19785 | 42880 | 65975 |
| TECTB | 19786 | 42881 | 65976 |
| TEDC1 | 19787 | 42882 | 65977 |
| TEDC2 | 19788 | 42883 | 65978 |
| TEDDM1 | 19789 | 42884 | 65979 |
| TEF | 19790 | 42885 | 65980 |
| TEFM | 19791 | 42886 | 65981 |
| TEK | 19792 | 42887 | 65982 |
| TEKT1 | 19793 | 42888 | 65983 |
| TEKT2 | 19794 | 42889 | 65984 |
| TEKT3 | 19795 | 42890 | 65985 |
| TEKT4 | 19796 | 42891 | 65986 |
| TEKT5 | 19797 | 42892 | 65987 |
| TELO2 | 19798 | 42893 | 65988 |
| TEN1 | 19799 | 42894 | 65989 |
| TENM1 | 19800 | 42895 | 65990 |
| TENM2 | 19801 | 42896 | 65991 |
| TENM3 | 19802 | 42897 | 65992 |
| TENM4 | 19803 | 42898 | 65993 |
| TEP1 | 19804 | 42899 | 65994 |
| TEPP | 19805 | 42900 | 65995 |
| TEPSIN | 19806 | 42901 | 65996 |
| TERB1 | 19807 | 42902 | 65997 |
| TERB2 | 19808 | 42903 | 65998 |
| TERF1 | 19809 | 42904 | 65999 |
| TERF2 | 19810 | 42905 | 66000 |
| TERF2IP | 19811 | 42906 | 66001 |
| TERT | 19812 | 42907 | 66002 |
| TES | 19813 | 42908 | 66003 |
| TESC | 19814 | 42909 | 66004 |
| TESK1 | 19815 | 42910 | 66005 |
| TESK2 | 19816 | 42911 | 66006 |
| TESMIN | 19817 | 42912 | 66007 |
| TESMIN | 19818 | 42913 | 66008 |
| TESPA1 | 19819 | 42914 | 66009 |
| TET1 | 19820 | 42915 | 66010 |
| TET2 | 19821 | 42916 | 66011 |
| TET2 | 19822 | 42917 | 66012 |
| TET3 | 19823 | 42918 | 66013 |
| TEX10 | 19824 | 42919 | 66014 |
| TEX101 | 19825 | 42920 | 66015 |
| TEX11 | 19826 | 42921 | 66016 |
| TEX12 | 19827 | 42922 | 66017 |
| TEX13A | 19828 | 42923 | 66018 |
| TEX13B | 19829 | 42924 | 66019 |
| TEX13C | 19830 | 42925 | 66020 |
| TEX14 | 19831 | 42926 | 66021 |
| TEX15 | 19832 | 42927 | 66022 |
| TEX19 | 19833 | 42928 | 66023 |
| TEX2 | 19834 | 42929 | 66024 |
| TEX22 | 19835 | 42930 | 66025 |
| TEX26 | 19836 | 42931 | 66026 |
| TEX261 | 19837 | 42932 | 66027 |
| TEX264 | 19838 | 42933 | 66028 |
| TEX28 | 19839 | 42934 | 66029 |
| TEX29 | 19840 | 42935 | 66030 |
| TEX30 | 19841 | 42936 | 66031 |
| TEX30 | 19842 | 42937 | 66032 |
| TEX33 | 19843 | 42938 | 66033 |
| TEX35 | 19844 | 42939 | 66034 |
| TEX35 | 19845 | 42940 | 66035 |
| TEX35 | 19846 | 42941 | 66036 |
| TEX36 | 19847 | 42942 | 66037 |
| TEX36 | 19848 | 42943 | 66038 |
| TEX37 | 19849 | 42944 | 66039 |
| TEX38 | 19850 | 42945 | 66040 |
| TEX43 | 19851 | 42946 | 66041 |
| TEX44 | 19852 | 42947 | 66042 |
| TEX45 | 19853 | 42948 | 66043 |
| TEX46 | 19854 | 42949 | 66044 |
| TEX47 | 19855 | 42950 | 66045 |
| TEX48 | 19856 | 42951 | 66046 |
| TEX49 | 19857 | 42952 | 66047 |
| TEX50 | 19858 | 42953 | 66048 |
| TEX51 | 19859 | 42954 | 66049 |
| TEX9 | 19860 | 42955 | 66050 |
| TF | 19861 | 42956 | 66051 |
| TFAM | 19862 | 42957 | 66052 |
| TFAP2A | 19863 | 42958 | 66053 |
| TFAP2B | 19864 | 42959 | 66054 |
| TFAP2C | 19865 | 42960 | 66055 |
| TFAP2D | 19866 | 42961 | 66056 |
| TFAP2E | 19867 | 42962 | 66057 |
| TFAP4 | 19868 | 42963 | 66058 |
| TFB1M | 19869 | 42964 | 66059 |
| TFB1M | 19870 | 42965 | 66060 |
| TFB2M | 19871 | 42966 | 66061 |
| TFCP2 | 19872 | 42967 | 66062 |
| TFCP2L1 | 19873 | 42968 | 66063 |
| TFDP1 | 19874 | 42969 | 66064 |
| TFDP2 | 19875 | 42970 | 66065 |
| TFDP3 | 19876 | 42971 | 66066 |
| TFE3 | 19877 | 42972 | 66067 |
| TFEB | 19878 | 42973 | 66068 |
| TFEC | 19879 | 42974 | 66069 |
| TFF1 | 19880 | 42975 | 66070 |
| TFF2 | 19881 | 42976 | 66071 |
| TFF3 | 19882 | 42977 | 66072 |
| TFG | 19883 | 42978 | 66073 |
| TFIP11 | 19884 | 42979 | 66074 |
| TFPI | 19885 | 42980 | 66075 |
| TFPI | 19886 | 42981 | 66076 |
| TFPI2 | 19887 | 42982 | 66077 |
| TFPI2 | 19888 | 42983 | 66078 |
| TFPT | 19889 | 42984 | 66079 |
| TFR2 | 19890 | 42985 | 66080 |
| TFRC | 19891 | 42986 | 66081 |
| TG | 19892 | 42987 | 66082 |
| TGDS | 19893 | 42988 | 66083 |
| TGFA | 19894 | 42989 | 66084 |
| TGFB1 | 19895 | 42990 | 66085 |
| TGFB1I1 | 19896 | 42991 | 66086 |
| TGFB2 | 19897 | 42992 | 66087 |
| TGFB3 | 19898 | 42993 | 66088 |
| TGFB3 | 19899 | 42994 | 66089 |
| TGFBI | 19900 | 42995 | 66090 |
| TGFBR1 | 19901 | 42996 | 66091 |
| TGFBR2 | 19902 | 42997 | 66092 |
| TGFBR3 | 19903 | 42998 | 66093 |
| TGFBR3L | 19904 | 42999 | 66094 |
| TGFBRAP1 | 19905 | 43000 | 66095 |
| TGFBRAP1 | 19906 | 43001 | 66096 |
| TGIF1 | 19907 | 43002 | 66097 |
| TGIF2 | 19908 | 43003 | 66098 |
| TGIF2LX | 19909 | 43004 | 66099 |
| TGIF2LY | 19910 | 43005 | 66100 |
| TGM1 | 19911 | 43006 | 66101 |
| TGM2 | 19912 | 43007 | 66102 |
| TGM2 | 19913 | 43008 | 66103 |
| TGM3 | 19914 | 43009 | 66104 |
| TGM4 | 19915 | 43010 | 66105 |
| TGM5 | 19916 | 43011 | 66106 |
| TGM6 | 19917 | 43012 | 66107 |
| TGM6 | 19918 | 43013 | 66108 |
| TGM7 | 19919 | 43014 | 66109 |
| TGOLN2 | 19920 | 43015 | 66110 |
| TGOLN2 | 19921 | 43016 | 66111 |
| TGOLN2 | 19922 | 43017 | 66112 |
| TGS1 | 19923 | 43018 | 66113 |
| TGS1 | 19924 | 43019 | 66114 |
| TH | 19925 | 43020 | 66115 |
| THADA | 19926 | 43021 | 66116 |
| THADA | 19927 | 43022 | 66117 |
| THADA | 19928 | 43023 | 66118 |
| THAP1 | 19929 | 43024 | 66119 |
| THAP10 | 19930 | 43025 | 66120 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| THAP11 | 19931 | 43026 | 66121 |
| THAP12 | 19932 | 43027 | 66122 |
| THAP2 | 19933 | 43028 | 66123 |
| THAP3 | 19934 | 43029 | 66124 |
| THAP3 | 19935 | 43030 | 66125 |
| THAP4 | 19936 | 43031 | 66126 |
| THAP5 | 19937 | 43032 | 66127 |
| THAP6 | 19938 | 43033 | 66128 |
| THAP7 | 19939 | 43034 | 66129 |
| THAP8 | 19940 | 43035 | 66130 |
| THAP9 | 19941 | 43036 | 66131 |
| THBD | 19942 | 43037 | 66132 |
| THBS1 | 19943 | 43038 | 66133 |
| THBS2 | 19944 | 43039 | 66134 |
| THBS3 | 19945 | 43040 | 66135 |
| THBS4 | 19946 | 43041 | 66136 |
| THEG | 19947 | 43042 | 66137 |
| THEG5 | 19948 | 43043 | 66138 |
| THEGL | 19949 | 43044 | 66139 |
| THEM4 | 19950 | 43045 | 66140 |
| THEM5 | 19951 | 43046 | 66141 |
| THEM6 | 19952 | 43047 | 66142 |
| THEMIS | 19953 | 43048 | 66143 |
| THEMIS2 | 19954 | 43049 | 66144 |
| THEMIS2 | 19955 | 43050 | 66145 |
| THG1L | 19956 | 43051 | 66146 |
| THNSL1 | 19957 | 43052 | 66147 |
| THNSL2 | 19958 | 43053 | 66148 |
| THNSL2 | 19959 | 43054 | 66149 |
| THNSL2 | 19960 | 43055 | 66150 |
| THOC1 | 19961 | 43056 | 66151 |
| THOC2 | 19962 | 43057 | 66152 |
| THOC3 | 19963 | 43058 | 66153 |
| THOC5 | 19964 | 43059 | 66154 |
| THOC6 | 19965 | 43060 | 66155 |
| THOC7 | 19966 | 43061 | 66156 |
| THOP1 | 19967 | 43062 | 66157 |
| THPO | 19968 | 43063 | 66158 |
| THPO | 19969 | 43064 | 66159 |
| THRA | 19970 | 43065 | 66160 |
| THRA | 19971 | 43066 | 66161 |
| THRAP3 | 19972 | 43067 | 66162 |
| THRB | 19973 | 43068 | 66163 |
| THRSP | 19974 | 43069 | 66164 |
| THSD1 | 19975 | 43070 | 66165 |
| THSD4 | 19976 | 43071 | 66166 |
| THSD7A | 19977 | 43072 | 66167 |
| THSD7B | 19978 | 43073 | 66168 |
| THTPA | 19979 | 43074 | 66169 |
| THTPA | 19980 | 43075 | 66170 |
| THUMPD1 | 19981 | 43076 | 66171 |
| THUMPD2 | 19982 | 43077 | 66172 |
| THUMPD2 | 19983 | 43078 | 66173 |
| THUMPD2 | 19984 | 43079 | 66174 |
| THUMPD2 | 19985 | 43080 | 66175 |
| THUMPD3 | 19986 | 43081 | 66176 |
| THY1 | 19987 | 43082 | 66177 |
| THYN1 | 19988 | 43083 | 66178 |
| THYN1 | 19989 | 43084 | 66179 |
| TIA1 | 19990 | 43085 | 66180 |
| TIA1 | 19991 | 43086 | 66181 |
| TIA1 | 19992 | 43087 | 66182 |
| TIA1 | 19993 | 43088 | 66183 |
| TIA1 | 19994 | 43089 | 66184 |
| TIA1 | 19995 | 43090 | 66185 |
| TIAF1 | 19996 | 43091 | 66186 |
| TIAL1 | 19997 | 43092 | 66187 |
| TIAM1 | 19998 | 43093 | 66188 |
| TIAM2 | 19999 | 43094 | 66189 |
| TICAM1 | 20000 | 43095 | 66190 |
| TICAM2 | 20001 | 43096 | 66191 |
| TICRR | 20002 | 43097 | 66192 |
| TIE1 | 20003 | 43098 | 66193 |
| TIFA | 20004 | 43099 | 66194 |
| TIFAB | 20005 | 43100 | 66195 |
| TIGAR | 20006 | 43101 | 66196 |
| TIGD1 | 20007 | 43102 | 66197 |
| TIGD2 | 20008 | 43103 | 66198 |
| TIGD3 | 20009 | 43104 | 66199 |
| TIGD4 | 20010 | 43105 | 66200 |
| TIGD5 | 20011 | 43106 | 66201 |
| TIGD6 | 20012 | 43107 | 66202 |
| TIGD7 | 20013 | 43108 | 66203 |
| TIGIT | 20014 | 43109 | 66204 |
| TIMD4 | 20015 | 43110 | 66205 |
| TIMELESS | 20016 | 43111 | 66206 |
| TIMM10 | 20017 | 43112 | 66207 |
| TIMM10B | 20018 | 43113 | 66208 |
| TIMM13 | 20019 | 43114 | 66209 |
| TIMM17A | 20020 | 43115 | 66210 |
| TIMM17B | 20021 | 43116 | 66211 |
| TIMM21 | 20022 | 43117 | 66212 |
| TIMM22 | 20023 | 43118 | 66213 |
| TIMM23 | 20024 | 43119 | 66214 |
| TIMM23B | 20025 | 43120 | 66215 |
| TIMM29 | 20026 | 43121 | 66216 |
| TIMM44 | 20027 | 43122 | 66217 |
| TIMM50 | 20028 | 43123 | 66218 |
| TIMM50 | 20029 | 43124 | 66219 |
| TIMM8A | 20030 | 43125 | 66220 |
| TIMM8A | 20031 | 43126 | 66221 |
| TIMM8B | 20032 | 43127 | 66222 |
| TIMM9 | 20033 | 43128 | 66223 |
| TIMMDC1 | 20034 | 43129 | 66224 |
| TIMP1 | 20035 | 43130 | 66225 |
| TIMP2 | 20036 | 43131 | 66226 |
| TIMP3 | 20037 | 43132 | 66227 |
| TIMP4 | 20038 | 43133 | 66228 |
| TINAG | 20039 | 43134 | 66229 |
| TINAGL1 | 20040 | 43135 | 66230 |
| TINF2 | 20041 | 43136 | 66231 |
| TINF2 | 20042 | 43137 | 66232 |
| TIPARP | 20043 | 43138 | 66233 |
| TIPIN | 20044 | 43139 | 66234 |
| TIPRL | 20045 | 43140 | 66235 |
| TIPRL | 20046 | 43141 | 66236 |
| TIRAP | 20047 | 43142 | 66237 |
| TIRAP | 20048 | 43143 | 66238 |
| TJAP1 | 20049 | 43144 | 66239 |
| TJP1 | 20050 | 43145 | 66240 |
| TJP2 | 20051 | 43146 | 66241 |
| TJP3 | 20052 | 43147 | 66242 |
| TK1 | 20053 | 43148 | 66243 |
| TK2 | 20054 | 43149 | 66244 |
| TK2 | 20055 | 43150 | 66245 |
| TKFC | 20056 | 43151 | 66246 |
| TKFC | 20057 | 43152 | 66247 |
| TKFC | 20058 | 43153 | 66248 |
| TKFC | 20059 | 43154 | 66249 |
| TKT | 20060 | 43155 | 66250 |
| TKTL1 | 20061 | 43156 | 66251 |
| TKTL2 | 20062 | 43157 | 66252 |
| TLCD1 | 20063 | 43158 | 66253 |
| TLCD2 | 20064 | 43159 | 66254 |
| TLDC1 | 20065 | 43160 | 66255 |
| TLDC2 | 20066 | 43161 | 66256 |
| TLE1 | 20067 | 43162 | 66257 |
| TLE2 | 20068 | 43163 | 66258 |
| TLE2 | 20069 | 43164 | 66259 |
| TLE3 | 20070 | 43165 | 66260 |
| TLE4 | 20071 | 43166 | 66261 |
| TLE6 | 20072 | 43167 | 66262 |
| TLK1 | 20073 | 43168 | 66263 |
| TLK2 | 20074 | 43169 | 66264 |
| TLL1 | 20075 | 43170 | 66265 |
| TLL1 | 20076 | 43171 | 66266 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| TLL2 | 20077 | 43172 | 66267 |
| TLN1 | 20078 | 43173 | 66268 |
| TLN2 | 20079 | 43174 | 66269 |
| TLNRD1 | 20080 | 43175 | 66270 |
| TLR1 | 20081 | 43176 | 66271 |
| TLR10 | 20082 | 43177 | 66272 |
| TLR2 | 20083 | 43178 | 66273 |
| TLR3 | 20084 | 43179 | 66274 |
| TLR4 | 20085 | 43180 | 66275 |
| TLR5 | 20086 | 43181 | 66276 |
| TLR6 | 20087 | 43182 | 66277 |
| TLR7 | 20088 | 43183 | 66278 |
| TLR8 | 20089 | 43184 | 66279 |
| TLR9 | 20090 | 43185 | 66280 |
| TLX1 | 20091 | 43186 | 66281 |
| TLX1 | 20092 | 43187 | 66282 |
| TLX2 | 20093 | 43188 | 66283 |
| TLX3 | 20094 | 43189 | 66284 |
| TM2D1 | 20095 | 43190 | 66285 |
| TM2D2 | 20096 | 43191 | 66286 |
| TM2D3 | 20097 | 43192 | 66287 |
| TM2D3 | 20098 | 43193 | 66288 |
| TM4SF1 | 20099 | 43194 | 66289 |
| TM4SF18 | 20100 | 43195 | 66290 |
| TM4SF19 | 20101 | 43196 | 66291 |
| TM4SF19 | 20102 | 43197 | 66292 |
| TM4SF20 | 20103 | 43198 | 66293 |
| TM4SF4 | 20104 | 43199 | 66294 |
| TM4SF5 | 20105 | 43200 | 66295 |
| TM6SF1 | 20106 | 43201 | 66296 |
| TM6SF1 | 20107 | 43202 | 66297 |
| TM6SF1 | 20108 | 43203 | 66298 |
| TM6SF2 | 20109 | 43204 | 66299 |
| TM7SF2 | 20110 | 43205 | 66300 |
| TM7SF3 | 20111 | 43206 | 66301 |
| TM9SF1 | 20112 | 43207 | 66302 |
| TM9SF1 | 20113 | 43208 | 66303 |
| TM9SF2 | 20114 | 43209 | 66304 |
| TM9SF3 | 20115 | 43210 | 66305 |
| TM9SF4 | 20116 | 43211 | 66306 |
| TMA16 | 20117 | 43212 | 66307 |
| TMA7 | 20118 | 43213 | 66308 |
| TMA7 | 20119 | 43214 | 66309 |
| TMBIM1 | 20120 | 43215 | 66310 |
| TMBIM1 | 20121 | 43216 | 66311 |
| TMBIM4 | 20122 | 43217 | 66312 |
| TMBIM4 | 20123 | 43218 | 66313 |
| TMBIM6 | 20124 | 43219 | 66314 |
| TMC1 | 20125 | 43220 | 66315 |
| TMC2 | 20126 | 43221 | 66316 |
| TMC3 | 20127 | 43222 | 66317 |
| TMC4 | 20128 | 43223 | 66318 |
| TMC5 | 20129 | 43224 | 66319 |
| TMC6 | 20130 | 43225 | 66320 |
| TMC7 | 20131 | 43226 | 66321 |
| TMC7 | 20132 | 43227 | 66322 |
| TMC8 | 20133 | 43228 | 66323 |
| TMCC1 | 20134 | 43229 | 66324 |
| TMCC2 | 20135 | 43230 | 66325 |
| TMCC3 | 20136 | 43231 | 66326 |
| TMCO1 | 20137 | 43232 | 66327 |
| TMCO2 | 20138 | 43233 | 66328 |
| TMCO3 | 20139 | 43234 | 66329 |
| TMCO3 | 20140 | 43235 | 66330 |
| TMCO3 | 20141 | 43236 | 66331 |
| TMCO4 | 20142 | 43237 | 66332 |
| TMCO4 | 20143 | 43238 | 66333 |
| TMCO5A | 20144 | 43239 | 66334 |
| TMCO5A | 20145 | 43240 | 66335 |
| TMCO6 | 20146 | 43241 | 66336 |
| TMED1 | 20147 | 43242 | 66337 |
| TMED10 | 20148 | 43243 | 66338 |
| TMED2 | 20149 | 43244 | 66339 |
| TMED3 | 20150 | 43245 | 66340 |
| TMED3 | 20151 | 43246 | 66341 |
| TMED3 | 20152 | 43247 | 66342 |
| TMED4 | 20153 | 43248 | 66343 |
| TMED4 | 20154 | 43249 | 66344 |
| TMED4 | 20155 | 43250 | 66345 |
| TMED5 | 20156 | 43251 | 66346 |
| TMED5 | 20157 | 43252 | 66347 |
| TMED6 | 20158 | 43253 | 66348 |
| TMED7 | 20159 | 43254 | 66349 |
| TMED8 | 20160 | 43255 | 66350 |
| TMED9 | 20161 | 43256 | 66351 |
| TMEFF1 | 20162 | 43257 | 66352 |
| TMEFF2 | 20163 | 43258 | 66353 |
| TMEFF2 | 20164 | 43259 | 66354 |
| TMEFF2 | 20165 | 43260 | 66355 |
| TMEM100 | 20166 | 43261 | 66356 |
| TMEM101 | 20167 | 43262 | 66357 |
| TMEM102 | 20168 | 43263 | 66358 |
| TMEM104 | 20169 | 43264 | 66359 |
| TMEM104 | 20170 | 43265 | 66360 |
| TMEM105 | 20171 | 43266 | 66361 |
| TMEM106A | 20172 | 43267 | 66362 |
| TMEM106B | 20173 | 43268 | 66363 |
| TMEM106C | 20174 | 43269 | 66364 |
| TMEM107 | 20175 | 43270 | 66365 |
| TMEM108 | 20176 | 43271 | 66366 |
| TMEM109 | 20177 | 43272 | 66367 |
| TMEM11 | 20178 | 43273 | 66368 |
| TMEM110 | 20179 | 43274 | 66369 |
| TMEM114 | 20180 | 43275 | 66370 |
| TMEM114 | 20181 | 43276 | 66371 |
| TMEM115 | 20182 | 43277 | 66372 |
| TMEM116 | 20183 | 43278 | 66373 |
| TMEM117 | 20184 | 43279 | 66374 |
| TMEM117 | 20185 | 43280 | 66375 |
| TMEM119 | 20186 | 43281 | 66376 |
| TMEM120A | 20187 | 43282 | 66377 |
| TMEM120A | 20188 | 43283 | 66378 |
| TMEM120B | 20189 | 43284 | 66379 |
| TMEM121 | 20190 | 43285 | 66380 |
| TMEM121 | 20191 | 43286 | 66381 |
| TMEM121B | 20192 | 43287 | 66382 |
| TMEM123 | 20193 | 43288 | 66383 |
| TMEM125 | 20194 | 43289 | 66384 |
| TMEM126A | 20195 | 43290 | 66385 |
| TMEM126B | 20196 | 43291 | 66386 |
| TMEM126B | 20197 | 43292 | 66387 |
| TMEM127 | 20198 | 43293 | 66388 |
| TMEM128 | 20199 | 43294 | 66389 |
| TMEM129 | 20200 | 43295 | 66390 |
| TMEM129 | 20201 | 43296 | 66391 |
| TMEM130 | 20202 | 43297 | 66392 |
| TMEM131 | 20203 | 43298 | 66393 |
| TMEM131L | 20204 | 43299 | 66394 |
| TMEM132A | 20205 | 43300 | 66395 |
| TMEM132B | 20206 | 43301 | 66396 |
| TMEM132C | 20207 | 43302 | 66397 |
| TMEM132D | 20208 | 43303 | 66398 |
| TMEM132E | 20209 | 43304 | 66399 |
| TMEM134 | 20210 | 43305 | 66400 |
| TMEM135 | 20211 | 43306 | 66401 |
| TMEM136 | 20212 | 43307 | 66402 |
| TMEM138 | 20213 | 43308 | 66403 |
| TMEM138 | 20214 | 43309 | 66404 |
| TMEM139 | 20215 | 43310 | 66405 |
| TMEM140 | 20216 | 43311 | 66406 |
| TMEM141 | 20217 | 43312 | 66407 |
| TMEM143 | 20218 | 43313 | 66408 |
| TMEM144 | 20219 | 43314 | 66409 |
| TMEM145 | 20220 | 43315 | 66410 |
| TMEM147 | 20221 | 43316 | 66411 |
| TMEM14A | 20222 | 43317 | 66412 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| TMEM14B | 20223 | 43318 | 66413 |
| TMEM14B | 20224 | 43319 | 66414 |
| TMEM14C | 20225 | 43320 | 66415 |
| TMEM150A | 20226 | 43321 | 66416 |
| TMEM150B | 20227 | 43322 | 66417 |
| TMEM150C | 20228 | 43323 | 66418 |
| TMEM151A | 20229 | 43324 | 66419 |
| TMEM151B | 20230 | 43325 | 66420 |
| TMEM154 | 20231 | 43326 | 66421 |
| TMEM155 | 20232 | 43327 | 66422 |
| TMEM155 | 20233 | 43328 | 66423 |
| TMEM156 | 20234 | 43329 | 66424 |
| TMEM158 | 20235 | 43330 | 66425 |
| TMEM159 | 20236 | 43331 | 66426 |
| TMEM159 | 20237 | 43332 | 66427 |
| TMEM160 | 20238 | 43333 | 66428 |
| TMEM161A | 20239 | 43334 | 66429 |
| TMEM161B | 20240 | 43335 | 66430 |
| TMEM161B | 20241 | 43336 | 66431 |
| TMEM161B | 20242 | 43337 | 66432 |
| TMEM163 | 20243 | 43338 | 66433 |
| TMEM164 | 20244 | 43339 | 66434 |
| TMEM164 | 20245 | 43340 | 66435 |
| TMEM165 | 20246 | 43341 | 66436 |
| TMEM167A | 20247 | 43342 | 66437 |
| TMEM167B | 20248 | 43343 | 66438 |
| TMEM167B | 20249 | 43344 | 66439 |
| TMEM168 | 20250 | 43345 | 66440 |
| TMEM169 | 20251 | 43346 | 66441 |
| TMEM17 | 20252 | 43347 | 66442 |
| TMEM170A | 20253 | 43348 | 66443 |
| TMEM170B | 20254 | 43349 | 66444 |
| TMEM171 | 20255 | 43350 | 66445 |
| TMEM173 | 20256 | 43351 | 66446 |
| TMEM173 | 20257 | 43352 | 66447 |
| TMEM174 | 20258 | 43353 | 66448 |
| TMEM175 | 20259 | 43354 | 66449 |
| TMEM176A | 20260 | 43355 | 66450 |
| TMEM176B | 20261 | 43356 | 66451 |
| TMEM177 | 20262 | 43357 | 66452 |
| TMEM178A | 20263 | 43358 | 66453 |
| TMEM178B | 20264 | 43359 | 66454 |
| TMEM179 | 20265 | 43360 | 66455 |
| TMEM179 | 20266 | 43361 | 66456 |
| TMEM179B | 20267 | 43362 | 66457 |
| TMEM18 | 20268 | 43363 | 66458 |
| TMEM181 | 20269 | 43364 | 66459 |
| TMEM182 | 20270 | 43365 | 66460 |
| TMEM183A | 20271 | 43366 | 66461 |
| TMEM183B | 20272 | 43367 | 66462 |
| TMEM184A | 20273 | 43368 | 66463 |
| TMEM184B | 20274 | 43369 | 66464 |
| TMEM184C | 20275 | 43370 | 66465 |
| TMEM185A | 20276 | 43371 | 66466 |
| TMEM185A | 20277 | 43372 | 66467 |
| TMEM185B | 20278 | 43373 | 66468 |
| TMEM186 | 20279 | 43374 | 66469 |
| TMEM187 | 20280 | 43375 | 66470 |
| TMEM189 | 20281 | 43376 | 66471 |
| TMEM19 | 20282 | 43377 | 66472 |
| TMEM190 | 20283 | 43378 | 66473 |
| TMEM191C | 20284 | 43379 | 66474 |
| TMEM192 | 20285 | 43380 | 66475 |
| TMEM196 | 20286 | 43381 | 66476 |
| TMEM198 | 20287 | 43382 | 66477 |
| TMEM199 | 20288 | 43383 | 66478 |
| TMEM2 | 20289 | 43384 | 66479 |
| TMEM200A | 20290 | 43385 | 66480 |
| TMEM200B | 20291 | 43386 | 66481 |
| TMEM200C | 20292 | 43387 | 66482 |
| TMEM201 | 20293 | 43388 | 66483 |
| TMEM201 | 20294 | 43389 | 66484 |
| TMEM202 | 20295 | 43390 | 66485 |
| TMEM203 | 20296 | 43391 | 66486 |
| TMEM204 | 20297 | 43392 | 66487 |
| TMEM205 | 20298 | 43393 | 66488 |
| TMEM206 | 20299 | 43394 | 66489 |
| TMEM207 | 20300 | 43395 | 66490 |
| TMEM208 | 20301 | 43396 | 66491 |
| TMEM209 | 20302 | 43397 | 66492 |
| TMEM210 | 20303 | 43398 | 66493 |
| TMEM211 | 20304 | 43399 | 66494 |
| TMEM212 | 20305 | 43400 | 66495 |
| TMEM213 | 20306 | 43401 | 66496 |
| TMEM214 | 20307 | 43402 | 66497 |
| TMEM215 | 20308 | 43403 | 66498 |
| TMEM216 | 20309 | 43404 | 66499 |
| TMEM216 | 20310 | 43405 | 66500 |
| TMEM217 | 20311 | 43406 | 66501 |
| TMEM217 | 20312 | 43407 | 66502 |
| TMEM217 | 20313 | 43408 | 66503 |
| TMEM218 | 20314 | 43409 | 66504 |
| TMEM219 | 20315 | 43410 | 66505 |
| TMEM220 | 20316 | 43411 | 66506 |
| TMEM221 | 20317 | 43412 | 66507 |
| TMEM222 | 20318 | 43413 | 66508 |
| TMEM223 | 20319 | 43414 | 66509 |
| TMEM225 | 20320 | 43415 | 66510 |
| TMEM225B | 20321 | 43416 | 66511 |
| TMEM229A | 20322 | 43417 | 66512 |
| TMEM229B | 20323 | 43418 | 66513 |
| TMEM230 | 20324 | 43419 | 66514 |
| TMEM230 | 20325 | 43420 | 66515 |
| TMEM231 | 20326 | 43421 | 66516 |
| TMEM232 | 20327 | 43422 | 66517 |
| TMEM233 | 20328 | 43423 | 66518 |
| TMEM234 | 20329 | 43424 | 66519 |
| TMEM235 | 20330 | 43425 | 66520 |
| TMEM235 | 20331 | 43426 | 66521 |
| TMEM236 | 20332 | 43427 | 66522 |
| TMEM237 | 20333 | 43428 | 66523 |
| TMEM238 | 20334 | 43429 | 66524 |
| TMEM239 | 20335 | 43430 | 66525 |
| TMEM240 | 20336 | 43431 | 66526 |
| TMEM241 | 20337 | 43432 | 66527 |
| TMEM242 | 20338 | 43433 | 66528 |
| TMEM243 | 20339 | 43434 | 66529 |
| TMEM244 | 20340 | 43435 | 66530 |
| TMEM245 | 20341 | 43436 | 66531 |
| TMEM246 | 20342 | 43437 | 66532 |
| TMEM247 | 20343 | 43438 | 66533 |
| TMEM248 | 20344 | 43439 | 66534 |
| TMEM249 | 20345 | 43440 | 66535 |
| TMEM249 | 20346 | 43441 | 66536 |
| TMEM25 | 20347 | 43442 | 66537 |
| TMEM25 | 20348 | 43443 | 66538 |
| TMEM25 | 20349 | 43444 | 66539 |
| TMEM250 | 20350 | 43445 | 66540 |
| TMEM251 | 20351 | 43446 | 66541 |
| TMEM252 | 20352 | 43447 | 66542 |
| TMEM253 | 20353 | 43448 | 66543 |
| TMEM254 | 20354 | 43449 | 66544 |
| TMEM254 | 20355 | 43450 | 66545 |
| TMEM254 | 20356 | 43451 | 66546 |
| TMEM255A | 20357 | 43452 | 66547 |
| TMEM255B | 20358 | 43453 | 66548 |
| TMEM256 | 20359 | 43454 | 66549 |
| TMEM258 | 20360 | 43455 | 66550 |
| TMEM259 | 20361 | 43456 | 66551 |
| TMEM259 | 20362 | 43457 | 66552 |
| TMEM26 | 20363 | 43458 | 66553 |
| TMEM260 | 20364 | 43459 | 66554 |
| TMEM262 | 20365 | 43460 | 66555 |
| TMEM262 | 20366 | 43461 | 66556 |
| TMEM263 | 20367 | 43462 | 66557 |
| TMEM265 | 20368 | 43463 | 66558 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| TMEM266 | 20369 | 43464 | 66559 |
| TMEM267 | 20370 | 43465 | 66560 |
| TMEM268 | 20371 | 43466 | 66561 |
| TMEM269 | 20372 | 43467 | 66562 |
| TMEM27 | 20373 | 43468 | 66563 |
| TMEM270 | 20374 | 43469 | 66564 |
| TMEM272 | 20375 | 43470 | 66565 |
| TMEM272 | 20376 | 43471 | 66566 |
| TMEM30A | 20377 | 43472 | 66567 |
| TMEM30B | 20378 | 43473 | 66568 |
| TMEM31 | 20379 | 43474 | 66569 |
| TMEM33 | 20380 | 43475 | 66570 |
| TMEM35A | 20381 | 43476 | 66571 |
| TMEM35B | 20382 | 43477 | 66572 |
| TMEM37 | 20383 | 43478 | 66573 |
| TMEM38A | 20384 | 43479 | 66574 |
| TMEM38B | 20385 | 43480 | 66575 |
| TMEM39A | 20386 | 43481 | 66576 |
| TMEM39B | 20387 | 43482 | 66577 |
| TMEM40 | 20388 | 43483 | 66578 |
| TMEM41A | 20389 | 43484 | 66579 |
| TMEM41B | 20390 | 43485 | 66580 |
| TMEM41B | 20391 | 43486 | 66581 |
| TMEM42 | 20392 | 43487 | 66582 |
| TMEM43 | 20393 | 43488 | 66583 |
| TMEM44 | 20394 | 43489 | 66584 |
| TMEM44 | 20395 | 43490 | 66585 |
| TMEM45A | 20396 | 43491 | 66586 |
| TMEM45B | 20397 | 43492 | 66587 |
| TMEM47 | 20398 | 43493 | 66588 |
| TMEM5 | 20399 | 43494 | 66589 |
| TMEM50A | 20400 | 43495 | 66590 |
| TMEM50B | 20401 | 43496 | 66591 |
| TMEM51 | 20402 | 43497 | 66592 |
| TMEM51 | 20403 | 43498 | 66593 |
| TMEM52 | 20404 | 43499 | 66594 |
| TMEM52B | 20405 | 43500 | 66595 |
| TMEM53 | 20406 | 43501 | 66596 |
| TMEM54 | 20407 | 43502 | 66597 |
| TMEM56 | 20408 | 43503 | 66598 |
| TMEM56-RWDD3 | 20409 | 43504 | 66599 |
| TMEM57 | 20410 | 43505 | 66600 |
| TMEM59 | 20411 | 43506 | 66601 |
| TMEM59 | 20412 | 43507 | 66602 |
| TMEM59L | 20413 | 43508 | 66603 |
| TMEM60 | 20414 | 43509 | 66604 |
| TMEM61 | 20415 | 43510 | 66605 |
| TMEM62 | 20416 | 43511 | 66606 |
| TMEM63A | 20417 | 43512 | 66607 |
| TMEM63B | 20418 | 43513 | 66608 |
| TMEM63C | 20419 | 43514 | 66609 |
| TMEM64 | 20420 | 43515 | 66610 |
| TMEM65 | 20421 | 43516 | 66611 |
| TMEM67 | 20422 | 43517 | 66612 |
| TMEM68 | 20423 | 43518 | 66613 |
| TMEM68 | 20424 | 43519 | 66614 |
| TMEM68 | 20425 | 43520 | 66615 |
| TMEM69 | 20426 | 43521 | 66616 |
| TMEM70 | 20427 | 43522 | 66617 |
| TMEM70 | 20428 | 43523 | 66618 |
| TMEM71 | 20429 | 43524 | 66619 |
| TMEM72 | 20430 | 43525 | 66620 |
| TMEM74 | 20431 | 43526 | 66621 |
| TMEM74B | 20432 | 43527 | 66622 |
| TMEM79 | 20433 | 43528 | 66623 |
| TMEM80 | 20434 | 43529 | 66624 |
| TMEM80 | 20435 | 43530 | 66625 |
| TMEM80 | 20436 | 43531 | 66626 |
| TMEM81 | 20437 | 43532 | 66627 |
| TMEM82 | 20438 | 43533 | 66628 |
| TMEM86A | 20439 | 43534 | 66629 |
| TMEM86B | 20440 | 43535 | 66630 |
| TMEM87A | 20441 | 43536 | 66631 |
| TMEM87A | 20442 | 43537 | 66632 |
| TMEM87B | 20443 | 43538 | 66633 |
| TMEM88 | 20444 | 43539 | 66634 |
| TMEM88 | 20445 | 43540 | 66635 |
| TMEM88B | 20446 | 43541 | 66636 |
| TMEM89 | 20447 | 43542 | 66637 |
| TMEM8A | 20448 | 43543 | 66638 |
| TMEM8B | 20449 | 43544 | 66639 |
| TMEM8B | 20450 | 43545 | 66640 |
| TMEM9 | 20451 | 43546 | 66641 |
| TMEM91 | 20452 | 43547 | 66642 |
| TMEM91 | 20453 | 43548 | 66643 |
| TMEM91 | 20454 | 43549 | 66644 |
| TMEM91 | 20455 | 43550 | 66645 |
| TMEM92 | 20456 | 43551 | 66646 |
| TMEM94 | 20457 | 43552 | 66647 |
| TMEM95 | 20458 | 43553 | 66648 |
| TMEM95 | 20459 | 43554 | 66649 |
| TMEM97 | 20460 | 43555 | 66650 |
| TMEM98 | 20461 | 43556 | 66651 |
| TMEM99 | 20462 | 43557 | 66652 |
| TMEM9B | 20463 | 43558 | 66653 |
| TMF1 | 20464 | 43559 | 66654 |
| TMIE | 20465 | 43560 | 66655 |
| TMIGD1 | 20466 | 43561 | 66656 |
| TMIGD1 | 20467 | 43562 | 66657 |
| TMIGD2 | 20468 | 43563 | 66658 |
| TMIGD2 | 20469 | 43564 | 66659 |
| TMIGD3 | 20470 | 43565 | 66660 |
| TMLHE | 20471 | 43566 | 66661 |
| TMLHE | 20472 | 43567 | 66662 |
| TMOD1 | 20473 | 43568 | 66663 |
| TMOD2 | 20474 | 43569 | 66664 |
| TMOD3 | 20475 | 43570 | 66665 |
| TMOD4 | 20476 | 43571 | 66666 |
| TMPO | 20477 | 43572 | 66667 |
| TMPO | 20478 | 43573 | 66668 |
| TMPPE | 20479 | 43574 | 66669 |
| TMPRSS11A | 20480 | 43575 | 66670 |
| TMPRSS11B | 20481 | 43576 | 66671 |
| TMPRSS11D | 20482 | 43577 | 66672 |
| TMPRSS11E | 20483 | 43578 | 66673 |
| TMPRSS11F | 20484 | 43579 | 66674 |
| TMPRSS12 | 20485 | 43580 | 66675 |
| TMPRSS13 | 20486 | 43581 | 66676 |
| TMPRSS13 | 20487 | 43582 | 66677 |
| TMPRSS15 | 20488 | 43583 | 66678 |
| TMPRSS2 | 20489 | 43584 | 66679 |
| TMPRSS3 | 20490 | 43585 | 66680 |
| TMPRSS3 | 20491 | 43586 | 66681 |
| TMPRSS4 | 20492 | 43587 | 66682 |
| TMPRSS5 | 20493 | 43588 | 66683 |
| TMPRSS6 | 20494 | 43589 | 66684 |
| TMPRSS7 | 20495 | 43590 | 66685 |
| TMPRSS9 | 20496 | 43591 | 66686 |
| TMSB10 | 20497 | 43592 | 66687 |
| TMSB15A | 20498 | 43593 | 66688 |
| TMSB15B | 20499 | 43594 | 66689 |
| TMSB15B | 20500 | 43595 | 66690 |
| TMSB15B | 20501 | 43596 | 66691 |
| TMSB4X | 20502 | 43597 | 66692 |
| TMSB4Y | 20503 | 43598 | 66693 |
| TMTC1 | 20504 | 43599 | 66694 |
| TMTC2 | 20505 | 43600 | 66695 |
| TMTC2 | 20506 | 43601 | 66696 |
| TMTC3 | 20507 | 43602 | 66697 |
| TMTC4 | 20508 | 43603 | 66698 |
| TMUB1 | 20509 | 43604 | 66699 |
| TMUB2 | 20510 | 43605 | 66700 |
| TMUB2 | 20511 | 43606 | 66701 |
| TMX1 | 20512 | 43607 | 66702 |
| TMX2 | 20513 | 43608 | 66703 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| TMX2 | 20514 | 43609 | 66704 |
| TMX3 | 20515 | 43610 | 66705 |
| TMX3 | 20516 | 43611 | 66706 |
| TMX3 | 20517 | 43612 | 66707 |
| TMX4 | 20518 | 43613 | 66708 |
| TNC | 20519 | 43614 | 66709 |
| TNF | 20520 | 43615 | 66710 |
| TNFAIP1 | 20521 | 43616 | 66711 |
| TNFAIP2 | 20522 | 43617 | 66712 |
| TNFAIP3 | 20523 | 43618 | 66713 |
| TNFAIP6 | 20524 | 43619 | 66714 |
| TNFAIP8 | 20525 | 43620 | 66715 |
| TNFAIP8L1 | 20526 | 43621 | 66716 |
| TNFAIP8L2 | 20527 | 43622 | 66717 |
| TNFAIP8L3 | 20528 | 43623 | 66718 |
| TNFRSF10A | 20529 | 43624 | 66719 |
| TNFRSF10B | 20530 | 43625 | 66720 |
| TNFRSF10C | 20531 | 43626 | 66721 |
| TNFRSF10D | 20532 | 43627 | 66722 |
| TNFRSF11A | 20533 | 43628 | 66723 |
| TNFRSF11A | 20534 | 43629 | 66724 |
| TNFRSF11B | 20535 | 43630 | 66725 |
| TNFRSF12A | 20536 | 43631 | 66726 |
| TNFRSF13B | 20537 | 43632 | 66727 |
| TNFRSF13C | 20538 | 43633 | 66728 |
| TNFRSF14 | 20539 | 43634 | 66729 |
| TNFRSF14 | 20540 | 43635 | 66730 |
| TNFRSF17 | 20541 | 43636 | 66731 |
| TNFRSF18 | 20542 | 43637 | 66732 |
| TNFRSF18 | 20543 | 43638 | 66733 |
| TNFRSF19 | 20544 | 43639 | 66734 |
| TNFRSF19 | 20545 | 43640 | 66735 |
| TNFRSF1A | 20546 | 43641 | 66736 |
| TNFRSF1B | 20547 | 43642 | 66737 |
| TNFRSF21 | 20548 | 43643 | 66738 |
| TNFRSF25 | 20549 | 43644 | 66739 |
| TNFRSF25 | 20550 | 43645 | 66740 |
| TNFRSF4 | 20551 | 43646 | 66741 |
| TNFRSF6B | 20552 | 43647 | 66742 |
| TNFRSF8 | 20553 | 43648 | 66743 |
| TNFRSF9 | 20554 | 43649 | 66744 |
| TNFSF10 | 20555 | 43650 | 66745 |
| TNFSF10 | 20556 | 43651 | 66746 |
| TNFSF10 | 20557 | 43652 | 66747 |
| TNFSF11 | 20558 | 43653 | 66748 |
| TNFSF12 | 20559 | 43654 | 66749 |
| TNFSF13 | 20560 | 43655 | 66750 |
| TNFSF13 | 20561 | 43656 | 66751 |
| TNFSF13B | 20562 | 43657 | 66752 |
| TNFSF14 | 20563 | 43658 | 66753 |
| TNFSF15 | 20564 | 43659 | 66754 |
| TNFSF18 | 20565 | 43660 | 66755 |
| TNFSF4 | 20566 | 43661 | 66756 |
| TNFSF8 | 20567 | 43662 | 66757 |
| TNFSF8 | 20568 | 43663 | 66758 |
| TNFSF9 | 20569 | 43664 | 66759 |
| TNIK | 20570 | 43665 | 66760 |
| TNIP1 | 20571 | 43666 | 66761 |
| TNIP1 | 20572 | 43667 | 66762 |
| TNIP1 | 20573 | 43668 | 66763 |
| TNIP1 | 20574 | 43669 | 66764 |
| TNIP2 | 20575 | 43670 | 66765 |
| TNIP3 | 20576 | 43671 | 66766 |
| TNIP3 | 20577 | 43672 | 66767 |
| TNK1 | 20578 | 43673 | 66768 |
| TNK2 | 20579 | 43674 | 66769 |
| TNKS | 20580 | 43675 | 66770 |
| TNKS1BP1 | 20581 | 43676 | 66771 |
| TNKS2 | 20582 | 43677 | 66772 |
| TNMD | 20583 | 43678 | 66773 |
| TNN | 20584 | 43679 | 66774 |
| TNNC1 | 20585 | 43680 | 66775 |
| TNNC2 | 20586 | 43681 | 66776 |
| TNNI1 | 20587 | 43682 | 66777 |
| TNNI2 | 20588 | 43683 | 66778 |
| TNNI3 | 20589 | 43684 | 66779 |
| TNNI3K | 20590 | 43685 | 66780 |
| TNNT1 | 20591 | 43686 | 66781 |
| TNNT2 | 20592 | 43687 | 66782 |
| TNNT3 | 20593 | 43688 | 66783 |
| TNP1 | 20594 | 43689 | 66784 |
| TNP2 | 20595 | 43690 | 66785 |
| TNPO1 | 20596 | 43691 | 66786 |
| TNPO2 | 20597 | 43692 | 66787 |
| TNPO3 | 20598 | 43693 | 66788 |
| TNR | 20599 | 43694 | 66789 |
| TNRC18 | 20600 | 43695 | 66790 |
| TNRC6A | 20601 | 43696 | 66791 |
| TNRC6B | 20602 | 43697 | 66792 |
| TNRC6C | 20603 | 43698 | 66793 |
| TNS1 | 20604 | 43699 | 66794 |
| TNS2 | 20605 | 43700 | 66795 |
| TNS3 | 20606 | 43701 | 66796 |
| TNS4 | 20607 | 43702 | 66797 |
| TNXB | 20608 | 43703 | 66798 |
| TOB1 | 20609 | 43704 | 66799 |
| TOB2 | 20610 | 43705 | 66800 |
| TOE1 | 20611 | 43706 | 66801 |
| TOGARAM1 | 20612 | 43707 | 66802 |
| TOGARAM2 | 20613 | 43708 | 66803 |
| TOLLIP | 20614 | 43709 | 66804 |
| TOLLIP | 20615 | 43710 | 66805 |
| TOM1 | 20616 | 43711 | 66806 |
| TOM1L1 | 20617 | 43712 | 66807 |
| TOM1L1 | 20618 | 43713 | 66808 |
| TOM1L2 | 20619 | 43714 | 66809 |
| TOMM20 | 20620 | 43715 | 66810 |
| TOMM20L | 20621 | 43716 | 66811 |
| TOMM22 | 20622 | 43717 | 66812 |
| TOMM34 | 20623 | 43718 | 66813 |
| TOMM40 | 20624 | 43719 | 66814 |
| TOMM40L | 20625 | 43720 | 66815 |
| TOMM5 | 20626 | 43721 | 66816 |
| TOMM5 | 20627 | 43722 | 66817 |
| TOMM5 | 20628 | 43723 | 66818 |
| TOMM6 | 20629 | 43724 | 66819 |
| TOMM7 | 20630 | 43725 | 66820 |
| TOMM70 | 20631 | 43726 | 66821 |
| TONSL | 20632 | 43727 | 66822 |
| TOP1 | 20633 | 43728 | 66823 |
| TOP1MT | 20634 | 43729 | 66824 |
| TOP2A | 20635 | 43730 | 66825 |
| TOP2B | 20636 | 43731 | 66826 |
| TOP3A | 20637 | 43732 | 66827 |
| TOP3B | 20638 | 43733 | 66828 |
| TOP3B | 20639 | 43734 | 66829 |
| TOPAZ1 | 20640 | 43735 | 66830 |
| TOPBP1 | 20641 | 43736 | 66831 |
| TOPORS | 20642 | 43737 | 66832 |
| TOR1A | 20643 | 43738 | 66833 |
| TOR1AIP1 | 20644 | 43739 | 66834 |
| TOR1AIP2 | 20645 | 43740 | 66835 |
| TOR1AIP2 | 20646 | 43741 | 66836 |
| TOR1B | 20647 | 43742 | 66837 |
| TOR1B | 20648 | 43743 | 66838 |
| TOR1B | 20649 | 43744 | 66839 |
| TOR2A | 20650 | 43745 | 66840 |
| TOR2A | 20651 | 43746 | 66841 |
| TOR2A | 20652 | 43747 | 66842 |
| TOR3A | 20653 | 43748 | 66843 |
| TOR4A | 20654 | 43749 | 66844 |
| TOX | 20655 | 43750 | 66845 |
| TOX2 | 20656 | 43751 | 66846 |
| TOX3 | 20657 | 43752 | 66847 |
| TOX4 | 20658 | 43753 | 66848 |
| TP53 | 20659 | 43754 | 66849 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| TP53 | 20660 | 43755 | 66850 |
| TP53 | 20661 | 43756 | 66851 |
| TP53AIP1 | 20662 | 43757 | 66852 |
| TP53AIP1 | 20663 | 43758 | 66853 |
| TP53AIP1 | 20664 | 43759 | 66854 |
| TP53BP1 | 20665 | 43760 | 66855 |
| TP53BP2 | 20666 | 43761 | 66856 |
| TP53I11 | 20667 | 43762 | 66857 |
| TP53I11 | 20668 | 43763 | 66858 |
| TP53I11 | 20669 | 43764 | 66859 |
| TP53I13 | 20670 | 43765 | 66860 |
| TP53I3 | 20671 | 43766 | 66861 |
| TP53I3 | 20672 | 43767 | 66862 |
| TP53INP1 | 20673 | 43768 | 66863 |
| TP53INP1 | 20674 | 43769 | 66864 |
| TP53INP2 | 20675 | 43770 | 66865 |
| TP53RK | 20676 | 43771 | 66866 |
| TP53TG3E | 20677 | 43772 | 66867 |
| TP53TG5 | 20678 | 43773 | 66868 |
| TP63 | 20679 | 43774 | 66869 |
| TP63 | 20680 | 43775 | 66870 |
| TP63 | 20681 | 43776 | 66871 |
| TP63 | 20682 | 43777 | 66872 |
| TP73 | 20683 | 43778 | 66873 |
| TP73 | 20684 | 43779 | 66874 |
| TP73 | 20685 | 43780 | 66875 |
| TPBG | 20686 | 43781 | 66876 |
| TPBGL | 20687 | 43782 | 66877 |
| TPCN1 | 20688 | 43783 | 66878 |
| TPCN2 | 20689 | 43784 | 66879 |
| TPD52 | 20690 | 43785 | 66880 |
| TPD52 | 20691 | 43786 | 66881 |
| TPD52L1 | 20692 | 43787 | 66882 |
| TPD52L1 | 20693 | 43788 | 66883 |
| TPD52L1 | 20694 | 43789 | 66884 |
| TPD52L2 | 20695 | 43790 | 66885 |
| TPD52L2 | 20696 | 43791 | 66886 |
| TPD52L3 | 20697 | 43792 | 66887 |
| TPD52L3 | 20698 | 43793 | 66888 |
| TPD52L3 | 20699 | 43794 | 66889 |
| TPGS1 | 20700 | 43795 | 66890 |
| TPGS2 | 20701 | 43796 | 66891 |
| TPGS2 | 20702 | 43797 | 66892 |
| TPGS2 | 20703 | 43798 | 66893 |
| TPGS2 | 20704 | 43799 | 66894 |
| TPGS2 | 20705 | 43800 | 66895 |
| TPGS2 | 20706 | 43801 | 66896 |
| TPGS2 | 20707 | 43802 | 66897 |
| TPH1 | 20708 | 43803 | 66898 |
| TPH2 | 20709 | 43804 | 66899 |
| TPI1 | 20710 | 43805 | 66900 |
| TPK1 | 20711 | 43806 | 66901 |
| TPK1 | 20712 | 43807 | 66902 |
| TPM1 | 20713 | 43808 | 66903 |
| TPM1 | 20714 | 43809 | 66904 |
| TPM1 | 20715 | 43810 | 66905 |
| TPM1 | 20716 | 43811 | 66906 |
| TPM2 | 20717 | 43812 | 66907 |
| TPM2 | 20718 | 43813 | 66908 |
| TPM3 | 20719 | 43814 | 66909 |
| TPM3 | 20720 | 43815 | 66910 |
| TPM3 | 20721 | 43816 | 66911 |
| TPM4 | 20722 | 43817 | 66912 |
| TPMT | 20723 | 43818 | 66913 |
| TPMT | 20724 | 43819 | 66914 |
| TPO | 20725 | 43820 | 66915 |
| TPP1 | 20726 | 43821 | 66916 |
| TPP2 | 20727 | 43822 | 66917 |
| TPPP | 20728 | 43823 | 66918 |
| TPPP2 | 20729 | 43824 | 66919 |
| TPPP3 | 20730 | 43825 | 66920 |
| TPR | 20731 | 43826 | 66921 |
| TPRA1 | 20732 | 43827 | 66922 |
| TPRA1 | 20733 | 43828 | 66923 |
| TPRG1 | 20734 | 43829 | 66924 |
| TPRG1L | 20735 | 43830 | 66925 |
| TPRKB | 20736 | 43831 | 66926 |
| TPRN | 20737 | 43832 | 66927 |
| TPRX1 | 20738 | 43833 | 66928 |
| TPSAB1 | 20739 | 43834 | 66929 |
| TPSD1 | 20740 | 43835 | 66930 |
| TPSG1 | 20741 | 43836 | 66931 |
| TPST1 | 20742 | 43837 | 66932 |
| TPST2 | 20743 | 43838 | 66933 |
| TPT1 | 20744 | 43839 | 66934 |
| TPT1 | 20745 | 43840 | 66935 |
| TPTE | 20746 | 43841 | 66936 |
| TPTE2 | 20747 | 43842 | 66937 |
| TPX2 | 20748 | 43843 | 66938 |
| TRA2A | 20749 | 43844 | 66939 |
| TRA2B | 20750 | 43845 | 66940 |
| TRABD | 20751 | 43846 | 66941 |
| TRABD | 20752 | 43847 | 66942 |
| TRABD2A | 20753 | 43848 | 66943 |
| TRABD2A | 20754 | 43849 | 66944 |
| TRABD2B | 20755 | 43850 | 66945 |
| TRADD | 20756 | 43851 | 66946 |
| TRAF1 | 20757 | 43852 | 66947 |
| TRAF2 | 20758 | 43853 | 66948 |
| TRAF3 | 20759 | 43854 | 66949 |
| TRAF3IP1 | 20760 | 43855 | 66950 |
| TRAF3IP2 | 20761 | 43856 | 66951 |
| TRAF3IP3 | 20762 | 43857 | 66952 |
| TRAF3IP3 | 20763 | 43858 | 66953 |
| TRAF4 | 20764 | 43859 | 66954 |
| TRAF5 | 20765 | 43860 | 66955 |
| TRAF6 | 20766 | 43861 | 66956 |
| TRAF7 | 20767 | 43862 | 66957 |
| TRAFD1 | 20768 | 43863 | 66958 |
| TRAIP | 20769 | 43864 | 66959 |
| TRAK1 | 20770 | 43865 | 66960 |
| TRAK1 | 20771 | 43866 | 66961 |
| TRAK1 | 20772 | 43867 | 66962 |
| TRAK1 | 20773 | 43868 | 66963 |
| TRAK2 | 20774 | 43869 | 66964 |
| TRAM1 | 20775 | 43870 | 66965 |
| TRAM1L1 | 20776 | 43871 | 66966 |
| TRAM2 | 20777 | 43872 | 66967 |
| TRANK1 | 20778 | 43873 | 66968 |
| TRAP1 | 20779 | 43874 | 66969 |
| TRAPPC1 | 20780 | 43875 | 66970 |
| TRAPPC10 | 20781 | 43876 | 66971 |
| TRAPPC11 | 20782 | 43877 | 66972 |
| TRAPPC11 | 20783 | 43878 | 66973 |
| TRAPPC12 | 20784 | 43879 | 66974 |
| TRAPPC13 | 20785 | 43880 | 66975 |
| TRAPPC2 | 20786 | 43881 | 66976 |
| TRAPPC2L | 20787 | 43882 | 66977 |
| TRAPPC3 | 20788 | 43883 | 66978 |
| TRAPPC3L | 20789 | 43884 | 66979 |
| TRAPPC4 | 20790 | 43885 | 66980 |
| TRAPPC4 | 20791 | 43886 | 66981 |
| TRAPPC4 | 20792 | 43887 | 66982 |
| TRAPPC5 | 20793 | 43888 | 66983 |
| TRAPPC6A | 20794 | 43889 | 66984 |
| TRAPPC6A | 20795 | 43890 | 66985 |
| TRAPPC6B | 20796 | 43891 | 66986 |
| TRAPPC8 | 20797 | 43892 | 66987 |
| TRAPPC9 | 20798 | 43893 | 66988 |
| TRAT1 | 20799 | 43894 | 66989 |
| TRDMT1 | 20800 | 43895 | 66990 |
| TRDMT1 | 20801 | 43896 | 66991 |
| TRDN | 20802 | 43897 | 66992 |
| TRDN | 20803 | 43898 | 66993 |
| TRDN | 20804 | 43899 | 66994 |
| TRDN | 20805 | 43900 | 66995 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| TRDN | 20806 | 43901 | 66996 |
| TREH | 20807 | 43902 | 66997 |
| TREM1 | 20808 | 43903 | 66998 |
| TREM1 | 20809 | 43904 | 66999 |
| TREM1 | 20810 | 43905 | 67000 |
| TREM2 | 20811 | 43906 | 67001 |
| TREM2 | 20812 | 43907 | 67002 |
| TREML1 | 20813 | 43908 | 67003 |
| TREML1 | 20814 | 43909 | 67004 |
| TREML2 | 20815 | 43910 | 67005 |
| TREML4 | 20816 | 43911 | 67006 |
| TRERF1 | 20817 | 43912 | 67007 |
| TREX1 | 20818 | 43913 | 67008 |
| TREX2 | 20819 | 43914 | 67009 |
| TRH | 20820 | 43915 | 67010 |
| TRHDE | 20821 | 43916 | 67011 |
| TRHR | 20822 | 43917 | 67012 |
| TRIAP1 | 20823 | 43918 | 67013 |
| TRIB1 | 20824 | 43919 | 67014 |
| TRIB2 | 20825 | 43920 | 67015 |
| TRIB3 | 20826 | 43921 | 67016 |
| TRIL | 20827 | 43922 | 67017 |
| TRIM10 | 20828 | 43923 | 67018 |
| TRIM10 | 20829 | 43924 | 67019 |
| TRIM11 | 20830 | 43925 | 67020 |
| TRIM13 | 20831 | 43926 | 67021 |
| TRIM14 | 20832 | 43927 | 67022 |
| TRIM15 | 20833 | 43928 | 67023 |
| TRIM16L | 20834 | 43929 | 67024 |
| TRIM16L | 20835 | 43930 | 67025 |
| TRIM16L | 20836 | 43931 | 67026 |
| TRIM17 | 20837 | 43932 | 67027 |
| TRIM17 | 20838 | 43933 | 67028 |
| TRIM2 | 20839 | 43934 | 67029 |
| TRIM2 | 20840 | 43935 | 67030 |
| TRIM21 | 20841 | 43936 | 67031 |
| TRIM22 | 20842 | 43937 | 67032 |
| TRIM23 | 20843 | 43938 | 67033 |
| TRIM23 | 20844 | 43939 | 67034 |
| TRIM23 | 20845 | 43940 | 67035 |
| TRIM24 | 20846 | 43941 | 67036 |
| TRIM25 | 20847 | 43942 | 67037 |
| TRIM26 | 20848 | 43943 | 67038 |
| TRIM27 | 20849 | 43944 | 67039 |
| TRIM28 | 20850 | 43945 | 67040 |
| TRIM29 | 20851 | 43946 | 67041 |
| TRIM3 | 20852 | 43947 | 67042 |
| TRIM31 | 20853 | 43948 | 67043 |
| TRIM32 | 20854 | 43949 | 67044 |
| TRIM33 | 20855 | 43950 | 67045 |
| TRIM34 | 20856 | 43951 | 67046 |
| TRIM35 | 20857 | 43952 | 67047 |
| TRIM35 | 20858 | 43953 | 67048 |
| TRIM36 | 20859 | 43954 | 67049 |
| TRIM36 | 20860 | 43955 | 67050 |
| TRIM37 | 20861 | 43956 | 67051 |
| TRIM38 | 20862 | 43957 | 67052 |
| TRIM39 | 20863 | 43958 | 67053 |
| TRIM4 | 20864 | 43959 | 67054 |
| TRIM40 | 20865 | 43960 | 67055 |
| TRIM41 | 20866 | 43961 | 67056 |
| TRIM41 | 20867 | 43962 | 67057 |
| TRIM42 | 20868 | 43963 | 67058 |
| TRIM43 | 20869 | 43964 | 67059 |
| TRIM44 | 20870 | 43965 | 67060 |
| TRIM45 | 20871 | 43966 | 67061 |
| TRIM46 | 20872 | 43967 | 67062 |
| TRIM46 | 20873 | 43968 | 67063 |
| TRIM47 | 20874 | 43969 | 67064 |
| TRIM48 | 20875 | 43970 | 67065 |
| TRIM49B | 20876 | 43971 | 67066 |
| TRIM49D1 | 20877 | 43972 | 67067 |
| TRIM5 | 20878 | 43973 | 67068 |
| TRIM5 | 20879 | 43974 | 67069 |
| TRIM5 | 20880 | 43975 | 67070 |
| TRIM50 | 20881 | 43976 | 67071 |
| TRIM51 | 20882 | 43977 | 67072 |
| TRIM52 | 20883 | 43978 | 67073 |
| TRIM52 | 20884 | 43979 | 67074 |
| TRIM52 | 20885 | 43980 | 67075 |
| TRIM52 | 20886 | 43981 | 67076 |
| TRIM52 | 20887 | 43982 | 67077 |
| TRIM54 | 20888 | 43983 | 67078 |
| TRIM55 | 20889 | 43984 | 67079 |
| TRIM55 | 20890 | 43985 | 67080 |
| TRIM56 | 20891 | 43986 | 67081 |
| TRIM58 | 20892 | 43987 | 67082 |
| TRIM59 | 20893 | 43988 | 67083 |
| TRIM6 | 20894 | 43989 | 67084 |
| TRIM6-TRIM34 | 20895 | 43990 | 67085 |
| TRIM60 | 20896 | 43991 | 67086 |
| TRIM61 | 20897 | 43992 | 67087 |
| TRIM62 | 20898 | 43993 | 67088 |
| TRIM63 | 20899 | 43994 | 67089 |
| TRIM64C | 20900 | 43995 | 67090 |
| TRIM65 | 20901 | 43996 | 67091 |
| TRIM66 | 20902 | 43997 | 67092 |
| TRIM67 | 20903 | 43998 | 67093 |
| TRIM68 | 20904 | 43999 | 67094 |
| TRIM69 | 20905 | 44000 | 67095 |
| TRIM7 | 20906 | 44001 | 67096 |
| TRIM7 | 20907 | 44002 | 67097 |
| TRIM71 | 20908 | 44003 | 67098 |
| TRIM72 | 20909 | 44004 | 67099 |
| TRIM74 | 20910 | 44005 | 67100 |
| TRIM77 | 20911 | 44006 | 67101 |
| TRIM8 | 20912 | 44007 | 67102 |
| TRIM9 | 20913 | 44008 | 67103 |
| TRIM9 | 20914 | 44009 | 67104 |
| TRIML1 | 20915 | 44010 | 67105 |
| TRIML2 | 20916 | 44011 | 67106 |
| TRIO | 20917 | 44012 | 67107 |
| TRIOBP | 20918 | 44013 | 67108 |
| TRIOBP | 20919 | 44014 | 67109 |
| TRIP10 | 20920 | 44015 | 67110 |
| TRIP10 | 20921 | 44016 | 67111 |
| TRIP11 | 20922 | 44017 | 67112 |
| TRIP12 | 20923 | 44018 | 67113 |
| TRIP12 | 20924 | 44019 | 67114 |
| TRIP13 | 20925 | 44020 | 67115 |
| TRIP13 | 20926 | 44021 | 67116 |
| TRIP4 | 20927 | 44022 | 67117 |
| TRIP6 | 20928 | 44023 | 67118 |
| TRIQK | 20929 | 44024 | 67119 |
| TRIR | 20930 | 44025 | 67120 |
| TRIR | 20931 | 44026 | 67121 |
| TRIT1 | 20932 | 44027 | 67122 |
| TRMO | 20933 | 44028 | 67123 |
| TRMT1 | 20934 | 44029 | 67124 |
| TRMT10A | 20935 | 44030 | 67125 |
| TRMT10B | 20936 | 44031 | 67126 |
| TRMT10C | 20937 | 44032 | 67127 |
| TRMT11 | 20938 | 44033 | 67128 |
| TRMT11 | 20939 | 44034 | 67129 |
| TRMT11 | 20940 | 44035 | 67130 |
| TRMT11 | 20941 | 44036 | 67131 |
| TRMT112 | 20942 | 44037 | 67132 |
| TRMT112 | 20943 | 44038 | 67133 |
| TRMT12 | 20944 | 44039 | 67134 |
| TRMT13 | 20945 | 44040 | 67135 |
| TRMT1L | 20946 | 44041 | 67136 |
| TRMT2A | 20947 | 44042 | 67137 |
| TRMT2A | 20948 | 44043 | 67138 |
| TRMT2B | 20949 | 44044 | 67139 |
| TRMT44 | 20950 | 44045 | 67140 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| TRMT5 | 20951 | 44046 | 67141 |
| TRMT6 | 20952 | 44047 | 67142 |
| TRMT61A | 20953 | 44048 | 67143 |
| TRMT61B | 20954 | 44049 | 67144 |
| TRMU | 20955 | 44050 | 67145 |
| TRMU | 20956 | 44051 | 67146 |
| TRNAU1AP | 20957 | 44052 | 67147 |
| TRNP1 | 20958 | 44053 | 67148 |
| TRNT1 | 20959 | 44054 | 67149 |
| TRO | 20960 | 44055 | 67150 |
| TRO | 20961 | 44056 | 67151 |
| TROAP | 20962 | 44057 | 67152 |
| TROAP | 20963 | 44058 | 67153 |
| TROVE2 | 20964 | 44059 | 67154 |
| TROVE2 | 20965 | 44060 | 67155 |
| TRPA1 | 20966 | 44061 | 67156 |
| TRPC1 | 20967 | 44062 | 67157 |
| TRPC3 | 20968 | 44063 | 67158 |
| TRPC4 | 20969 | 44064 | 67159 |
| TRPC4AP | 20970 | 44065 | 67160 |
| TRPC5 | 20971 | 44066 | 67161 |
| TRPC5OS | 20972 | 44067 | 67162 |
| TRPC6 | 20973 | 44068 | 67163 |
| TRPC7 | 20974 | 44069 | 67164 |
| TRPM1 | 20975 | 44070 | 67165 |
| TRPM1 | 20976 | 44071 | 67166 |
| TRPM2 | 20977 | 44072 | 67167 |
| TRPM3 | 20978 | 44073 | 67168 |
| TRPM3 | 20979 | 44074 | 67169 |
| TRPM4 | 20980 | 44075 | 67170 |
| TRPM5 | 20981 | 44076 | 67171 |
| TRPM6 | 20982 | 44077 | 67172 |
| TRPM7 | 20983 | 44078 | 67173 |
| TRPM8 | 20984 | 44079 | 67174 |
| TRPS1 | 20985 | 44080 | 67175 |
| TRPT1 | 20986 | 44081 | 67176 |
| TRPV1 | 20987 | 44082 | 67177 |
| TRPV2 | 20988 | 44083 | 67178 |
| TRPV3 | 20989 | 44084 | 67179 |
| TRPV4 | 20990 | 44085 | 67180 |
| TRPV5 | 20991 | 44086 | 67181 |
| TRPV6 | 20992 | 44087 | 67182 |
| TRRAP | 20993 | 44088 | 67183 |
| TRUB1 | 20994 | 44089 | 67184 |
| TRUB2 | 20995 | 44090 | 67185 |
| TSACC | 20996 | 44091 | 67186 |
| TSACC | 20997 | 44092 | 67187 |
| TSC1 | 20998 | 44093 | 67188 |
| TSC2 | 20999 | 44094 | 67189 |
| TSC22D1 | 21000 | 44095 | 67190 |
| TSC22D1 | 21001 | 44096 | 67191 |
| TSC22D2 | 21002 | 44097 | 67192 |
| TSC22D3 | 21003 | 44098 | 67193 |
| TSC22D4 | 21004 | 44099 | 67194 |
| TSEN15 | 21005 | 44100 | 67195 |
| TSEN15 | 21006 | 44101 | 67196 |
| TSEN15 | 21007 | 44102 | 67197 |
| TSEN15 | 21008 | 44103 | 67198 |
| TSEN2 | 21009 | 44104 | 67199 |
| TSEN2 | 21010 | 44105 | 67200 |
| TSEN34 | 21011 | 44106 | 67201 |
| TSEN34 | 21012 | 44107 | 67202 |
| TSEN54 | 21013 | 44108 | 67203 |
| TSFM | 21014 | 44109 | 67204 |
| TSFM | 21015 | 44110 | 67205 |
| TSFM | 21016 | 44111 | 67206 |
| TSG101 | 21017 | 44112 | 67207 |
| TSGA10 | 21018 | 44113 | 67208 |
| TSGA10IP | 21019 | 44114 | 67209 |
| TSGA13 | 21020 | 44115 | 67210 |
| TSHB | 21021 | 44116 | 67211 |
| TSHR | 21022 | 44117 | 67212 |
| TSHR | 21023 | 44118 | 67213 |
| TSHZ1 | 21024 | 44119 | 67214 |
| TSHZ2 | 21025 | 44120 | 67215 |
| TSHZ3 | 21026 | 44121 | 67216 |
| TSKS | 21027 | 44122 | 67217 |
| TSKU | 21028 | 44123 | 67218 |
| TSLP | 21029 | 44124 | 67219 |
| TSN | 21030 | 44125 | 67220 |
| TSN | 21031 | 44126 | 67221 |
| TSNARE1 | 21032 | 44127 | 67222 |
| TSNARE1 | 21033 | 44128 | 67223 |
| TSNAX | 21034 | 44129 | 67224 |
| TSNAXIP1 | 21035 | 44130 | 67225 |
| TSPAN1 | 21036 | 44131 | 67226 |
| TSPAN10 | 21037 | 44132 | 67227 |
| TSPAN11 | 21038 | 44133 | 67228 |
| TSPAN12 | 21039 | 44134 | 67229 |
| TSPAN13 | 21040 | 44135 | 67230 |
| TSPAN14 | 21041 | 44136 | 67231 |
| TSPAN15 | 21042 | 44137 | 67232 |
| TSPAN16 | 21043 | 44138 | 67233 |
| TSPAN16 | 21044 | 44139 | 67234 |
| TSPAN17 | 21045 | 44140 | 67235 |
| TSPAN17 | 21046 | 44141 | 67236 |
| TSPAN18 | 21047 | 44142 | 67237 |
| TSPAN19 | 21048 | 44143 | 67238 |
| TSPAN2 | 21049 | 44144 | 67239 |
| TSPAN3 | 21050 | 44145 | 67240 |
| TSPAN31 | 21051 | 44146 | 67241 |
| TSPAN32 | 21052 | 44147 | 67242 |
| TSPAN33 | 21053 | 44148 | 67243 |
| TSPAN4 | 21054 | 44149 | 67244 |
| TSPAN5 | 21055 | 44150 | 67245 |
| TSPAN6 | 21056 | 44151 | 67246 |
| TSPAN6 | 21057 | 44152 | 67247 |
| TSPAN7 | 21058 | 44153 | 67248 |
| TSPAN8 | 21059 | 44154 | 67249 |
| TSPAN9 | 21060 | 44155 | 67250 |
| TSPEAR | 21061 | 44156 | 67251 |
| TSPO | 21062 | 44157 | 67252 |
| TSPO2 | 21063 | 44158 | 67253 |
| TSPOAP1 | 21064 | 44159 | 67254 |
| TSPY10 | 21065 | 44160 | 67255 |
| TSPY2 | 21066 | 44161 | 67256 |
| TSPYL1 | 21067 | 44162 | 67257 |
| TSPYL2 | 21068 | 44163 | 67258 |
| TSPYL4 | 21069 | 44164 | 67259 |
| TSPYL5 | 21070 | 44165 | 67260 |
| TSPYL6 | 21071 | 44166 | 67261 |
| TSR1 | 21072 | 44167 | 67262 |
| TSR2 | 21073 | 44168 | 67263 |
| TSR2 | 21074 | 44169 | 67264 |
| TSR3 | 21075 | 44170 | 67265 |
| TSSC4 | 21076 | 44171 | 67266 |
| TSSK1B | 21077 | 44172 | 67267 |
| TSSK2 | 21078 | 44173 | 67268 |
| TSSK3 | 21079 | 44174 | 67269 |
| TSSK4 | 21080 | 44175 | 67270 |
| TSSK6 | 21081 | 44176 | 67271 |
| TST | 21082 | 44177 | 67272 |
| TSTA3 | 21083 | 44178 | 67273 |
| TSTD1 | 21084 | 44179 | 67274 |
| TSTD1 | 21085 | 44180 | 67275 |
| TSTD2 | 21086 | 44181 | 67276 |
| TSTD3 | 21087 | 44182 | 67277 |
| TTBK1 | 21088 | 44183 | 67278 |
| TTBK2 | 21089 | 44184 | 67279 |
| TTC1 | 21090 | 44185 | 67280 |
| TTC12 | 21091 | 44186 | 67281 |
| TTC13 | 21092 | 44187 | 67282 |
| TTC14 | 21093 | 44188 | 67283 |
| TTC14 | 21094 | 44189 | 67284 |
| TTC14 | 21095 | 44190 | 67285 |
| TTC16 | 21096 | 44191 | 67286 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| TTC17 | 21097 | 44192 | 67287 |
| TTC17 | 21098 | 44193 | 67288 |
| TTC19 | 21099 | 44194 | 67289 |
| TTC21A | 21100 | 44195 | 67290 |
| TTC21B | 21101 | 44196 | 67291 |
| TTC22 | 21102 | 44197 | 67292 |
| TTC22 | 21103 | 44198 | 67293 |
| TTC23 | 21104 | 44199 | 67294 |
| TTC23L | 21105 | 44200 | 67295 |
| TTC24 | 21106 | 44201 | 67296 |
| TTC25 | 21107 | 44202 | 67297 |
| TTC25 | 21108 | 44203 | 67298 |
| TTC26 | 21109 | 44204 | 67299 |
| TTC26 | 21110 | 44205 | 67300 |
| TTC26 | 21111 | 44206 | 67301 |
| TTC27 | 21112 | 44207 | 67302 |
| TTC28 | 21113 | 44208 | 67303 |
| TTC29 | 21114 | 44209 | 67304 |
| TTC3 | 21115 | 44210 | 67305 |
| TTC30A | 21116 | 44211 | 67306 |
| TTC30B | 21117 | 44212 | 67307 |
| TTC31 | 21118 | 44213 | 67308 |
| TTC32 | 21119 | 44214 | 67309 |
| TTC33 | 21120 | 44215 | 67310 |
| TTC34 | 21121 | 44216 | 67311 |
| TTC36 | 21122 | 44217 | 67312 |
| TTC37 | 21123 | 44218 | 67313 |
| TTC38 | 21124 | 44219 | 67314 |
| TTC39A | 21125 | 44220 | 67315 |
| TTC39A | 21126 | 44221 | 67316 |
| TTC39B | 21127 | 44222 | 67317 |
| TTC39C | 21128 | 44223 | 67318 |
| TTC39C | 21129 | 44224 | 67319 |
| TTC4 | 21130 | 44225 | 67320 |
| TTC5 | 21131 | 44226 | 67321 |
| TTC6 | 21132 | 44227 | 67322 |
| TTC7A | 21133 | 44228 | 67323 |
| TTC7B | 21134 | 44229 | 67324 |
| TTC8 | 21135 | 44230 | 67325 |
| TTC9 | 21136 | 44231 | 67326 |
| TTC9B | 21137 | 44232 | 67327 |
| TTC9C | 21138 | 44233 | 67328 |
| TTF1 | 21139 | 44234 | 67329 |
| TTF2 | 21140 | 44235 | 67330 |
| TTI1 | 21141 | 44236 | 67331 |
| TTI2 | 21142 | 44237 | 67332 |
| TTK | 21143 | 44238 | 67333 |
| TTL | 21144 | 44239 | 67334 |
| TTLL1 | 21145 | 44240 | 67335 |
| TTLL10 | 21146 | 44241 | 67336 |
| TTLL10 | 21147 | 44242 | 67337 |
| TTLL11 | 21148 | 44243 | 67338 |
| TTLL11 | 21149 | 44244 | 67339 |
| TTLL12 | 21150 | 44245 | 67340 |
| TTLL2 | 21151 | 44246 | 67341 |
| TTLL3 | 21152 | 44247 | 67342 |
| TTLL4 | 21153 | 44248 | 67343 |
| TTLL5 | 21154 | 44249 | 67344 |
| TTLL6 | 21155 | 44250 | 67345 |
| TTLL7 | 21156 | 44251 | 67346 |
| TTLL8 | 21157 | 44252 | 67347 |
| TTLL9 | 21158 | 44253 | 67348 |
| TTN | 21159 | 44254 | 67349 |
| TTN | 21160 | 44255 | 67350 |
| TTPA | 21161 | 44256 | 67351 |
| TTPAL | 21162 | 44257 | 67352 |
| TTR | 21163 | 44258 | 67353 |
| TTYH1 | 21164 | 44259 | 67354 |
| TTYH1 | 21165 | 44260 | 67355 |
| TTYH2 | 21166 | 44261 | 67356 |
| TTYH3 | 21167 | 44262 | 67357 |
| TUB | 21168 | 44263 | 67358 |
| TUBA1A | 21169 | 44264 | 67359 |
| TUBA1C | 21170 | 44265 | 67360 |
| TUBA3C | 21171 | 44266 | 67361 |
| TUBA3D | 21172 | 44267 | 67362 |
| TUBA4A | 21173 | 44268 | 67363 |
| TUBA8 | 21174 | 44269 | 67364 |
| TUBAL3 | 21175 | 44270 | 67365 |
| TUBB | 21176 | 44271 | 67366 |
| TUBB1 | 21177 | 44272 | 67367 |
| TUBB2B | 21178 | 44273 | 67368 |
| TUBB3 | 21179 | 44274 | 67369 |
| TUBB4A | 21180 | 44275 | 67370 |
| TUBB4B | 21181 | 44276 | 67371 |
| TUBB6 | 21182 | 44277 | 67372 |
| TUBB6 | 21183 | 44278 | 67373 |
| TUBB8 | 21184 | 44279 | 67374 |
| TUBD1 | 21185 | 44280 | 67375 |
| TUBE1 | 21186 | 44281 | 67376 |
| TUBG1 | 21187 | 44282 | 67377 |
| TUBG2 | 21188 | 44283 | 67378 |
| TUBGCP2 | 21189 | 44284 | 67379 |
| TUBGCP3 | 21190 | 44285 | 67380 |
| TUBGCP3 | 21191 | 44286 | 67381 |
| TUBGCP3 | 21192 | 44287 | 67382 |
| TUBGCP4 | 21193 | 44288 | 67383 |
| TUBGCP5 | 21194 | 44289 | 67384 |
| TUBGCP5 | 21195 | 44290 | 67385 |
| TUBGCP5 | 21196 | 44291 | 67386 |
| TUBGCP6 | 21197 | 44292 | 67387 |
| TUFM | 21198 | 44293 | 67388 |
| TUFT1 | 21199 | 44294 | 67389 |
| TULP1 | 21200 | 44295 | 67390 |
| TULP2 | 21201 | 44296 | 67391 |
| TULP3 | 21202 | 44297 | 67392 |
| TULP3 | 21203 | 44298 | 67393 |
| TULP4 | 21204 | 44299 | 67394 |
| TULP4 | 21205 | 44300 | 67395 |
| TUSC1 | 21206 | 44301 | 67396 |
| TUSC2 | 21207 | 44302 | 67397 |
| TUSC3 | 21208 | 44303 | 67398 |
| TUSC5 | 21209 | 44304 | 67399 |
| TUT1 | 21210 | 44305 | 67400 |
| TVP23A | 21211 | 44306 | 67401 |
| TVP23B | 21212 | 44307 | 67402 |
| TVP23B | 21213 | 44308 | 67403 |
| TVP23C | 21214 | 44309 | 67404 |
| TVP23C-CDRT4 | 21215 | 44310 | 67405 |
| TWF1 | 21216 | 44311 | 67406 |
| TWF2 | 21217 | 44312 | 67407 |
| TWIST1 | 21218 | 44313 | 67408 |
| TWIST2 | 21219 | 44314 | 67409 |
| TWISTNB | 21220 | 44315 | 67410 |
| TWNK | 21221 | 44316 | 67411 |
| TWNK | 21222 | 44317 | 67412 |
| TWSG1 | 21223 | 44318 | 67413 |
| TXK | 21224 | 44319 | 67414 |
| TXLNA | 21225 | 44320 | 67415 |
| TXLNB | 21226 | 44321 | 67416 |
| TXLNG | 21227 | 44322 | 67417 |
| TXN | 21228 | 44323 | 67418 |
| TXN2 | 21229 | 44324 | 67419 |
| TXNDC11 | 21230 | 44325 | 67420 |
| TXNDC12 | 21231 | 44326 | 67421 |
| TXNDC15 | 21232 | 44327 | 67422 |
| TXNDC16 | 21233 | 44328 | 67423 |
| TXNDC17 | 21234 | 44329 | 67424 |
| TXNDC2 | 21235 | 44330 | 67425 |
| TXNDC5 | 21236 | 44331 | 67426 |
| TXNDC8 | 21237 | 44332 | 67427 |
| TXNDC8 | 21238 | 44333 | 67428 |
| TXNDC9 | 21239 | 44334 | 67429 |
| TXNIP | 21240 | 44335 | 67430 |
| TXNL1 | 21241 | 44336 | 67431 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| TXNL4A | 21242 | 44337 | 67432 |
| TXNL4B | 21243 | 44338 | 67433 |
| TXNL4B | 21244 | 44339 | 67434 |
| TXNRD1 | 21245 | 44340 | 67435 |
| TXNRD2 | 21246 | 44341 | 67436 |
| TXNRD2 | 21247 | 44342 | 67437 |
| TXNRD3 | 21248 | 44343 | 67438 |
| TXNRD3NB | 21249 | 44344 | 67439 |
| TYK2 | 21250 | 44345 | 67440 |
| TYMP | 21251 | 44346 | 67441 |
| TYMS | 21252 | 44347 | 67442 |
| TYMSOS | 21253 | 44348 | 67443 |
| TYR | 21254 | 44349 | 67444 |
| TYRO3 | 21255 | 44350 | 67445 |
| TYROBP | 21256 | 44351 | 67446 |
| TYRP1 | 21257 | 44352 | 67447 |
| TYSND1 | 21258 | 44353 | 67448 |
| TYSND1 | 21259 | 44354 | 67449 |
| TYW1B | 21260 | 44355 | 67450 |
| TYW3 | 21261 | 44356 | 67451 |
| TYW5 | 21262 | 44357 | 67452 |
| U2AF1 | 21263 | 44358 | 67453 |
| U2AF1L4 | 21264 | 44359 | 67454 |
| U2AF1L4 | 21265 | 44360 | 67455 |
| U2AF2 | 21266 | 44361 | 67456 |
| U2SURP | 21267 | 44362 | 67457 |
| UACA | 21268 | 44363 | 67458 |
| UAP1 | 21269 | 44364 | 67459 |
| UAP1L1 | 21270 | 44365 | 67460 |
| UBA1 | 21271 | 44366 | 67461 |
| UBA2 | 21272 | 44367 | 67462 |
| UBA3 | 21273 | 44368 | 67463 |
| UBA5 | 21274 | 44369 | 67464 |
| UBA52 | 21275 | 44370 | 67465 |
| UBA52 | 21276 | 44371 | 67466 |
| UBA6 | 21277 | 44372 | 67467 |
| UBA7 | 21278 | 44373 | 67468 |
| UBAC1 | 21279 | 44374 | 67469 |
| UBAC2 | 21280 | 44375 | 67470 |
| UBALD1 | 21281 | 44376 | 67471 |
| UBALD2 | 21282 | 44377 | 67472 |
| UBAP1 | 21283 | 44378 | 67473 |
| UBAP1L | 21284 | 44379 | 67474 |
| UBAP2 | 21285 | 44380 | 67475 |
| UBAP2L | 21286 | 44381 | 67476 |
| UBAP2L | 21287 | 44382 | 67477 |
| UBAP2L | 21288 | 44383 | 67478 |
| UBASH3A | 21289 | 44384 | 67479 |
| UBASH3A | 21290 | 44385 | 67480 |
| UBASH3B | 21291 | 44386 | 67481 |
| UBB | 21292 | 44387 | 67482 |
| UBC | 21293 | 44388 | 67483 |
| UBD | 21294 | 44389 | 67484 |
| UBE2A | 21295 | 44390 | 67485 |
| UBE2B | 21296 | 44391 | 67486 |
| UBE2C | 21297 | 44392 | 67487 |
| UBE2C | 21298 | 44393 | 67488 |
| UBE2D1 | 21299 | 44394 | 67489 |
| UBE2D2 | 21300 | 44395 | 67490 |
| UBE2D3 | 21301 | 44396 | 67491 |
| UBE2D3 | 21302 | 44397 | 67492 |
| UBE2D4 | 21303 | 44398 | 67493 |
| UBE2E1 | 21304 | 44399 | 67494 |
| UBE2E2 | 21305 | 44400 | 67495 |
| UBE2F | 21306 | 44401 | 67496 |
| UBE2G1 | 21307 | 44402 | 67497 |
| UBE2G2 | 21308 | 44403 | 67498 |
| UBE2H | 21309 | 44404 | 67499 |
| UBE2I | 21310 | 44405 | 67500 |
| UBE2J1 | 21311 | 44406 | 67501 |
| UBE2J2 | 21312 | 44407 | 67502 |
| UBE2K | 21313 | 44408 | 67503 |
| UBE2L3 | 21314 | 44409 | 67504 |
| UBE2L6 | 21315 | 44410 | 67505 |
| UBE2M | 21316 | 44411 | 67506 |
| UBE2NL | 21317 | 44412 | 67507 |
| UBE2O | 21318 | 44413 | 67508 |
| UBE2Q1 | 21319 | 44414 | 67509 |
| UBE2Q2 | 21320 | 44415 | 67510 |
| UBE2Q2L | 21321 | 44416 | 67511 |
| UBE2QL1 | 21322 | 44417 | 67512 |
| UBE2R2 | 21323 | 44418 | 67513 |
| UBE2S | 21324 | 44419 | 67514 |
| UBE2T | 21325 | 44420 | 67515 |
| UBE2U | 21326 | 44421 | 67516 |
| UBE2V1 | 21327 | 44422 | 67517 |
| UBE2V1 | 21328 | 44423 | 67518 |
| UBE2V2 | 21329 | 44424 | 67519 |
| UBE2W | 21330 | 44425 | 67520 |
| UBE2Z | 21331 | 44426 | 67521 |
| UBE3A | 21332 | 44427 | 67522 |
| UBE3B | 21333 | 44428 | 67523 |
| UBE3B | 21334 | 44429 | 67524 |
| UBE3C | 21335 | 44430 | 67525 |
| UBE3D | 21336 | 44431 | 67526 |
| UBE4A | 21337 | 44432 | 67527 |
| UBE4B | 21338 | 44433 | 67528 |
| UBFD1 | 21339 | 44434 | 67529 |
| UBIAD1 | 21340 | 44435 | 67530 |
| UBIAD1 | 21341 | 44436 | 67531 |
| UBIAD1 | 21342 | 44437 | 67532 |
| UBL3 | 21343 | 44438 | 67533 |
| UBL4A | 21344 | 44439 | 67534 |
| UBL4B | 21345 | 44440 | 67535 |
| UBL5 | 21346 | 44441 | 67536 |
| UBL7 | 21347 | 44442 | 67537 |
| UBLCP1 | 21348 | 44443 | 67538 |
| UBN1 | 21349 | 44444 | 67539 |
| UBN2 | 21350 | 44445 | 67540 |
| UBOX5 | 21351 | 44446 | 67541 |
| UBOX5 | 21352 | 44447 | 67542 |
| UBP1 | 21353 | 44448 | 67543 |
| UBQLN1 | 21354 | 44449 | 67544 |
| UBQLN2 | 21355 | 44450 | 67545 |
| UBQLN3 | 21356 | 44451 | 67546 |
| UBQLN4 | 21357 | 44452 | 67547 |
| UBQLNL | 21358 | 44453 | 67548 |
| UBR1 | 21359 | 44454 | 67549 |
| UBR2 | 21360 | 44455 | 67550 |
| UBR2 | 21361 | 44456 | 67551 |
| UBR3 | 21362 | 44457 | 67552 |
| UBR4 | 21363 | 44458 | 67553 |
| UBR5 | 21364 | 44459 | 67554 |
| UBR7 | 21365 | 44460 | 67555 |
| UBTD1 | 21366 | 44461 | 67556 |
| UBTD2 | 21367 | 44462 | 67557 |
| UBTF | 21368 | 44463 | 67558 |
| UBTFL1 | 21369 | 44464 | 67559 |
| UBXN1 | 21370 | 44465 | 67560 |
| UBXN1 | 21371 | 44466 | 67561 |
| UBXN10 | 21372 | 44467 | 67562 |
| UBXN11 | 21373 | 44468 | 67563 |
| UBXN2A | 21374 | 44469 | 67564 |
| UBXN2B | 21375 | 44470 | 67565 |
| UBXN2B | 21376 | 44471 | 67566 |
| UBXN4 | 21377 | 44472 | 67567 |
| UBXN6 | 21378 | 44473 | 67568 |
| UBXN7 | 21379 | 44474 | 67569 |
| UBXN8 | 21380 | 44475 | 67570 |
| UCHL1 | 21381 | 44476 | 67571 |
| UCHL3 | 21382 | 44477 | 67572 |
| UCHL5 | 21383 | 44478 | 67573 |
| UCHL5 | 21384 | 44479 | 67574 |
| UCHL5 | 21385 | 44480 | 67575 |
| UCK1 | 21386 | 44481 | 67576 |
| UCK1 | 21387 | 44482 | 67577 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| UCK2 | 21388 | 44483 | 67578 |
| UCKL1 | 21389 | 44484 | 67579 |
| UCMA | 21390 | 44485 | 67580 |
| UCN | 21391 | 44486 | 67581 |
| UCN2 | 21392 | 44487 | 67582 |
| UCN3 | 21393 | 44488 | 67583 |
| UCP1 | 21394 | 44489 | 67584 |
| UCP2 | 21395 | 44490 | 67585 |
| UCP3 | 21396 | 44491 | 67586 |
| UCP3 | 21397 | 44492 | 67587 |
| UEVLD | 21398 | 44493 | 67588 |
| UEVLD | 21399 | 44494 | 67589 |
| UEVLD | 21400 | 44495 | 67590 |
| UEVLD | 21401 | 44496 | 67591 |
| UFC1 | 21402 | 44497 | 67592 |
| UFD1 | 21403 | 44498 | 67593 |
| UFD1 | 21404 | 44499 | 67594 |
| UFL1 | 21405 | 44500 | 67595 |
| UFM1 | 21406 | 44501 | 67596 |
| UFM1 | 21407 | 44502 | 67597 |
| UFSP1 | 21408 | 44503 | 67598 |
| UFSP2 | 21409 | 44504 | 67599 |
| UGCG | 21410 | 44505 | 67600 |
| UGDH | 21411 | 44506 | 67601 |
| UGGT1 | 21412 | 44507 | 67602 |
| UGGT2 | 21413 | 44508 | 67603 |
| UGP2 | 21414 | 44509 | 67604 |
| UGT1A1 | 21415 | 44510 | 67605 |
| UGT2A1 | 21416 | 44511 | 67606 |
| UGT2A3 | 21417 | 44512 | 67607 |
| UGT2B10 | 21418 | 44513 | 67608 |
| UGT2B11 | 21419 | 44514 | 67609 |
| UGT2B15 | 21420 | 44515 | 67610 |
| UGT2B17 | 21421 | 44516 | 67611 |
| UGT2B28 | 21422 | 44517 | 67612 |
| UGT2B4 | 21423 | 44518 | 67613 |
| UGT2B4 | 21424 | 44519 | 67614 |
| UGT2B7 | 21425 | 44520 | 67615 |
| UGT2B7 | 21426 | 44521 | 67616 |
| UGT3A1 | 21427 | 44522 | 67617 |
| UGT3A1 | 21428 | 44523 | 67618 |
| UGT3A2 | 21429 | 44524 | 67619 |
| UGT8 | 21430 | 44525 | 67620 |
| UHMK1 | 21431 | 44526 | 67621 |
| UHMK1 | 21432 | 44527 | 67622 |
| UHRF1 | 21433 | 44528 | 67623 |
| UHRF1BP1 | 21434 | 44529 | 67624 |
| UHRF1BP1L | 21435 | 44530 | 67625 |
| UHRF1BP1L | 21436 | 44531 | 67626 |
| UHRF2 | 21437 | 44532 | 67627 |
| UIMC1 | 21438 | 44533 | 67628 |
| ULBP1 | 21439 | 44534 | 67629 |
| ULBP1 | 21440 | 44535 | 67630 |
| ULBP2 | 21441 | 44536 | 67631 |
| ULBP3 | 21442 | 44537 | 67632 |
| ULK1 | 21443 | 44538 | 67633 |
| ULK2 | 21444 | 44539 | 67634 |
| ULK3 | 21445 | 44540 | 67635 |
| ULK4 | 21446 | 44541 | 67636 |
| ULK4 | 21447 | 44542 | 67637 |
| UMAD1 | 21448 | 44543 | 67638 |
| UMOD | 21449 | 44544 | 67639 |
| UMODL1 | 21450 | 44545 | 67640 |
| UMPS | 21451 | 44546 | 67641 |
| UNC119 | 21452 | 44547 | 67642 |
| UNC119 | 21453 | 44548 | 67643 |
| UNC119 | 21454 | 44549 | 67644 |
| UNC119B | 21455 | 44550 | 67645 |
| UNC13A | 21456 | 44551 | 67646 |
| UNC13B | 21457 | 44552 | 67647 |
| UNC13C | 21458 | 44553 | 67648 |
| UNC13D | 21459 | 44554 | 67649 |
| UNC45A | 21460 | 44555 | 67650 |
| UNC45B | 21461 | 44556 | 67651 |
| UNC50 | 21462 | 44557 | 67652 |
| UNC5A | 21463 | 44558 | 67653 |
| UNC5B | 21464 | 44559 | 67654 |
| UNC5C | 21465 | 44560 | 67655 |
| UNC5CL | 21466 | 44561 | 67656 |
| UNC5D | 21467 | 44562 | 67657 |
| UNC79 | 21468 | 44563 | 67658 |
| UNC80 | 21469 | 44564 | 67659 |
| UNC93A | 21470 | 44565 | 67660 |
| UNC93B1 | 21471 | 44566 | 67661 |
| UNCX | 21472 | 44567 | 67662 |
| UNG | 21473 | 44568 | 67663 |
| UNK | 21474 | 44569 | 67664 |
| UNKL | 21475 | 44570 | 67665 |
| UNKL | 21476 | 44571 | 67666 |
| UPB1 | 21477 | 44572 | 67667 |
| UPF1 | 21478 | 44573 | 67668 |
| UPF2 | 21479 | 44574 | 67669 |
| UPF3A | 21480 | 44575 | 67670 |
| UPF3A | 21481 | 44576 | 67671 |
| UPF3A | 21482 | 44577 | 67672 |
| UPF3A | 21483 | 44578 | 67673 |
| UPF3A | 21484 | 44579 | 67674 |
| UPF3A | 21485 | 44580 | 67675 |
| UPF3B | 21486 | 44581 | 67676 |
| UPK1A | 21487 | 44582 | 67677 |
| UPK1A | 21488 | 44583 | 67678 |
| UPK1B | 21489 | 44584 | 67679 |
| UPK2 | 21490 | 44585 | 67680 |
| UPK3A | 21491 | 44586 | 67681 |
| UPK3B | 21492 | 44587 | 67682 |
| UPK3B | 21493 | 44588 | 67683 |
| UPK3BL1 | 21494 | 44589 | 67684 |
| UPP1 | 21495 | 44590 | 67685 |
| UPP2 | 21496 | 44591 | 67686 |
| UPRT | 21497 | 44592 | 67687 |
| UPRT | 21498 | 44593 | 67688 |
| UQCC1 | 21499 | 44594 | 67689 |
| UQCC2 | 21500 | 44595 | 67690 |
| UQCC3 | 21501 | 44596 | 67691 |
| UQCR10 | 21502 | 44597 | 67692 |
| UQCR11 | 21503 | 44598 | 67693 |
| UQCRB | 21504 | 44599 | 67694 |
| UQCRB | 21505 | 44600 | 67695 |
| UQCRB | 21506 | 44601 | 67696 |
| UQCRC1 | 21507 | 44602 | 67697 |
| UQCRC2 | 21508 | 44603 | 67698 |
| UQCRFS1 | 21509 | 44604 | 67699 |
| UQCRH | 21510 | 44605 | 67700 |
| UQCRHL | 21511 | 44606 | 67701 |
| UQCRQ | 21512 | 44607 | 67702 |
| URAD | 21513 | 44608 | 67703 |
| URB1 | 21514 | 44609 | 67704 |
| URB2 | 21515 | 44610 | 67705 |
| URGCP | 21516 | 44611 | 67706 |
| URGCP-MRPS24 | 21517 | 44612 | 67707 |
| URI1 | 21518 | 44613 | 67708 |
| URI1 | 21519 | 44614 | 67709 |
| URM1 | 21520 | 44615 | 67710 |
| URM1 | 21521 | 44616 | 67711 |
| URM1 | 21522 | 44617 | 67712 |
| UROC1 | 21523 | 44618 | 67713 |
| UROD | 21524 | 44619 | 67714 |
| UROS | 21525 | 44620 | 67715 |
| UROS | 21526 | 44621 | 67716 |
| USB1 | 21527 | 44622 | 67717 |
| USB1 | 21528 | 44623 | 67718 |
| USB1 | 21529 | 44624 | 67719 |
| USE1 | 21530 | 44625 | 67720 |
| USF1 | 21531 | 44626 | 67721 |
| USF2 | 21532 | 44627 | 67722 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| USF3 | 21533 | 44628 | 67723 |
| USH1C | 21534 | 44629 | 67724 |
| USH1C | 21535 | 44630 | 67725 |
| USH1G | 21536 | 44631 | 67726 |
| USH2A | 21537 | 44632 | 67727 |
| USH2A | 21538 | 44633 | 67728 |
| USHBP1 | 21539 | 44634 | 67729 |
| USMG5 | 21540 | 44635 | 67730 |
| USO1 | 21541 | 44636 | 67731 |
| USP1 | 21542 | 44637 | 67732 |
| USP10 | 21543 | 44638 | 67733 |
| USP11 | 21544 | 44639 | 67734 |
| USP12 | 21545 | 44640 | 67735 |
| USP13 | 21546 | 44641 | 67736 |
| USP14 | 21547 | 44642 | 67737 |
| USP15 | 21548 | 44643 | 67738 |
| USP15 | 21549 | 44644 | 67739 |
| USP15 | 21550 | 44645 | 67740 |
| USP15 | 21551 | 44646 | 67741 |
| USP16 | 21552 | 44647 | 67742 |
| USP17L1 | 21553 | 44648 | 67743 |
| USP17L12 | 21554 | 44649 | 67744 |
| USP17L13 | 21555 | 44650 | 67745 |
| USP17L15 | 21556 | 44651 | 67746 |
| USP17L17 | 21557 | 44652 | 67747 |
| USP17L21 | 21558 | 44653 | 67748 |
| USP17L4 | 21559 | 44654 | 67749 |
| USP17L5 | 21560 | 44655 | 67750 |
| USP17L7 | 21561 | 44656 | 67751 |
| USP18 | 21562 | 44657 | 67752 |
| USP19 | 21563 | 44658 | 67753 |
| USP19 | 21564 | 44659 | 67754 |
| USP2 | 21565 | 44660 | 67755 |
| USP20 | 21566 | 44661 | 67756 |
| USP21 | 21567 | 44662 | 67757 |
| USP22 | 21568 | 44663 | 67758 |
| USP24 | 21569 | 44664 | 67759 |
| USP25 | 21570 | 44665 | 67760 |
| USP26 | 21571 | 44666 | 67761 |
| USP27X | 21572 | 44667 | 67762 |
| USP28 | 21573 | 44668 | 67763 |
| USP28 | 21574 | 44669 | 67764 |
| USP29 | 21575 | 44670 | 67765 |
| USP3 | 21576 | 44671 | 67766 |
| USP30 | 21577 | 44672 | 67767 |
| USP31 | 21578 | 44673 | 67768 |
| USP33 | 21579 | 44674 | 67769 |
| USP33 | 21580 | 44675 | 67770 |
| USP34 | 21581 | 44676 | 67771 |
| USP35 | 21582 | 44677 | 67772 |
| USP36 | 21583 | 44678 | 67773 |
| USP37 | 21584 | 44679 | 67774 |
| USP38 | 21585 | 44680 | 67775 |
| USP38 | 21586 | 44681 | 67776 |
| USP39 | 21587 | 44682 | 67777 |
| USP39 | 21588 | 44683 | 67778 |
| USP4 | 21589 | 44684 | 67779 |
| USP4 | 21590 | 44685 | 67780 |
| USP40 | 21591 | 44686 | 67781 |
| USP42 | 21592 | 44687 | 67782 |
| USP43 | 21593 | 44688 | 67783 |
| USP44 | 21594 | 44689 | 67784 |
| USP45 | 21595 | 44690 | 67785 |
| USP45 | 21596 | 44691 | 67786 |
| USP45 | 21597 | 44692 | 67787 |
| USP45 | 21598 | 44693 | 67788 |
| USP46 | 21599 | 44694 | 67789 |
| USP46 | 21600 | 44695 | 67790 |
| USP47 | 21601 | 44696 | 67791 |
| USP48 | 21602 | 44697 | 67792 |
| USP48 | 21603 | 44698 | 67793 |
| USP49 | 21604 | 44699 | 67794 |
| USP49 | 21605 | 44700 | 67795 |
| USP5 | 21606 | 44701 | 67796 |
| USP50 | 21607 | 44702 | 67797 |
| USP51 | 21608 | 44703 | 67798 |
| USP53 | 21609 | 44704 | 67799 |
| USP54 | 21610 | 44705 | 67800 |
| USP54 | 21611 | 44706 | 67801 |
| USP6 | 21612 | 44707 | 67802 |
| USP6NL | 21613 | 44708 | 67803 |
| USP7 | 21614 | 44709 | 67804 |
| USP8 | 21615 | 44710 | 67805 |
| USP9X | 21616 | 44711 | 67806 |
| USP9Y | 21617 | 44712 | 67807 |
| USPL1 | 21618 | 44713 | 67808 |
| UST | 21619 | 44714 | 67809 |
| UTF1 | 21620 | 44715 | 67810 |
| UTP11 | 21621 | 44716 | 67811 |
| UTP14A | 21622 | 44717 | 67812 |
| UTP14C | 21623 | 44718 | 67813 |
| UTP15 | 21624 | 44719 | 67814 |
| UTP18 | 21625 | 44720 | 67815 |
| UTP20 | 21626 | 44721 | 67816 |
| UTP23 | 21627 | 44722 | 67817 |
| UTP3 | 21628 | 44723 | 67818 |
| UTP4 | 21629 | 44724 | 67819 |
| UTP6 | 21630 | 44725 | 67820 |
| UTRN | 21631 | 44726 | 67821 |
| UTS2 | 21632 | 44727 | 67822 |
| UTS2B | 21633 | 44728 | 67823 |
| UTS2R | 21634 | 44729 | 67824 |
| UTY | 21635 | 44730 | 67825 |
| UTY | 21636 | 44731 | 67826 |
| UTY | 21637 | 44732 | 67827 |
| UTY | 21638 | 44733 | 67828 |
| UVRAG | 21639 | 44734 | 67829 |
| UVSSA | 21640 | 44735 | 67830 |
| UXS1 | 21641 | 44736 | 67831 |
| UXT | 21642 | 44737 | 67832 |
| VAC14 | 21643 | 44738 | 67833 |
| VAMP1 | 21644 | 44739 | 67834 |
| VAMP1 | 21645 | 44740 | 67835 |
| VAMP2 | 21646 | 44741 | 67836 |
| VAMP3 | 21647 | 44742 | 67837 |
| VAMP4 | 21648 | 44743 | 67838 |
| VAMP5 | 21649 | 44744 | 67839 |
| VAMP7 | 21650 | 44745 | 67840 |
| VAMP7 | 21651 | 44746 | 67841 |
| VAMP8 | 21652 | 44747 | 67842 |
| VANGL1 | 21653 | 44748 | 67843 |
| VANGL2 | 21654 | 44749 | 67844 |
| VAPA | 21655 | 44750 | 67845 |
| VAPB | 21656 | 44751 | 67846 |
| VAPB | 21657 | 44752 | 67847 |
| VARS | 21658 | 44753 | 67848 |
| VARS2 | 21659 | 44754 | 67849 |
| VASH1 | 21660 | 44755 | 67850 |
| VASH2 | 21661 | 44756 | 67851 |
| VASN | 21662 | 44757 | 67852 |
| VASP | 21663 | 44758 | 67853 |
| VAT1 | 21664 | 44759 | 67854 |
| VAT1L | 21665 | 44760 | 67855 |
| VAV1 | 21666 | 44761 | 67856 |
| VAV2 | 21667 | 44762 | 67857 |
| VAV3 | 21668 | 44763 | 67858 |
| VAX1 | 21669 | 44764 | 67859 |
| VAX1 | 21670 | 44765 | 67860 |
| VAX2 | 21671 | 44766 | 67861 |
| VBP1 | 21672 | 44767 | 67862 |
| VCAM1 | 21673 | 44768 | 67863 |
| VCAN | 21674 | 44769 | 67864 |
| VCL | 21675 | 44770 | 67865 |
| VCP | 21676 | 44771 | 67866 |
| VCPIP1 | 21677 | 44772 | 67867 |
| VCPKMT | 21678 | 44773 | 67868 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| VCX2 | 21679 | 44774 | 67869 |
| VCX3B | 21680 | 44775 | 67870 |
| VCY | 21681 | 44776 | 67871 |
| VDAC1 | 21682 | 44777 | 67872 |
| VDAC2 | 21683 | 44778 | 67873 |
| VDAC3 | 21684 | 44779 | 67874 |
| VDR | 21685 | 44780 | 67875 |
| VEGFA | 21686 | 44781 | 67876 |
| VEGFA | 21687 | 44782 | 67877 |
| VEGFA | 21688 | 44783 | 67878 |
| VEGFB | 21689 | 44784 | 67879 |
| VEGFB | 21690 | 44785 | 67880 |
| VEGFC | 21691 | 44786 | 67881 |
| VEGFD | 21692 | 44787 | 67882 |
| VENTX | 21693 | 44788 | 67883 |
| VEPH1 | 21694 | 44789 | 67884 |
| VEPH1 | 21695 | 44790 | 67885 |
| VEPH1 | 21696 | 44791 | 67886 |
| VEZF1 | 21697 | 44792 | 67887 |
| VEZT | 21698 | 44793 | 67888 |
| VEZT | 21699 | 44794 | 67889 |
| VEZT | 21700 | 44795 | 67890 |
| VGF | 21701 | 44796 | 67891 |
| VGLL1 | 21702 | 44797 | 67892 |
| VGLL2 | 21703 | 44798 | 67893 |
| VGLL3 | 21704 | 44799 | 67894 |
| VGLL3 | 21705 | 44800 | 67895 |
| VGLL4 | 21706 | 44801 | 67896 |
| VHL | 21707 | 44802 | 67897 |
| VHLL | 21708 | 44803 | 67898 |
| VIL1 | 21709 | 44804 | 67899 |
| VILL | 21710 | 44805 | 67900 |
| VIM | 21711 | 44806 | 67901 |
| VIP | 21712 | 44807 | 67902 |
| VIPAS39 | 21713 | 44808 | 67903 |
| VIPR1 | 21714 | 44809 | 67904 |
| VIPR2 | 21715 | 44810 | 67905 |
| VIRMA | 21716 | 44811 | 67906 |
| VIRMA | 21717 | 44812 | 67907 |
| VIT | 21718 | 44813 | 67908 |
| VIT | 21719 | 44814 | 67909 |
| VKORC1 | 21720 | 44815 | 67910 |
| VKORC1 | 21721 | 44816 | 67911 |
| VKORC1L1 | 21722 | 44817 | 67912 |
| VKORC1L1 | 21723 | 44818 | 67913 |
| VLDLR | 21724 | 44819 | 67914 |
| VMA21 | 21725 | 44820 | 67915 |
| VMAC | 21726 | 44821 | 67916 |
| VMO1 | 21727 | 44822 | 67917 |
| VMO1 | 21728 | 44823 | 67918 |
| VMO1 | 21729 | 44824 | 67919 |
| VMP1 | 21730 | 44825 | 67920 |
| VN1R1 | 21731 | 44826 | 67921 |
| VN1R2 | 21732 | 44827 | 67922 |
| VN1R3 | 21733 | 44828 | 67923 |
| VN1R4 | 21734 | 44829 | 67924 |
| VN1R5 | 21735 | 44830 | 67925 |
| VNN1 | 21736 | 44831 | 67926 |
| VNN2 | 21737 | 44832 | 67927 |
| VNN3 | 21738 | 44833 | 67928 |
| VNN3 | 21739 | 44834 | 67929 |
| VOPP1 | 21740 | 44835 | 67930 |
| VOPP1 | 21741 | 44836 | 67931 |
| VPREB1 | 21742 | 44837 | 67932 |
| VPREB3 | 21743 | 44838 | 67933 |
| VPS11 | 21744 | 44839 | 67934 |
| VPS13A | 21745 | 44840 | 67935 |
| VPS13A | 21746 | 44841 | 67936 |
| VPS13A | 21747 | 44842 | 67937 |
| VPS13B | 21748 | 44843 | 67938 |
| VPS13B | 21749 | 44844 | 67939 |
| VPS13B | 21750 | 44845 | 67940 |
| VPS13C | 21751 | 44846 | 67941 |
| VPS13C | 21752 | 44847 | 67942 |
| VPS13D | 21753 | 44848 | 67943 |
| VPS16 | 21754 | 44849 | 67944 |
| VPS18 | 21755 | 44850 | 67945 |
| VPS25 | 21756 | 44851 | 67946 |
| VPS26A | 21757 | 44852 | 67947 |
| VPS26A | 21758 | 44853 | 67948 |
| VPS26B | 21759 | 44854 | 67949 |
| VPS28 | 21760 | 44855 | 67950 |
| VPS28 | 21761 | 44856 | 67951 |
| VPS29 | 21762 | 44857 | 67952 |
| VPS33A | 21763 | 44858 | 67953 |
| VPS33A | 21764 | 44859 | 67954 |
| VPS33B | 21765 | 44860 | 67955 |
| VPS35 | 21766 | 44861 | 67956 |
| VPS36 | 21767 | 44862 | 67957 |
| VPS37A | 21768 | 44863 | 67958 |
| VPS37B | 21769 | 44864 | 67959 |
| VPS37C | 21770 | 44865 | 67960 |
| VPS37D | 21771 | 44866 | 67961 |
| VPS39 | 21772 | 44867 | 67962 |
| VPS41 | 21773 | 44868 | 67963 |
| VPS45 | 21774 | 44869 | 67964 |
| VPS45 | 21775 | 44870 | 67965 |
| VPS4A | 21776 | 44871 | 67966 |
| VPS4B | 21777 | 44872 | 67967 |
| VPS50 | 21778 | 44873 | 67968 |
| VPS50 | 21779 | 44874 | 67969 |
| VPS51 | 21780 | 44875 | 67970 |
| VPS52 | 21781 | 44876 | 67971 |
| VPS53 | 21782 | 44877 | 67972 |
| VPS53 | 21783 | 44878 | 67973 |
| VPS54 | 21784 | 44879 | 67974 |
| VPS72 | 21785 | 44880 | 67975 |
| VPS72 | 21786 | 44881 | 67976 |
| VPS8 | 21787 | 44882 | 67977 |
| VPS9D1 | 21788 | 44883 | 67978 |
| VRK1 | 21789 | 44884 | 67979 |
| VRK2 | 21790 | 44885 | 67980 |
| VRK2 | 21791 | 44886 | 67981 |
| VRK3 | 21792 | 44887 | 67982 |
| VRK3 | 21793 | 44888 | 67983 |
| VRTN | 21794 | 44889 | 67984 |
| VSIG1 | 21795 | 44890 | 67985 |
| VSIG10 | 21796 | 44891 | 67986 |
| VSIG10L | 21797 | 44892 | 67987 |
| VSIG2 | 21798 | 44893 | 67988 |
| VSIG2 | 21799 | 44894 | 67989 |
| VSIG4 | 21800 | 44895 | 67990 |
| VSIG4 | 21801 | 44896 | 67991 |
| VSIG4 | 21802 | 44897 | 67992 |
| VSIG8 | 21803 | 44898 | 67993 |
| VSIR | 21804 | 44899 | 67994 |
| VSNL1 | 21805 | 44900 | 67995 |
| VSTM1 | 21806 | 44901 | 67996 |
| VSTM2A | 21807 | 44902 | 67997 |
| VSTM2A | 21808 | 44903 | 67998 |
| VSTM2A | 21809 | 44904 | 67999 |
| VSTM2B | 21810 | 44905 | 68000 |
| VSTM2L | 21811 | 44906 | 68001 |
| VSTM4 | 21812 | 44907 | 68002 |
| VSTM4 | 21813 | 44908 | 68003 |
| VSTM5 | 21814 | 44909 | 68004 |
| VSX1 | 21815 | 44910 | 68005 |
| VSX1 | 21816 | 44911 | 68006 |
| VSX1 | 21817 | 44912 | 68007 |
| VSX1 | 21818 | 44913 | 68008 |
| VSX2 | 21819 | 44914 | 68009 |
| VTA1 | 21820 | 44915 | 68010 |
| VTCN1 | 21821 | 44916 | 68011 |
| VTI1A | 21822 | 44917 | 68012 |
| VTI1A | 21823 | 44918 | 68013 |
| VTI1B | 21824 | 44919 | 68014 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| VTN | 21825 | 44920 | 68015 |
| VWA1 | 21826 | 44921 | 68016 |
| VWA2 | 21827 | 44922 | 68017 |
| VWA3A | 21828 | 44923 | 68018 |
| VWA3B | 21829 | 44924 | 68019 |
| VWA5A | 21830 | 44925 | 68020 |
| VWA5A | 21831 | 44926 | 68021 |
| VWA5B1 | 21832 | 44927 | 68022 |
| VWA5B2 | 21833 | 44928 | 68023 |
| VWA7 | 21834 | 44929 | 68024 |
| VWA8 | 21835 | 44930 | 68025 |
| VWA8 | 21836 | 44931 | 68026 |
| VWC2 | 21837 | 44932 | 68027 |
| VWC2L | 21838 | 44933 | 68028 |
| VWC2L | 21839 | 44934 | 68029 |
| VWCE | 21840 | 44935 | 68030 |
| VWDE | 21841 | 44936 | 68031 |
| VWF | 21842 | 44937 | 68032 |
| WAC | 21843 | 44938 | 68033 |
| WAPL | 21844 | 44939 | 68034 |
| WARS | 21845 | 44940 | 68035 |
| WARS2 | 21846 | 44941 | 68036 |
| WARS2 | 21847 | 44942 | 68037 |
| WAS | 21848 | 44943 | 68038 |
| WASF1 | 21849 | 44944 | 68039 |
| WASF2 | 21850 | 44945 | 68040 |
| WASF2 | 21851 | 44946 | 68041 |
| WASF3 | 21852 | 44947 | 68042 |
| WASHC1 | 21853 | 44948 | 68043 |
| WASHC2A | 21854 | 44949 | 68044 |
| WASHC3 | 21855 | 44950 | 68045 |
| WASHC4 | 21856 | 44951 | 68046 |
| WASHC5 | 21857 | 44952 | 68047 |
| WASL | 21858 | 44953 | 68048 |
| WBP1 | 21859 | 44954 | 68049 |
| WBP11 | 21860 | 44955 | 68050 |
| WBP1L | 21861 | 44956 | 68051 |
| WBP2 | 21862 | 44957 | 68052 |
| WBP2NL | 21863 | 44958 | 68053 |
| WBP4 | 21864 | 44959 | 68054 |
| WDCP | 21865 | 44960 | 68055 |
| WDCP | 21866 | 44961 | 68056 |
| WDFY1 | 21867 | 44962 | 68057 |
| WDFY2 | 21868 | 44963 | 68058 |
| WDFY3 | 21869 | 44964 | 68059 |
| WDFY4 | 21870 | 44965 | 68060 |
| WDHD1 | 21871 | 44966 | 68061 |
| WDPCP | 21872 | 44967 | 68062 |
| WDPCP | 21873 | 44968 | 68063 |
| WDR1 | 21874 | 44969 | 68064 |
| WDR11 | 21875 | 44970 | 68065 |
| WDR12 | 21876 | 44971 | 68066 |
| WDR13 | 21877 | 44972 | 68067 |
| WDR17 | 21878 | 44973 | 68068 |
| WDR18 | 21879 | 44974 | 68069 |
| WDR19 | 21880 | 44975 | 68070 |
| WDR20 | 21881 | 44976 | 68071 |
| WDR20 | 21882 | 44977 | 68072 |
| WDR20 | 21883 | 44978 | 68073 |
| WDR20 | 21884 | 44979 | 68074 |
| WDR20 | 21885 | 44980 | 68075 |
| WDR24 | 21886 | 44981 | 68076 |
| WDR25 | 21887 | 44982 | 68077 |
| WDR26 | 21888 | 44983 | 68078 |
| WDR27 | 21889 | 44984 | 68079 |
| WDR27 | 21890 | 44985 | 68080 |
| WDR3 | 21891 | 44986 | 68081 |
| WDR31 | 21892 | 44987 | 68082 |
| WDR33 | 21893 | 44988 | 68083 |
| WDR33 | 21894 | 44989 | 68084 |
| WDR33 | 21895 | 44990 | 68085 |
| WDR34 | 21896 | 44991 | 68086 |
| WDR35 | 21897 | 44992 | 68087 |
| WDR36 | 21898 | 44993 | 68088 |
| WDR37 | 21899 | 44994 | 68089 |
| WDR38 | 21900 | 44995 | 68090 |
| WDR4 | 21901 | 44996 | 68091 |
| WDR41 | 21902 | 44997 | 68092 |
| WDR43 | 21903 | 44998 | 68093 |
| WDR44 | 21904 | 44999 | 68094 |
| WDR45 | 21905 | 45000 | 68095 |
| WDR45B | 21906 | 45001 | 68096 |
| WDR46 | 21907 | 45002 | 68097 |
| WDR47 | 21908 | 45003 | 68098 |
| WDR48 | 21909 | 45004 | 68099 |
| WDR49 | 21910 | 45005 | 68100 |
| WDR5 | 21911 | 45006 | 68101 |
| WDR53 | 21912 | 45007 | 68102 |
| WDR53 | 21913 | 45008 | 68103 |
| WDR54 | 21914 | 45009 | 68104 |
| WDR54 | 21915 | 45010 | 68105 |
| WDR55 | 21916 | 45011 | 68106 |
| WDR59 | 21917 | 45012 | 68107 |
| WDR59 | 21918 | 45013 | 68108 |
| WDR59 | 21919 | 45014 | 68109 |
| WDR5B | 21920 | 45015 | 68110 |
| WDR6 | 21921 | 45016 | 68111 |
| WDR60 | 21922 | 45017 | 68112 |
| WDR61 | 21923 | 45018 | 68113 |
| WDR62 | 21924 | 45019 | 68114 |
| WDR63 | 21925 | 45020 | 68115 |
| WDR64 | 21926 | 45021 | 68116 |
| WDR66 | 21927 | 45022 | 68117 |
| WDR66 | 21928 | 45023 | 68118 |
| WDR7 | 21929 | 45024 | 68119 |
| WDR70 | 21930 | 45025 | 68120 |
| WDR72 | 21931 | 45026 | 68121 |
| WDR72 | 21932 | 45027 | 68122 |
| WDR73 | 21933 | 45028 | 68123 |
| WDR74 | 21934 | 45029 | 68124 |
| WDR75 | 21935 | 45030 | 68125 |
| WDR76 | 21936 | 45031 | 68126 |
| WDR77 | 21937 | 45032 | 68127 |
| WDR78 | 21938 | 45033 | 68128 |
| WDR78 | 21939 | 45034 | 68129 |
| WDR81 | 21940 | 45035 | 68130 |
| WDR82 | 21941 | 45036 | 68131 |
| WDR83 | 21942 | 45037 | 68132 |
| WDR83OS | 21943 | 45038 | 68133 |
| WDR86 | 21944 | 45039 | 68134 |
| WDR86 | 21945 | 45040 | 68135 |
| WDR86 | 21946 | 45041 | 68136 |
| WDR87 | 21947 | 45042 | 68137 |
| WDR88 | 21948 | 45043 | 68138 |
| WDR89 | 21949 | 45044 | 68139 |
| WDR90 | 21950 | 45045 | 68140 |
| WDR91 | 21951 | 45046 | 68141 |
| WDR92 | 21952 | 45047 | 68142 |
| WDR92 | 21953 | 45048 | 68143 |
| WDR93 | 21954 | 45049 | 68144 |
| WDR93 | 21955 | 45050 | 68145 |
| WDR97 | 21956 | 45051 | 68146 |
| WDSUB1 | 21957 | 45052 | 68147 |
| WDTC1 | 21958 | 45053 | 68148 |
| WDYHV1 | 21959 | 45054 | 68149 |
| WEE1 | 21960 | 45055 | 68150 |
| WEE2 | 21961 | 45056 | 68151 |
| WFDC1 | 21962 | 45057 | 68152 |
| WFDC10A | 21963 | 45058 | 68153 |
| WFDC10B | 21964 | 45059 | 68154 |
| WFDC10B | 21965 | 45060 | 68155 |
| WFDC11 | 21966 | 45061 | 68156 |
| WFDC12 | 21967 | 45062 | 68157 |
| WFDC13 | 21968 | 45063 | 68158 |
| WFDC2 | 21969 | 45064 | 68159 |
| WFDC3 | 21970 | 45065 | 68160 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| WFDC5 | 21971 | 45066 | 68161 |
| WFDC6 | 21972 | 45067 | 68162 |
| WFDC8 | 21973 | 45068 | 68163 |
| WFDC8 | 21974 | 45069 | 68164 |
| WFDC9 | 21975 | 45070 | 68165 |
| WFIKKN1 | 21976 | 45071 | 68166 |
| WFIKKN2 | 21977 | 45072 | 68167 |
| WFS1 | 21978 | 45073 | 68168 |
| WHAMM | 21979 | 45074 | 68169 |
| WHRN | 21980 | 45075 | 68170 |
| WIF1 | 21981 | 45076 | 68171 |
| WIPF1 | 21982 | 45077 | 68172 |
| WIPF2 | 21983 | 45078 | 68173 |
| WIPF3 | 21984 | 45079 | 68174 |
| WIPI1 | 21985 | 45080 | 68175 |
| WIPI2 | 21986 | 45081 | 68176 |
| WISP1 | 21987 | 45082 | 68177 |
| WISP1 | 21988 | 45083 | 68178 |
| WISP2 | 21989 | 45084 | 68179 |
| WISP2 | 21990 | 45085 | 68180 |
| WISP3 | 21991 | 45086 | 68181 |
| WIZ | 21992 | 45087 | 68182 |
| WLS | 21993 | 45088 | 68183 |
| WLS | 21994 | 45089 | 68184 |
| WNK1 | 21995 | 45090 | 68185 |
| WNK2 | 21996 | 45091 | 68186 |
| WNK2 | 21997 | 45092 | 68187 |
| WNK3 | 21998 | 45093 | 68188 |
| WNK4 | 21999 | 45094 | 68189 |
| WNT1 | 22000 | 45095 | 68190 |
| WNT10A | 22001 | 45096 | 68191 |
| WNT10B | 22002 | 45097 | 68192 |
| WNT11 | 22003 | 45098 | 68193 |
| WNT16 | 22004 | 45099 | 68194 |
| WNT2 | 22005 | 45100 | 68195 |
| WNT2B | 22006 | 45101 | 68196 |
| WNT3 | 22007 | 45102 | 68197 |
| WNT3A | 22008 | 45103 | 68198 |
| WNT4 | 22009 | 45104 | 68199 |
| WNT5A | 22010 | 45105 | 68200 |
| WNT5B | 22011 | 45106 | 68201 |
| WNT6 | 22012 | 45107 | 68202 |
| WNT7A | 22013 | 45108 | 68203 |
| WNT7B | 22014 | 45109 | 68204 |
| WNT8A | 22015 | 45110 | 68205 |
| WNT8A | 22016 | 45111 | 68206 |
| WNT8B | 22017 | 45112 | 68207 |
| WNT9A | 22018 | 45113 | 68208 |
| WNT9B | 22019 | 45114 | 68209 |
| WNT9B | 22020 | 45115 | 68210 |
| WRAP53 | 22021 | 45116 | 68211 |
| WRAP73 | 22022 | 45117 | 68212 |
| WRB | 22023 | 45118 | 68213 |
| WRB-SH3BGR | 22024 | 45119 | 68214 |
| WRN | 22025 | 45120 | 68215 |
| WRNIP1 | 22026 | 45121 | 68216 |
| WSB1 | 22027 | 45122 | 68217 |
| WSB2 | 22028 | 45123 | 68218 |
| WSCD1 | 22029 | 45124 | 68219 |
| WSCD2 | 22030 | 45125 | 68220 |
| WT1 | 22031 | 45126 | 68221 |
| WTAP | 22032 | 45127 | 68222 |
| WTAP | 22033 | 45128 | 68223 |
| WTAP | 22034 | 45129 | 68224 |
| WTH3DI | 22035 | 45130 | 68225 |
| WTIP | 22036 | 45131 | 68226 |
| WWC1 | 22037 | 45132 | 68227 |
| WWC2 | 22038 | 45133 | 68228 |
| WWC3 | 22039 | 45134 | 68229 |
| WWOX | 22040 | 45135 | 68230 |
| WWOX | 22041 | 45136 | 68231 |
| WWP1 | 22042 | 45137 | 68232 |
| WWP2 | 22043 | 45138 | 68233 |
| WWP2 | 22044 | 45139 | 68234 |
| WWTR1 | 22045 | 45140 | 68235 |
| XAB2 | 22046 | 45141 | 68236 |
| XAF1 | 22047 | 45142 | 68237 |
| XAGE1B | 22048 | 45143 | 68238 |
| XAGE1E | 22049 | 45144 | 68239 |
| XAGE2 | 22050 | 45145 | 68240 |
| XAGE3 | 22051 | 45146 | 68241 |
| XAGE5 | 22052 | 45147 | 68242 |
| XBP1 | 22053 | 45148 | 68243 |
| XBP1 | 22054 | 45149 | 68244 |
| XCL1 | 22055 | 45150 | 68245 |
| XCL2 | 22056 | 45151 | 68246 |
| XCR1 | 22057 | 45152 | 68247 |
| XDH | 22058 | 45153 | 68248 |
| XG | 22059 | 45154 | 68249 |
| XIAP | 22060 | 45155 | 68250 |
| XIRP1 | 22061 | 45156 | 68251 |
| XIRP1 | 22062 | 45157 | 68252 |
| XIRP2 | 22063 | 45158 | 68253 |
| XIRP2 | 22064 | 45159 | 68254 |
| XK | 22065 | 45160 | 68255 |
| XKR3 | 22066 | 45161 | 68256 |
| XKR4 | 22067 | 45162 | 68257 |
| XKR5 | 22068 | 45163 | 68258 |
| XKR6 | 22069 | 45164 | 68259 |
| XKR7 | 22070 | 45165 | 68260 |
| XKR8 | 22071 | 45166 | 68261 |
| XKR9 | 22072 | 45167 | 68262 |
| XKRX | 22073 | 45168 | 68263 |
| XKRY | 22074 | 45169 | 68264 |
| XPA | 22075 | 45170 | 68265 |
| XPC | 22076 | 45171 | 68266 |
| XPNPEP1 | 22077 | 45172 | 68267 |
| XPNPEP1 | 22078 | 45173 | 68268 |
| XPNPEP2 | 22079 | 45174 | 68269 |
| XPNPEP3 | 22080 | 45175 | 68270 |
| XPNPEP3 | 22081 | 45176 | 68271 |
| XPO1 | 22082 | 45177 | 68272 |
| XPO4 | 22083 | 45178 | 68273 |
| XPO5 | 22084 | 45179 | 68274 |
| XPO6 | 22085 | 45180 | 68275 |
| XPO7 | 22086 | 45181 | 68276 |
| XPOT | 22087 | 45182 | 68277 |
| XPR1 | 22088 | 45183 | 68278 |
| XPR1 | 22089 | 45184 | 68279 |
| XRCC1 | 22090 | 45185 | 68280 |
| XRCC2 | 22091 | 45186 | 68281 |
| XRCC3 | 22092 | 45187 | 68282 |
| XRCC4 | 22093 | 45188 | 68283 |
| XRCC4 | 22094 | 45189 | 68284 |
| XRCC5 | 22095 | 45190 | 68285 |
| XRCC6 | 22096 | 45191 | 68286 |
| XRN1 | 22097 | 45192 | 68287 |
| XRN1 | 22098 | 45193 | 68288 |
| XRN2 | 22099 | 45194 | 68289 |
| XRRA1 | 22100 | 45195 | 68290 |
| XRRA1 | 22101 | 45196 | 68291 |
| XXYLT1 | 22102 | 45197 | 68292 |
| XYLB | 22103 | 45198 | 68293 |
| XYLB | 22104 | 45199 | 68294 |
| XYLB | 22105 | 45200 | 68295 |
| XYLT1 | 22106 | 45201 | 68296 |
| XYLT2 | 22107 | 45202 | 68297 |
| YAE1D1 | 22108 | 45203 | 68298 |
| YAE1D1 | 22109 | 45204 | 68299 |
| YAF2 | 22110 | 45205 | 68300 |
| YAF2 | 22111 | 45206 | 68301 |
| YAP1 | 22112 | 45207 | 68302 |
| YARS | 22113 | 45208 | 68303 |
| YARS2 | 22114 | 45209 | 68304 |
| YBEY | 22115 | 45210 | 68305 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| YBEY | 22116 | 45211 | 68306 |
| YBX1 | 22117 | 45212 | 68307 |
| YBX2 | 22118 | 45213 | 68308 |
| YBX3 | 22119 | 45214 | 68309 |
| YDJC | 22120 | 45215 | 68310 |
| YEATS2 | 22121 | 45216 | 68311 |
| YEATS2 | 22122 | 45217 | 68312 |
| YEATS4 | 22123 | 45218 | 68313 |
| YES1 | 22124 | 45219 | 68314 |
| YIF1A | 22125 | 45220 | 68315 |
| YIF1B | 22126 | 45221 | 68316 |
| YIF1B | 22127 | 45222 | 68317 |
| YIPF1 | 22128 | 45223 | 68318 |
| YIPF2 | 22129 | 45224 | 68319 |
| YIPF3 | 22130 | 45225 | 68320 |
| YIPF4 | 22131 | 45226 | 68321 |
| YIPF5 | 22132 | 45227 | 68322 |
| YIPF6 | 22133 | 45228 | 68323 |
| YIPF7 | 22134 | 45229 | 68324 |
| YJEFN3 | 22135 | 45230 | 68325 |
| YKT6 | 22136 | 45231 | 68326 |
| YLPM1 | 22137 | 45232 | 68327 |
| YME1L1 | 22138 | 45233 | 68328 |
| YOD1 | 22139 | 45234 | 68329 |
| YPEL1 | 22140 | 45235 | 68330 |
| YPEL2 | 22141 | 45236 | 68331 |
| YPEL3 | 22142 | 45237 | 68332 |
| YPEL4 | 22143 | 45238 | 68333 |
| YPEL5 | 22144 | 45239 | 68334 |
| YRDC | 22145 | 45240 | 68335 |
| YTHDC1 | 22146 | 45241 | 68336 |
| YTHDC2 | 22147 | 45242 | 68337 |
| YTHDF1 | 22148 | 45243 | 68338 |
| YTHDF2 | 22149 | 45244 | 68339 |
| YTHDF3 | 22150 | 45245 | 68340 |
| YWHAB | 22151 | 45246 | 68341 |
| YWHAE | 22152 | 45247 | 68342 |
| YWHAG | 22153 | 45248 | 68343 |
| YWHAH | 22154 | 45249 | 68344 |
| YWHAQ | 22155 | 45250 | 68345 |
| YWHAZ | 22156 | 45251 | 68346 |
| YY1 | 22157 | 45252 | 68347 |
| YY1AP1 | 22158 | 45253 | 68348 |
| YY1AP1 | 22159 | 45254 | 68349 |
| YY2 | 22160 | 45255 | 68350 |
| ZACN | 22161 | 45256 | 68351 |
| ZADH2 | 22162 | 45257 | 68352 |
| ZAN | 22163 | 45258 | 68353 |
| ZAP70 | 22164 | 45259 | 68354 |
| ZAR1 | 22165 | 45260 | 68355 |
| ZAR1L | 22166 | 45261 | 68356 |
| ZASP | 22167 | 45262 | 68357 |
| ZBBX | 22168 | 45263 | 68358 |
| ZBED1 | 22169 | 45264 | 68359 |
| ZBED2 | 22170 | 45265 | 68360 |
| ZBED3 | 22171 | 45266 | 68361 |
| ZBED4 | 22172 | 45267 | 68362 |
| ZBED5 | 22173 | 45268 | 68363 |
| ZBED6 | 22174 | 45269 | 68364 |
| ZBED6CL | 22175 | 45270 | 68365 |
| ZBED8 | 22176 | 45271 | 68366 |
| ZBED9 | 22177 | 45272 | 68367 |
| ZBP1 | 22178 | 45273 | 68368 |
| ZBP1 | 22179 | 45274 | 68369 |
| ZBTB1 | 22180 | 45275 | 68370 |
| ZBTB1 | 22181 | 45276 | 68371 |
| ZBTB10 | 22182 | 45277 | 68372 |
| ZBTB11 | 22183 | 45278 | 68373 |
| ZBTB12 | 22184 | 45279 | 68374 |
| ZBTB14 | 22185 | 45280 | 68375 |
| ZBTB16 | 22186 | 45281 | 68376 |
| ZBTB17 | 22187 | 45282 | 68377 |
| ZBTB18 | 22188 | 45283 | 68378 |
| ZBTB2 | 22189 | 45284 | 68379 |
| ZBTB20 | 22190 | 45285 | 68380 |
| ZBTB21 | 22191 | 45286 | 68381 |
| ZBTB22 | 22192 | 45287 | 68382 |
| ZBTB24 | 22193 | 45288 | 68383 |
| ZBTB24 | 22194 | 45289 | 68384 |
| ZBTB25 | 22195 | 45290 | 68385 |
| ZBTB25 | 22196 | 45291 | 68386 |
| ZBTB26 | 22197 | 45292 | 68387 |
| ZBTB3 | 22198 | 45293 | 68388 |
| ZBTB32 | 22199 | 45294 | 68389 |
| ZBTB33 | 22200 | 45295 | 68390 |
| ZBTB34 | 22201 | 45296 | 68391 |
| ZBTB37 | 22202 | 45297 | 68392 |
| ZBTB37 | 22203 | 45298 | 68393 |
| ZBTB37 | 22204 | 45299 | 68394 |
| ZBTB38 | 22205 | 45300 | 68395 |
| ZBTB39 | 22206 | 45301 | 68396 |
| ZBTB4 | 22207 | 45302 | 68397 |
| ZBTB40 | 22208 | 45303 | 68398 |
| ZBTB41 | 22209 | 45304 | 68399 |
| ZBTB42 | 22210 | 45305 | 68400 |
| ZBTB43 | 22211 | 45306 | 68401 |
| ZBTB44 | 22212 | 45307 | 68402 |
| ZBTB44 | 22213 | 45308 | 68403 |
| ZBTB44 | 22214 | 45309 | 68404 |
| ZBTB45 | 22215 | 45310 | 68405 |
| ZBTB46 | 22216 | 45311 | 68406 |
| ZBTB47 | 22217 | 45312 | 68407 |
| ZBTB48 | 22218 | 45313 | 68408 |
| ZBTB49 | 22219 | 45314 | 68409 |
| ZBTB5 | 22220 | 45315 | 68410 |
| ZBTB6 | 22221 | 45316 | 68411 |
| ZBTB7A | 22222 | 45317 | 68412 |
| ZBTB7B | 22223 | 45318 | 68413 |
| ZBTB7C | 22224 | 45319 | 68414 |
| ZBTB8A | 22225 | 45320 | 68415 |
| ZBTB8A | 22226 | 45321 | 68416 |
| ZBTB8B | 22227 | 45322 | 68417 |
| ZBTB8OS | 22228 | 45323 | 68418 |
| ZBTB8OS | 22229 | 45324 | 68419 |
| ZBTB9 | 22230 | 45325 | 68420 |
| ZC2HC1A | 22231 | 45326 | 68421 |
| ZC2HC1B | 22232 | 45327 | 68422 |
| ZC2HC1C | 22233 | 45328 | 68423 |
| ZC2HC1C | 22234 | 45329 | 68424 |
| ZC2HC1C | 22235 | 45330 | 68425 |
| ZC3H10 | 22236 | 45331 | 68426 |
| ZC3H11A | 22237 | 45332 | 68427 |
| ZC3H12A | 22238 | 45333 | 68428 |
| ZC3H12B | 22239 | 45334 | 68429 |
| ZC3H12C | 22240 | 45335 | 68430 |
| ZC3H12D | 22241 | 45336 | 68431 |
| ZC3H13 | 22242 | 45337 | 68432 |
| ZC3H13 | 22243 | 45338 | 68433 |
| ZC3H14 | 22244 | 45339 | 68434 |
| ZC3H15 | 22245 | 45340 | 68435 |
| ZC3H18 | 22246 | 45341 | 68436 |
| ZC3H3 | 22247 | 45342 | 68437 |
| ZC3H4 | 22248 | 45343 | 68438 |
| ZC3H6 | 22249 | 45344 | 68439 |
| ZC3H7A | 22250 | 45345 | 68440 |
| ZC3H7B | 22251 | 45346 | 68441 |
| ZC3H8 | 22252 | 45347 | 68442 |
| ZC3HAV1 | 22253 | 45348 | 68443 |
| ZC3HAV1 | 22254 | 45349 | 68444 |
| ZC3HAV1L | 22255 | 45350 | 68445 |
| ZC3HC1 | 22256 | 45351 | 68446 |
| ZC4H2 | 22257 | 45352 | 68447 |
| ZCCHC10 | 22258 | 45353 | 68448 |
| ZCCHC10 | 22259 | 45354 | 68449 |
| ZCCHC11 | 22260 | 45355 | 68450 |
| ZCCHC12 | 22261 | 45356 | 68451 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| ZCCHC13 | 22262 | 45357 | 68452 |
| ZCCHC14 | 22263 | 45358 | 68453 |
| ZCCHC17 | 22264 | 45359 | 68454 |
| ZCCHC17 | 22265 | 45360 | 68455 |
| ZCCHC17 | 22266 | 45361 | 68456 |
| ZCCHC18 | 22267 | 45362 | 68457 |
| ZCCHC2 | 22268 | 45363 | 68458 |
| ZCCHC23 | 22269 | 45364 | 68459 |
| ZCCHC24 | 22270 | 45365 | 68460 |
| ZCCHC3 | 22271 | 45366 | 68461 |
| ZCCHC4 | 22272 | 45367 | 68462 |
| ZCCHC4 | 22273 | 45368 | 68463 |
| ZCCHC6 | 22274 | 45369 | 68464 |
| ZCCHC7 | 22275 | 45370 | 68465 |
| ZCCHC8 | 22276 | 45371 | 68466 |
| ZCCHC9 | 22277 | 45372 | 68467 |
| ZCRB1 | 22278 | 45373 | 68468 |
| ZCWPW1 | 22279 | 45374 | 68469 |
| ZCWPW1 | 22280 | 45375 | 68470 |
| ZCWPW2 | 22281 | 45376 | 68471 |
| ZDBF2 | 22282 | 45377 | 68472 |
| ZDHHC1 | 22283 | 45378 | 68473 |
| ZDHHC1 | 22284 | 45379 | 68474 |
| ZDHHC11 | 22285 | 45380 | 68475 |
| ZDHHC12 | 22286 | 45381 | 68476 |
| ZDHHC12 | 22287 | 45382 | 68477 |
| ZDHHC12 | 22288 | 45383 | 68478 |
| ZDHHC13 | 22289 | 45384 | 68479 |
| ZDHHC14 | 22290 | 45385 | 68480 |
| ZDHHC15 | 22291 | 45386 | 68481 |
| ZDHHC15 | 22292 | 45387 | 68482 |
| ZDHHC16 | 22293 | 45388 | 68483 |
| ZDHHC17 | 22294 | 45389 | 68484 |
| ZDHHC18 | 22295 | 45390 | 68485 |
| ZDHHC19 | 22296 | 45391 | 68486 |
| ZDHHC2 | 22297 | 45392 | 68487 |
| ZDHHC20 | 22298 | 45393 | 68488 |
| ZDHHC20 | 22299 | 45394 | 68489 |
| ZDHHC21 | 22300 | 45395 | 68490 |
| ZDHHC22 | 22301 | 45396 | 68491 |
| ZDHHC23 | 22302 | 45397 | 68492 |
| ZDHHC23 | 22303 | 45398 | 68493 |
| ZDHHC24 | 22304 | 45399 | 68494 |
| ZDHHC24 | 22305 | 45400 | 68495 |
| ZDHHC3 | 22306 | 45401 | 68496 |
| ZDHHC3 | 22307 | 45402 | 68497 |
| ZDHHC4 | 22308 | 45403 | 68498 |
| ZDHHC5 | 22309 | 45404 | 68499 |
| ZDHHC6 | 22310 | 45405 | 68500 |
| ZDHHC7 | 22311 | 45406 | 68501 |
| ZDHHC8 | 22312 | 45407 | 68502 |
| ZDHHC8 | 22313 | 45408 | 68503 |
| ZDHHC9 | 22314 | 45409 | 68504 |
| ZEB1 | 22315 | 45410 | 68505 |
| ZEB2 | 22316 | 45411 | 68506 |
| ZER1 | 22317 | 45412 | 68507 |
| ZFAND1 | 22318 | 45413 | 68508 |
| ZFAND1 | 22319 | 45414 | 68509 |
| ZFAND2A | 22320 | 45415 | 68510 |
| ZFAND2B | 22321 | 45416 | 68511 |
| ZFAND3 | 22322 | 45417 | 68512 |
| ZFAND4 | 22323 | 45418 | 68513 |
| ZFAND5 | 22324 | 45419 | 68514 |
| ZFAND6 | 22325 | 45420 | 68515 |
| ZFAT | 22326 | 45421 | 68516 |
| ZFC3H1 | 22327 | 45422 | 68517 |
| ZFHX2 | 22328 | 45423 | 68518 |
| ZFHX3 | 22329 | 45424 | 68519 |
| ZFHX4 | 22330 | 45425 | 68520 |
| ZFP1 | 22331 | 45426 | 68521 |
| ZFP14 | 22332 | 45427 | 68522 |
| ZFP2 | 22333 | 45428 | 68523 |
| ZFP28 | 22334 | 45429 | 68524 |
| ZFP28 | 22335 | 45430 | 68525 |
| ZFP3 | 22336 | 45431 | 68526 |
| ZFP30 | 22337 | 45432 | 68527 |
| ZFP36 | 22338 | 45433 | 68528 |
| ZFP36L1 | 22339 | 45434 | 68529 |
| ZFP36L2 | 22340 | 45435 | 68530 |
| ZFP37 | 22341 | 45436 | 68531 |
| ZFP41 | 22342 | 45437 | 68532 |
| ZFP42 | 22343 | 45438 | 68533 |
| ZFP57 | 22344 | 45439 | 68534 |
| ZFP62 | 22345 | 45440 | 68535 |
| ZFP64 | 22346 | 45441 | 68536 |
| ZFP64 | 22347 | 45442 | 68537 |
| ZFP69 | 22348 | 45443 | 68538 |
| ZFP69B | 22349 | 45444 | 68539 |
| ZFP82 | 22350 | 45445 | 68540 |
| ZFP82 | 22351 | 45446 | 68541 |
| ZFP82 | 22352 | 45447 | 68542 |
| ZFP90 | 22353 | 45448 | 68543 |
| ZFP90 | 22354 | 45449 | 68544 |
| ZFP91 | 22355 | 45450 | 68545 |
| ZFP92 | 22356 | 45451 | 68546 |
| ZFPL1 | 22357 | 45452 | 68547 |
| ZFPM1 | 22358 | 45453 | 68548 |
| ZFPM2 | 22359 | 45454 | 68549 |
| ZFR | 22360 | 45455 | 68550 |
| ZFR2 | 22361 | 45456 | 68551 |
| ZFR2 | 22362 | 45457 | 68552 |
| ZFX | 22363 | 45458 | 68553 |
| ZFX | 22364 | 45459 | 68554 |
| ZFY | 22365 | 45460 | 68555 |
| ZFYVE1 | 22366 | 45461 | 68556 |
| ZFYVE16 | 22367 | 45462 | 68557 |
| ZFYVE16 | 22368 | 45463 | 68558 |
| ZFYVE19 | 22369 | 45464 | 68559 |
| ZFYVE21 | 22370 | 45465 | 68560 |
| ZFYVE26 | 22371 | 45466 | 68561 |
| ZFYVE27 | 22372 | 45467 | 68562 |
| ZFYVE28 | 22373 | 45468 | 68563 |
| ZFYVE28 | 22374 | 45469 | 68564 |
| ZFYVE28 | 22375 | 45470 | 68565 |
| ZFYVE28 | 22376 | 45471 | 68566 |
| ZFYVE9 | 22377 | 45472 | 68567 |
| ZG16 | 22378 | 45473 | 68568 |
| ZG16B | 22379 | 45474 | 68569 |
| ZGLP1 | 22380 | 45475 | 68570 |
| ZGPAT | 22381 | 45476 | 68571 |
| ZGRF1 | 22382 | 45477 | 68572 |
| ZHX1 | 22383 | 45478 | 68573 |
| ZHX1-C8orf76 | 22384 | 45479 | 68574 |
| ZHX2 | 22385 | 45480 | 68575 |
| ZHX3 | 22386 | 45481 | 68576 |
| ZIC1 | 22387 | 45482 | 68577 |
| ZIC2 | 22388 | 45483 | 68578 |
| ZIC3 | 22389 | 45484 | 68579 |
| ZIC3 | 22390 | 45485 | 68580 |
| ZIC4 | 22391 | 45486 | 68581 |
| ZIC5 | 22392 | 45487 | 68582 |
| ZIK1 | 22393 | 45488 | 68583 |
| ZIM2 | 22394 | 45489 | 68584 |
| ZIM3 | 22395 | 45490 | 68585 |
| ZKSCAN1 | 22396 | 45491 | 68586 |
| ZKSCAN1 | 22397 | 45492 | 68587 |
| ZKSCAN2 | 22398 | 45493 | 68588 |
| ZKSCAN3 | 22399 | 45494 | 68589 |
| ZKSCAN4 | 22400 | 45495 | 68590 |
| ZKSCAN5 | 22401 | 45496 | 68591 |
| ZKSCAN7 | 22402 | 45497 | 68592 |
| ZKSCAN7 | 22403 | 45498 | 68593 |
| ZKSCAN7 | 22404 | 45499 | 68594 |
| ZKSCAN8 | 22405 | 45500 | 68595 |
| ZMAT1 | 22406 | 45501 | 68596 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| ZMAT2 | 22407 | 45502 | 68597 |
| ZMAT3 | 22408 | 45503 | 68598 |
| ZMAT4 | 22409 | 45504 | 68599 |
| ZMAT5 | 22410 | 45505 | 68600 |
| ZMIZ1 | 22411 | 45506 | 68601 |
| ZMIZ2 | 22412 | 45507 | 68602 |
| ZMPSTE24 | 22413 | 45508 | 68603 |
| ZMYM1 | 22414 | 45509 | 68604 |
| ZMYM2 | 22415 | 45510 | 68605 |
| ZMYM2 | 22416 | 45511 | 68606 |
| ZMYM3 | 22417 | 45512 | 68607 |
| ZMYM3 | 22418 | 45513 | 68608 |
| ZMYM4 | 22419 | 45514 | 68609 |
| ZMYM5 | 22420 | 45515 | 68610 |
| ZMYM5 | 22421 | 45516 | 68611 |
| ZMYM5 | 22422 | 45517 | 68612 |
| ZMYM6 | 22423 | 45518 | 68613 |
| ZMYND10 | 22424 | 45519 | 68614 |
| ZMYND11 | 22425 | 45520 | 68615 |
| ZMYND11 | 22426 | 45521 | 68616 |
| ZMYND12 | 22427 | 45522 | 68617 |
| ZMYND15 | 22428 | 45523 | 68618 |
| ZMYND19 | 22429 | 45524 | 68619 |
| ZMYND8 | 22430 | 45525 | 68620 |
| ZMYND8 | 22431 | 45526 | 68621 |
| ZNF10 | 22432 | 45527 | 68622 |
| ZNF100 | 22433 | 45528 | 68623 |
| ZNF101 | 22434 | 45529 | 68624 |
| ZNF106 | 22435 | 45530 | 68625 |
| ZNF107 | 22436 | 45531 | 68626 |
| ZNF112 | 22437 | 45532 | 68627 |
| ZNF114 | 22438 | 45533 | 68628 |
| ZNF117 | 22439 | 45534 | 68629 |
| ZNF12 | 22440 | 45535 | 68630 |
| ZNF121 | 22441 | 45536 | 68631 |
| ZNF124 | 22442 | 45537 | 68632 |
| ZNF124 | 22443 | 45538 | 68633 |
| ZNF124 | 22444 | 45539 | 68634 |
| ZNF131 | 22445 | 45540 | 68635 |
| ZNF132 | 22446 | 45541 | 68636 |
| ZNF133 | 22447 | 45542 | 68637 |
| ZNF134 | 22448 | 45543 | 68638 |
| ZNF135 | 22449 | 45544 | 68639 |
| ZNF135 | 22450 | 45545 | 68640 |
| ZNF136 | 22451 | 45546 | 68641 |
| ZNF138 | 22452 | 45547 | 68642 |
| ZNF14 | 22453 | 45548 | 68643 |
| ZNF140 | 22454 | 45549 | 68644 |
| ZNF141 | 22455 | 45550 | 68645 |
| ZNF141 | 22456 | 45551 | 68646 |
| ZNF141 | 22457 | 45552 | 68647 |
| ZNF141 | 22458 | 45553 | 68648 |
| ZNF142 | 22459 | 45554 | 68649 |
| ZNF143 | 22460 | 45555 | 68650 |
| ZNF146 | 22461 | 45556 | 68651 |
| ZNF148 | 22462 | 45557 | 68652 |
| ZNF148 | 22463 | 45558 | 68653 |
| ZNF154 | 22464 | 45559 | 68654 |
| ZNF155 | 22465 | 45560 | 68655 |
| ZNF157 | 22466 | 45561 | 68656 |
| ZNF16 | 22467 | 45562 | 68657 |
| ZNF160 | 22468 | 45563 | 68658 |
| ZNF160 | 22469 | 45564 | 68659 |
| ZNF165 | 22470 | 45565 | 68660 |
| ZNF169 | 22471 | 45566 | 68661 |
| ZNF17 | 22472 | 45567 | 68662 |
| ZNF174 | 22473 | 45568 | 68663 |
| ZNF174 | 22474 | 45569 | 68664 |
| ZNF174 | 22475 | 45570 | 68665 |
| ZNF175 | 22476 | 45571 | 68666 |
| ZNF18 | 22477 | 45572 | 68667 |
| ZNF180 | 22478 | 45573 | 68668 |
| ZNF181 | 22479 | 45574 | 68669 |
| ZNF182 | 22480 | 45575 | 68670 |
| ZNF184 | 22481 | 45576 | 68671 |
| ZNF185 | 22482 | 45577 | 68672 |
| ZNF189 | 22483 | 45578 | 68673 |
| ZNF19 | 22484 | 45579 | 68674 |
| ZNF195 | 22485 | 45580 | 68675 |
| ZNF2 | 22486 | 45581 | 68676 |
| ZNF20 | 22487 | 45582 | 68677 |
| ZNF200 | 22488 | 45583 | 68678 |
| ZNF202 | 22489 | 45584 | 68679 |
| ZNF205 | 22490 | 45585 | 68680 |
| ZNF207 | 22491 | 45586 | 68681 |
| ZNF208 | 22492 | 45587 | 68682 |
| ZNF208 | 22493 | 45588 | 68683 |
| ZNF208 | 22494 | 45589 | 68684 |
| ZNF208 | 22495 | 45590 | 68685 |
| ZNF211 | 22496 | 45591 | 68686 |
| ZNF212 | 22497 | 45592 | 68687 |
| ZNF213 | 22498 | 45593 | 68688 |
| ZNF214 | 22499 | 45594 | 68689 |
| ZNF215 | 22500 | 45595 | 68690 |
| ZNF217 | 22501 | 45596 | 68691 |
| ZNF219 | 22502 | 45597 | 68692 |
| ZNF22 | 22503 | 45598 | 68693 |
| ZNF221 | 22504 | 45599 | 68694 |
| ZNF224 | 22505 | 45600 | 68695 |
| ZNF225 | 22506 | 45601 | 68696 |
| ZNF226 | 22507 | 45602 | 68697 |
| ZNF226 | 22508 | 45603 | 68698 |
| ZNF227 | 22509 | 45604 | 68699 |
| ZNF229 | 22510 | 45605 | 68700 |
| ZNF23 | 22511 | 45606 | 68701 |
| ZNF232 | 22512 | 45607 | 68702 |
| ZNF233 | 22513 | 45608 | 68703 |
| ZNF234 | 22514 | 45609 | 68704 |
| ZNF235 | 22515 | 45610 | 68705 |
| ZNF236 | 22516 | 45611 | 68706 |
| ZNF239 | 22517 | 45612 | 68707 |
| ZNF24 | 22518 | 45613 | 68708 |
| ZNF24 | 22519 | 45614 | 68709 |
| ZNF248 | 22520 | 45615 | 68710 |
| ZNF248 | 22521 | 45616 | 68711 |
| ZNF248 | 22522 | 45617 | 68712 |
| ZNF25 | 22523 | 45618 | 68713 |
| ZNF250 | 22524 | 45619 | 68714 |
| ZNF251 | 22525 | 45620 | 68715 |
| ZNF253 | 22526 | 45621 | 68716 |
| ZNF254 | 22527 | 45622 | 68717 |
| ZNF254 | 22528 | 45623 | 68718 |
| ZNF256 | 22529 | 45624 | 68719 |
| ZNF257 | 22530 | 45625 | 68720 |
| ZNF26 | 22531 | 45626 | 68721 |
| ZNF260 | 22532 | 45627 | 68722 |
| ZNF263 | 22533 | 45628 | 68723 |
| ZNF264 | 22534 | 45629 | 68724 |
| ZNF266 | 22535 | 45630 | 68725 |
| ZNF267 | 22536 | 45631 | 68726 |
| ZNF268 | 22537 | 45632 | 68727 |
| ZNF273 | 22538 | 45633 | 68728 |
| ZNF274 | 22539 | 45634 | 68729 |
| ZNF275 | 22540 | 45635 | 68730 |
| ZNF276 | 22541 | 45636 | 68731 |
| ZNF277 | 22542 | 45637 | 68732 |
| ZNF28 | 22543 | 45638 | 68733 |
| ZNF280A | 22544 | 45639 | 68734 |
| ZNF280B | 22545 | 45640 | 68735 |
| ZNF280C | 22546 | 45641 | 68736 |
| ZNF280D | 22547 | 45642 | 68737 |
| ZNF280D | 22548 | 45643 | 68738 |
| ZNF280D | 22549 | 45644 | 68739 |
| ZNF281 | 22550 | 45645 | 68740 |
| ZNF282 | 22551 | 45646 | 68741 |
| ZNF282 | 22552 | 45647 | 68742 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| ZNF283 | 22553 | 45648 | 68743 |
| ZNF284 | 22554 | 45649 | 68744 |
| ZNF285 | 22555 | 45650 | 68745 |
| ZNF286A | 22556 | 45651 | 68746 |
| ZNF287 | 22557 | 45652 | 68747 |
| ZNF292 | 22558 | 45653 | 68748 |
| ZNF296 | 22559 | 45654 | 68749 |
| ZNF3 | 22560 | 45655 | 68750 |
| ZNF3 | 22561 | 45656 | 68751 |
| ZNF3 | 22562 | 45657 | 68752 |
| ZNF30 | 22563 | 45658 | 68753 |
| ZNF300 | 22564 | 45659 | 68754 |
| ZNF302 | 22565 | 45660 | 68755 |
| ZNF304 | 22566 | 45661 | 68756 |
| ZNF311 | 22567 | 45662 | 68757 |
| ZNF316 | 22568 | 45663 | 68758 |
| ZNF317 | 22569 | 45664 | 68759 |
| ZNF318 | 22570 | 45665 | 68760 |
| ZNF319 | 22571 | 45666 | 68761 |
| ZNF32 | 22572 | 45667 | 68762 |
| ZNF320 | 22573 | 45668 | 68763 |
| ZNF320 | 22574 | 45669 | 68764 |
| ZNF322 | 22575 | 45670 | 68765 |
| ZNF324 | 22576 | 45671 | 68766 |
| ZNF324B | 22577 | 45672 | 68767 |
| ZNF326 | 22578 | 45673 | 68768 |
| ZNF326 | 22579 | 45674 | 68769 |
| ZNF329 | 22580 | 45675 | 68770 |
| ZNF330 | 22581 | 45676 | 68771 |
| ZNF331 | 22582 | 45677 | 68772 |
| ZNF333 | 22583 | 45678 | 68773 |
| ZNF333 | 22584 | 45679 | 68774 |
| ZNF333 | 22585 | 45680 | 68775 |
| ZNF334 | 22586 | 45681 | 68776 |
| ZNF335 | 22587 | 45682 | 68777 |
| ZNF337 | 22588 | 45683 | 68778 |
| ZNF33A | 22589 | 45684 | 68779 |
| ZNF33B | 22590 | 45685 | 68780 |
| ZNF34 | 22591 | 45686 | 68781 |
| ZNF341 | 22592 | 45687 | 68782 |
| ZNF343 | 22593 | 45688 | 68783 |
| ZNF343 | 22594 | 45689 | 68784 |
| ZNF345 | 22595 | 45690 | 68785 |
| ZNF346 | 22596 | 45691 | 68786 |
| ZNF346 | 22597 | 45692 | 68787 |
| ZNF346 | 22598 | 45693 | 68788 |
| ZNF346 | 22599 | 45694 | 68789 |
| ZNF347 | 22600 | 45695 | 68790 |
| ZNF35 | 22601 | 45696 | 68791 |
| ZNF350 | 22602 | 45697 | 68792 |
| ZNF354A | 22603 | 45698 | 68793 |
| ZNF354B | 22604 | 45699 | 68794 |
| ZNF354C | 22605 | 45700 | 68795 |
| ZNF358 | 22606 | 45701 | 68796 |
| ZNF362 | 22607 | 45702 | 68797 |
| ZNF365 | 22608 | 45703 | 68798 |
| ZNF365 | 22609 | 45704 | 68799 |
| ZNF365 | 22610 | 45705 | 68800 |
| ZNF366 | 22611 | 45706 | 68801 |
| ZNF367 | 22612 | 45707 | 68802 |
| ZNF37A | 22613 | 45708 | 68803 |
| ZNF37A | 22614 | 45709 | 68804 |
| ZNF37A | 22615 | 45710 | 68805 |
| ZNF37A | 22616 | 45711 | 68806 |
| ZNF382 | 22617 | 45712 | 68807 |
| ZNF383 | 22618 | 45713 | 68808 |
| ZNF384 | 22619 | 45714 | 68809 |
| ZNF385A | 22620 | 45715 | 68810 |
| ZNF385B | 22621 | 45716 | 68811 |
| ZNF385C | 22622 | 45717 | 68812 |
| ZNF385D | 22623 | 45718 | 68813 |
| ZNF391 | 22624 | 45719 | 68814 |
| ZNF394 | 22625 | 45720 | 68815 |
| ZNF394 | 22626 | 45721 | 68816 |
| ZNF395 | 22627 | 45722 | 68817 |
| ZNF396 | 22628 | 45723 | 68818 |
| ZNF396 | 22629 | 45724 | 68819 |
| ZNF396 | 22630 | 45725 | 68820 |
| ZNF397 | 22631 | 45726 | 68821 |
| ZNF397 | 22632 | 45727 | 68822 |
| ZNF398 | 22633 | 45728 | 68823 |
| ZNF404 | 22634 | 45729 | 68824 |
| ZNF407 | 22635 | 45730 | 68825 |
| ZNF407 | 22636 | 45731 | 68826 |
| ZNF407 | 22637 | 45732 | 68827 |
| ZNF408 | 22638 | 45733 | 68828 |
| ZNF41 | 22639 | 45734 | 68829 |
| ZNF410 | 22640 | 45735 | 68830 |
| ZNF410 | 22641 | 45736 | 68831 |
| ZNF410 | 22642 | 45737 | 68832 |
| ZNF414 | 22643 | 45738 | 68833 |
| ZNF414 | 22644 | 45739 | 68834 |
| ZNF415 | 22645 | 45740 | 68835 |
| ZNF416 | 22646 | 45741 | 68836 |
| ZNF417 | 22647 | 45742 | 68837 |
| ZNF418 | 22648 | 45743 | 68838 |
| ZNF419 | 22649 | 45744 | 68839 |
| ZNF420 | 22650 | 45745 | 68840 |
| ZNF420 | 22651 | 45746 | 68841 |
| ZNF420 | 22652 | 45747 | 68842 |
| ZNF423 | 22653 | 45748 | 68843 |
| ZNF425 | 22654 | 45749 | 68844 |
| ZNF426 | 22655 | 45750 | 68845 |
| ZNF428 | 22656 | 45751 | 68846 |
| ZNF429 | 22657 | 45752 | 68847 |
| ZNF43 | 22658 | 45753 | 68848 |
| ZNF430 | 22659 | 45754 | 68849 |
| ZNF431 | 22660 | 45755 | 68850 |
| ZNF432 | 22661 | 45756 | 68851 |
| ZNF433 | 22662 | 45757 | 68852 |
| ZNF436 | 22663 | 45758 | 68853 |
| ZNF438 | 22664 | 45759 | 68854 |
| ZNF439 | 22665 | 45760 | 68855 |
| ZNF44 | 22666 | 45761 | 68856 |
| ZNF440 | 22667 | 45762 | 68857 |
| ZNF441 | 22568 | 45763 | 68858 |
| ZNF443 | 22669 | 45764 | 68859 |
| ZNF444 | 22670 | 45765 | 68860 |
| ZNF445 | 22671 | 45766 | 68861 |
| ZNF446 | 22672 | 45767 | 68862 |
| ZNF446 | 22673 | 45768 | 68863 |
| ZNF449 | 22674 | 45769 | 68864 |
| ZNF45 | 22675 | 45770 | 68865 |
| ZNF451 | 22676 | 45771 | 68866 |
| ZNF451 | 22677 | 45772 | 68867 |
| ZNF454 | 22678 | 45773 | 68868 |
| ZNF454 | 22679 | 45774 | 68869 |
| ZNF460 | 22680 | 45775 | 68870 |
| ZNF461 | 22681 | 45776 | 68871 |
| ZNF462 | 22682 | 45777 | 68872 |
| ZNF467 | 22683 | 45778 | 68873 |
| ZNF467 | 22684 | 45779 | 68874 |
| ZNF468 | 22685 | 45780 | 68875 |
| ZNF469 | 22686 | 45781 | 68876 |
| ZNF470 | 22687 | 45782 | 68877 |
| ZNF471 | 22688 | 45783 | 68878 |
| ZNF473 | 22689 | 45784 | 68879 |
| ZNF474 | 22690 | 45785 | 68880 |
| ZNF479 | 22691 | 45786 | 68881 |
| ZNF48 | 22692 | 45787 | 68882 |
| ZNF480 | 22693 | 45788 | 68883 |
| ZNF483 | 22694 | 45789 | 68884 |
| ZNF483 | 22695 | 45790 | 68885 |
| ZNF484 | 22696 | 45791 | 68886 |
| ZNF485 | 22697 | 45792 | 68887 |
| ZNF486 | 22698 | 45793 | 68888 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| ZNF488 | 22699 | 45794 | 68889 |
| ZNF490 | 22700 | 45795 | 68890 |
| ZNF491 | 22701 | 45796 | 68891 |
| ZNF492 | 22702 | 45797 | 68892 |
| ZNF493 | 22703 | 45798 | 68893 |
| ZNF493 | 22704 | 45799 | 68894 |
| ZNF496 | 22705 | 45800 | 68895 |
| ZNF496 | 22706 | 45801 | 68896 |
| ZNF497 | 22707 | 45802 | 68897 |
| ZNF500 | 22708 | 45803 | 68898 |
| ZNF500 | 22709 | 45804 | 68899 |
| ZNF501 | 22710 | 45805 | 68900 |
| ZNF502 | 22711 | 45806 | 68901 |
| ZNF503 | 22712 | 45807 | 68902 |
| ZNF506 | 22713 | 45808 | 68903 |
| ZNF507 | 22714 | 45809 | 68904 |
| ZNF510 | 22715 | 45810 | 68905 |
| ZNF511 | 22716 | 45811 | 68906 |
| ZNF512 | 22717 | 45812 | 68907 |
| ZNF512B | 22718 | 45813 | 68908 |
| ZNF513 | 22719 | 45814 | 68909 |
| ZNF514 | 22720 | 45815 | 68910 |
| ZNF516 | 22721 | 45816 | 68911 |
| ZNF517 | 22722 | 45817 | 68912 |
| ZNF518A | 22723 | 45818 | 68913 |
| ZNF518B | 22724 | 45819 | 68914 |
| ZNF519 | 22725 | 45820 | 68915 |
| ZNF521 | 22726 | 45821 | 68916 |
| ZNF524 | 22727 | 45822 | 68917 |
| ZNF525 | 22728 | 45823 | 68918 |
| ZNF526 | 22729 | 45824 | 68919 |
| ZNF527 | 22730 | 45825 | 68920 |
| ZNF528 | 22731 | 45826 | 68921 |
| ZNF529 | 22732 | 45827 | 68922 |
| ZNF530 | 22733 | 45828 | 68923 |
| ZNF532 | 22734 | 45829 | 68924 |
| ZNF534 | 22735 | 45830 | 68925 |
| ZNF534 | 22736 | 45831 | 68926 |
| ZNF536 | 22737 | 45832 | 68927 |
| ZNF536 | 22738 | 45833 | 68928 |
| ZNF540 | 22739 | 45834 | 68929 |
| ZNF541 | 22740 | 45835 | 68930 |
| ZNF543 | 22741 | 45836 | 68931 |
| ZNF544 | 22742 | 45837 | 68932 |
| ZNF544 | 22743 | 45838 | 68933 |
| ZNF544 | 22744 | 45839 | 68934 |
| ZNF544 | 22745 | 45840 | 68935 |
| ZNF544 | 22746 | 45841 | 68936 |
| ZNF546 | 22747 | 45842 | 68937 |
| ZNF547 | 22748 | 45843 | 68938 |
| ZNF548 | 22749 | 45844 | 68939 |
| ZNF549 | 22750 | 45845 | 68940 |
| ZNF550 | 22751 | 45846 | 68941 |
| ZNF550 | 22752 | 45847 | 68942 |
| ZNF551 | 22753 | 45848 | 68943 |
| ZNF552 | 22754 | 45849 | 68944 |
| ZNF554 | 22755 | 45850 | 68945 |
| ZNF555 | 22756 | 45851 | 68946 |
| ZNF556 | 22757 | 45852 | 68947 |
| ZNF557 | 22758 | 45853 | 68948 |
| ZNF558 | 22759 | 45854 | 68949 |
| ZNF559 | 22760 | 45855 | 68950 |
| ZNF559-ZNF177 | 22761 | 45856 | 68951 |
| ZNF560 | 22762 | 45857 | 68952 |
| ZNF561 | 22763 | 45858 | 68953 |
| ZNF562 | 22764 | 45859 | 68954 |
| ZNF563 | 22765 | 45860 | 68955 |
| ZNF564 | 22766 | 45861 | 68956 |
| ZNF565 | 22767 | 45862 | 68957 |
| ZNF566 | 22768 | 45863 | 68958 |
| ZNF567 | 22769 | 45864 | 68959 |
| ZNF568 | 22770 | 45865 | 68960 |
| ZNF568 | 22771 | 45866 | 68961 |
| ZNF569 | 22772 | 45867 | 68962 |
| ZNF57 | 22773 | 45868 | 68963 |
| ZNF570 | 22774 | 45869 | 68964 |
| ZNF571 | 22775 | 45870 | 68965 |
| ZNF572 | 22776 | 45871 | 68966 |
| ZNF573 | 22777 | 45872 | 68967 |
| ZNF574 | 22778 | 45873 | 68968 |
| ZNF575 | 22779 | 45874 | 68969 |
| ZNF576 | 22780 | 45875 | 68970 |
| ZNF577 | 22781 | 45876 | 68971 |
| ZNF578 | 22782 | 45877 | 68972 |
| ZNF579 | 22783 | 45878 | 68973 |
| ZNF580 | 22784 | 45879 | 68974 |
| ZNF581 | 22785 | 45880 | 68975 |
| ZNF582 | 22786 | 45881 | 68976 |
| ZNF583 | 22787 | 45882 | 68977 |
| ZNF584 | 22788 | 45883 | 68978 |
| ZNF584 | 22789 | 45884 | 68979 |
| ZNF585A | 22790 | 45885 | 68980 |
| ZNF586 | 22791 | 45886 | 68981 |
| ZNF586 | 22792 | 45887 | 68982 |
| ZNF587B | 22793 | 45888 | 68983 |
| ZNF589 | 22794 | 45889 | 68984 |
| ZNF592 | 22795 | 45890 | 68985 |
| ZNF593 | 22796 | 45891 | 68986 |
| ZNF594 | 22797 | 45892 | 68987 |
| ZNF595 | 22798 | 45893 | 68988 |
| ZNF596 | 22799 | 45894 | 68989 |
| ZNF597 | 22800 | 45895 | 68990 |
| ZNF598 | 22801 | 45896 | 68991 |
| ZNF599 | 22802 | 45897 | 68992 |
| ZNF600 | 22803 | 45898 | 68993 |
| ZNF605 | 22804 | 45899 | 68994 |
| ZNF606 | 22805 | 45900 | 68995 |
| ZNF607 | 22806 | 45901 | 68996 |
| ZNF608 | 22807 | 45902 | 68997 |
| ZNF609 | 22808 | 45903 | 68998 |
| ZNF610 | 22809 | 45904 | 68999 |
| ZNF611 | 22810 | 45905 | 69000 |
| ZNF613 | 22811 | 45906 | 69001 |
| ZNF614 | 22812 | 45907 | 69002 |
| ZNF615 | 22813 | 45908 | 69003 |
| ZNF616 | 22814 | 45909 | 69004 |
| ZNF618 | 22815 | 45910 | 69005 |
| ZNF619 | 22816 | 45911 | 69006 |
| ZNF620 | 22817 | 45912 | 69007 |
| ZNF621 | 22818 | 45913 | 69008 |
| ZNF621 | 22819 | 45914 | 69009 |
| ZNF622 | 22820 | 45915 | 69010 |
| ZNF623 | 22821 | 45916 | 69011 |
| ZNF624 | 22822 | 45917 | 69012 |
| ZNF625 | 22823 | 45918 | 69013 |
| ZNF626 | 22824 | 45919 | 69014 |
| ZNF626 | 22825 | 45920 | 69015 |
| ZNF627 | 22826 | 45921 | 69016 |
| ZNF628 | 22827 | 45922 | 69017 |
| ZNF629 | 22828 | 45923 | 69018 |
| ZNF630 | 22829 | 45924 | 69019 |
| ZNF638 | 22830 | 45925 | 69020 |
| ZNF639 | 22831 | 45926 | 69021 |
| ZNF641 | 22832 | 45927 | 69022 |
| ZNF644 | 22833 | 45928 | 69023 |
| ZNF645 | 22834 | 45929 | 69024 |
| ZNF646 | 22835 | 45930 | 69025 |
| ZNF648 | 22836 | 45931 | 69026 |
| ZNF649 | 22837 | 45932 | 69027 |
| ZNF652 | 22838 | 45933 | 69028 |
| ZNF653 | 22839 | 45934 | 69029 |
| ZNF654 | 22840 | 45935 | 69030 |
| ZNF655 | 22841 | 45936 | 69031 |
| ZNF655 | 22842 | 45937 | 69032 |
| ZNF658 | 22843 | 45938 | 69033 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| ZNF660 | 22844 | 45939 | 69034 |
| ZNF660-ZNF197 | 22845 | 45940 | 69035 |
| ZNF660-ZNF197 | 22846 | 45941 | 69036 |
| ZNF662 | 22847 | 45942 | 69037 |
| ZNF664 | 22848 | 45943 | 69038 |
| ZNF664-RFLNA | 22849 | 45944 | 69039 |
| ZNF665 | 22850 | 45945 | 69040 |
| ZNF667 | 22851 | 45946 | 69041 |
| ZNF668 | 22852 | 45947 | 69042 |
| ZNF669 | 22853 | 45948 | 69043 |
| ZNF670 | 22854 | 45949 | 69044 |
| ZNF671 | 22855 | 45950 | 69045 |
| ZNF672 | 22856 | 45951 | 69046 |
| ZNF674 | 22857 | 45952 | 69047 |
| ZNF675 | 22858 | 45953 | 69048 |
| ZNF676 | 22859 | 45954 | 69049 |
| ZNF677 | 22860 | 45955 | 69050 |
| ZNF678 | 22861 | 45956 | 69051 |
| ZNF679 | 22862 | 45957 | 69052 |
| ZNF680 | 22863 | 45958 | 69053 |
| ZNF680 | 22864 | 45959 | 69054 |
| ZNF681 | 22865 | 45960 | 69055 |
| ZNF682 | 22866 | 45961 | 69056 |
| ZNF683 | 22867 | 45962 | 69057 |
| ZNF684 | 22868 | 45963 | 69058 |
| ZNF687 | 22869 | 45964 | 69059 |
| ZNF688 | 22870 | 45965 | 69060 |
| ZNF689 | 22871 | 45966 | 69061 |
| ZNF69 | 22872 | 45967 | 69062 |
| ZNF691 | 22873 | 45968 | 69063 |
| ZNF692 | 22874 | 45969 | 69064 |
| ZNF695 | 22875 | 45970 | 69065 |
| ZNF695 | 22876 | 45971 | 69066 |
| ZNF696 | 22877 | 45972 | 69067 |
| ZNF697 | 22878 | 45973 | 69068 |
| ZNF699 | 22879 | 45974 | 69069 |
| ZNF7 | 22880 | 45975 | 69070 |
| ZNF7 | 22881 | 45976 | 69071 |
| ZNF70 | 22882 | 45977 | 69072 |
| ZNF700 | 22883 | 45978 | 69073 |
| ZNF701 | 22884 | 45979 | 69074 |
| ZNF703 | 22885 | 45980 | 69075 |
| ZNF704 | 22886 | 45981 | 69076 |
| ZNF705A | 22887 | 45982 | 69077 |
| ZNF705E | 22888 | 45983 | 69078 |
| ZNF705G | 22889 | 45984 | 69079 |
| ZNF706 | 22890 | 45985 | 69080 |
| ZNF707 | 22891 | 45986 | 69081 |
| ZNF708 | 22892 | 45987 | 69082 |
| ZNF709 | 22893 | 45988 | 69083 |
| ZNF71 | 22894 | 45989 | 69084 |
| ZNF710 | 22895 | 45990 | 69085 |
| ZNF711 | 22896 | 45991 | 69086 |
| ZNF713 | 22897 | 45992 | 69087 |
| ZNF714 | 22898 | 45993 | 69088 |
| ZNF716 | 22899 | 45994 | 69089 |
| ZNF717 | 22900 | 45995 | 69090 |
| ZNF717 | 22901 | 45996 | 69091 |
| ZNF717 | 22902 | 45997 | 69092 |
| ZNF718 | 22903 | 45998 | 69093 |
| ZNF720 | 22904 | 45999 | 69094 |
| ZNF721 | 22905 | 46000 | 69095 |
| ZNF723 | 22906 | 46001 | 69096 |
| ZNF726 | 22907 | 46002 | 69097 |
| ZNF726 | 22908 | 46003 | 69098 |
| ZNF726 | 22909 | 46004 | 69099 |
| ZNF726 | 22910 | 46005 | 69100 |
| ZNF727 | 22911 | 46006 | 69101 |
| ZNF728 | 22912 | 46007 | 69102 |
| ZNF729 | 22913 | 46008 | 69103 |
| ZNF730 | 22914 | 46009 | 69104 |
| ZNF732 | 22915 | 46010 | 69105 |
| ZNF735 | 22916 | 46011 | 69106 |
| ZNF736 | 22917 | 46012 | 69107 |
| ZNF736 | 22918 | 46013 | 69108 |
| ZNF737 | 22919 | 46014 | 69109 |
| ZNF74 | 22920 | 46015 | 69110 |
| ZNF740 | 22921 | 46016 | 69111 |
| ZNF746 | 22922 | 46017 | 69112 |
| ZNF747 | 22923 | 46018 | 69113 |
| ZNF747 | 22924 | 46019 | 69114 |
| ZNF749 | 22925 | 46020 | 69115 |
| ZNF750 | 22926 | 46021 | 69116 |
| ZNF75A | 22927 | 46022 | 69117 |
| ZNF75A | 22928 | 46023 | 69118 |
| ZNF75A | 22929 | 46024 | 69119 |
| ZNF75D | 22930 | 46025 | 69120 |
| ZNF76 | 22931 | 46026 | 69121 |
| ZNF761 | 22932 | 46027 | 69122 |
| ZNF761 | 22933 | 46028 | 69123 |
| ZNF763 | 22934 | 46029 | 69124 |
| ZNF764 | 22935 | 46030 | 69125 |
| ZNF765 | 22936 | 46031 | 69126 |
| ZNF766 | 22937 | 46032 | 69127 |
| ZNF768 | 22938 | 46033 | 69128 |
| ZNF77 | 22939 | 46034 | 69129 |
| ZNF770 | 22940 | 46035 | 69130 |
| ZNF771 | 22941 | 46036 | 69131 |
| ZNF772 | 22942 | 46037 | 69132 |
| ZNF773 | 22943 | 46038 | 69133 |
| ZNF773 | 22944 | 46039 | 69134 |
| ZNF774 | 22945 | 46040 | 69135 |
| ZNF775 | 22946 | 46041 | 69136 |
| ZNF776 | 22947 | 46042 | 69137 |
| ZNF776 | 22948 | 46043 | 69138 |
| ZNF777 | 22949 | 46044 | 69139 |
| ZNF778 | 22950 | 46045 | 69140 |
| ZNF780A | 22951 | 46046 | 69141 |
| ZNF780A | 22952 | 46047 | 69142 |
| ZNF780B | 22953 | 46048 | 69143 |
| ZNF781 | 22954 | 46049 | 69144 |
| ZNF782 | 22955 | 46050 | 69145 |
| ZNF783 | 22956 | 46051 | 69146 |
| ZNF784 | 22957 | 46052 | 69147 |
| ZNF785 | 22958 | 46053 | 69148 |
| ZNF786 | 22959 | 46054 | 69149 |
| ZNF787 | 22960 | 46055 | 69150 |
| ZNF787 | 22961 | 46056 | 69151 |
| ZNF788 | 22962 | 46057 | 69152 |
| ZNF789 | 22963 | 46058 | 69153 |
| ZNF789 | 22964 | 46059 | 69154 |
| ZNF789 | 22965 | 46060 | 69155 |
| ZNF79 | 22966 | 46061 | 69156 |
| ZNF790 | 22967 | 46062 | 69157 |
| ZNF791 | 22968 | 46063 | 69158 |
| ZNF792 | 22969 | 46064 | 69159 |
| ZNF793 | 22970 | 46065 | 69160 |
| ZNF799 | 22971 | 46066 | 69161 |
| ZNF8 | 22972 | 46067 | 69162 |
| ZNF80 | 22973 | 46068 | 69163 |
| ZNF800 | 22974 | 46069 | 69164 |
| ZNF804A | 22975 | 46070 | 69165 |
| ZNF804B | 22976 | 46071 | 69166 |
| ZNF808 | 22977 | 46072 | 69167 |
| ZNF81 | 22978 | 46073 | 69168 |
| ZNF814 | 22979 | 46074 | 69169 |
| ZNF816 | 22980 | 46075 | 69170 |
| ZNF816-ZNF321P | 22981 | 46076 | 69171 |
| ZNF821 | 22982 | 46077 | 69172 |
| ZNF823 | 22983 | 46078 | 69173 |
| ZNF827 | 22984 | 46079 | 69174 |
| ZNF827 | 22985 | 46080 | 69175 |

TABLE 2-continued

Target Genes (Each target gene name is followed by three SEQ ID NOs corresponding to the genomic target site, the adjacent sequence for mapping, and the oligonucleotide sequence used for generating a single guide RNA specific for the gene).

| Gene | SEQ ID | | |
|---|---|---|---|
| ZNF829 | 22986 | 46081 | 69176 |
| ZNF83 | 22987 | 46082 | 69177 |
| ZNF830 | 22988 | 46083 | 69178 |
| ZNF831 | 22989 | 46084 | 69179 |
| ZNF835 | 22990 | 46085 | 69180 |
| ZNF836 | 22991 | 46086 | 69181 |
| ZNF837 | 22992 | 46087 | 69182 |
| ZNF839 | 22993 | 46088 | 69183 |
| ZNF84 | 22994 | 46089 | 69184 |
| ZNF841 | 22995 | 46090 | 69185 |
| ZNF841 | 22996 | 46091 | 69186 |
| ZNF843 | 22997 | 46092 | 69187 |
| ZNF844 | 22998 | 46093 | 69188 |
| ZNF845 | 22999 | 46094 | 69189 |
| ZNF846 | 23000 | 46095 | 69190 |
| ZNF846 | 23001 | 46096 | 69191 |
| ZNF85 | 23002 | 46097 | 69192 |
| ZNF85 | 23003 | 46098 | 69193 |
| ZNF850 | 23004 | 46099 | 69194 |
| ZNF852 | 23005 | 46100 | 69195 |
| ZNF853 | 23006 | 46101 | 69196 |
| ZNF860 | 23007 | 46102 | 69197 |
| ZNF862 | 23008 | 46103 | 69198 |
| ZNF865 | 23009 | 46104 | 69199 |
| ZNF878 | 23010 | 46105 | 69200 |
| ZNF879 | 23011 | 46106 | 69201 |
| ZNF880 | 23012 | 46107 | 69202 |
| ZNF883 | 23013 | 46108 | 69203 |
| ZNF888 | 23014 | 46109 | 69204 |
| ZNF891 | 23015 | 46110 | 69205 |
| ZNF90 | 23016 | 46111 | 69206 |
| ZNF91 | 23017 | 46112 | 69207 |
| ZNF92 | 23018 | 46113 | 69208 |
| ZNF93 | 23019 | 46114 | 69209 |
| ZNF98 | 23020 | 46115 | 69210 |
| ZNF99 | 23021 | 46116 | 69211 |
| ZNFX1 | 23022 | 46117 | 69212 |
| ZNHIT1 | 23023 | 46118 | 69213 |
| ZNHIT2 | 23024 | 46119 | 69214 |
| ZNHIT3 | 23025 | 46120 | 69215 |
| ZNHIT3 | 23026 | 46121 | 69216 |
| ZNHIT3 | 23027 | 46122 | 69217 |
| ZNHIT6 | 23028 | 46123 | 69218 |
| ZNRD1 | 23029 | 46124 | 69219 |
| ZNRF1 | 23030 | 46125 | 69220 |
| ZNRF2 | 23031 | 46126 | 69221 |
| ZNRF3 | 23032 | 46127 | 69222 |
| ZNRF4 | 23033 | 46128 | 69223 |
| ZP1 | 23034 | 46129 | 69224 |
| ZP2 | 23035 | 46130 | 69225 |
| ZP3 | 23036 | 46131 | 69226 |
| ZP4 | 23037 | 46132 | 69227 |
| ZPBP | 23038 | 46133 | 69228 |
| ZPBP2 | 23039 | 46134 | 69229 |
| ZPLD1 | 23040 | 46135 | 69230 |
| ZPR1 | 23041 | 46136 | 69231 |
| ZRANB1 | 23042 | 46137 | 69232 |
| ZRANB2 | 23043 | 46138 | 69233 |
| ZRANB2 | 23044 | 46139 | 69234 |
| ZRANB3 | 23045 | 46140 | 69235 |
| ZRSR2 | 23046 | 46141 | 69236 |
| ZSCAN1 | 23047 | 46142 | 69237 |
| ZSCAN10 | 23048 | 46143 | 69238 |
| ZSCAN12 | 23049 | 46144 | 69239 |
| ZSCAN16 | 23050 | 46145 | 69240 |
| ZSCAN16 | 23051 | 46146 | 69241 |
| ZSCAN16 | 23052 | 46147 | 69242 |
| ZSCAN18 | 23053 | 46148 | 69243 |
| ZSCAN2 | 23054 | 46149 | 69244 |
| ZSCAN2 | 23055 | 46150 | 69245 |
| ZSCAN2 | 23056 | 46151 | 69246 |
| ZSCAN20 | 23057 | 46152 | 69247 |
| ZSCAN21 | 23058 | 46153 | 69248 |
| ZSCAN22 | 23059 | 46154 | 69249 |
| ZSCAN22 | 23060 | 46155 | 69250 |
| ZSCAN23 | 23061 | 46156 | 69251 |
| ZSCAN25 | 23062 | 46157 | 69252 |
| ZSCAN25 | 23063 | 46158 | 69253 |
| ZSCAN25 | 23064 | 46159 | 69254 |
| ZSCAN26 | 23065 | 46160 | 69255 |
| ZSCAN29 | 23066 | 46161 | 69256 |
| ZSCAN30 | 23067 | 46162 | 69257 |
| ZSCAN31 | 23068 | 46163 | 69258 |
| ZSCAN32 | 23069 | 46164 | 69259 |
| ZSCAN4 | 23070 | 46165 | 69260 |
| ZSCAN5A | 23071 | 46166 | 69261 |
| ZSCAN5B | 23072 | 46167 | 69262 |
| ZSCAN9 | 23073 | 46168 | 69263 |
| ZSWIM1 | 23074 | 46169 | 69264 |
| ZSWIM2 | 23075 | 46170 | 69265 |
| ZSWIM3 | 23076 | 46171 | 69266 |
| ZSWIM4 | 23077 | 46172 | 69267 |
| ZSWIM5 | 23078 | 46173 | 69268 |
| ZSWIM6 | 23079 | 46174 | 69269 |
| ZSWIM7 | 23080 | 46175 | 69270 |
| ZSWIM8 | 23081 | 46176 | 69271 |
| ZSWIM8 | 23082 | 46177 | 69272 |
| ZSWIM9 | 23083 | 46178 | 69273 |
| ZUFSP | 23084 | 46179 | 69274 |
| ZW10 | 23085 | 46180 | 69275 |
| ZWILCH | 23086 | 46181 | 69276 |
| ZWINT | 23087 | 46182 | 69277 |
| ZXDA | 23088 | 46183 | 69278 |
| ZXDC | 23089 | 46184 | 69279 |
| ZXDC | 23090 | 46185 | 69280 |
| ZYG11A | 23091 | 46186 | 69281 |
| ZYG11B | 23092 | 46187 | 69282 |
| ZYX | 23093 | 46188 | 69283 |
| ZZEF1 | 23094 | 46189 | 69284 |
| ZZZ3 | 23095 | 46190 | 69285 |

TABLE 3

| Pools of small molecules | | | | |
|---|---|---|---|---|
| Pool 1 | Pool 2 | Pool 3 | Pool 4 | Pool 5 |
| OSI-930 | RAF265 (CHIR-265) | L-H-Rhamnose Monohydrate | Akti-1/2 | GW788388 |
| KU-0063794 | AZD1480 | Lappaconitine | Coelenterazine | Milciclib (PHA-848125) |

TABLE 3-continued

| Pools of small molecules | | | | |
|---|---|---|---|---|
| 2-Methoxyestradiol (2-MeOE2) | PF-4708671 | Limonin | Smoothened Agonist (SAG) HCl | HER2-Inhibitor-1 |
| AG-1024 | PD128907 HCl | Luteolin | Combretastatin A4 | A1406 (SM-406) |
| Latrepirdine 2HCl | Givinostat (ITF2357) | Magnolol | SRT2104 (GSK2245840) | CUDC-907 |
| JNJ-7706621 | AG-14361 | (+)-Matrine | Purvalanol A | NVP-BVU972 |
| CHIR-99021 (CT99021) | SB743921 HCl | Methyl-Hesperidin | ORY-1001 (RG-6016) 2HCl | MK-2048 |
| PD173074 | AST-1306 | Morin Hydrate | GSK2879552 2HCl | 3-Methyladenine (3-MA) |
| WYE-354 | SB505124 | Myricetin | GNE-317 | Dovitinib (TKI-258) Dilactic Acid |
| BX-795 | Avasimibe | Myricitrin | A-1155463 | MK-5108 (VX-689) |
| BX-912 | Sapitinib (AZD8931) | Naringin | A-1331852 | Dalcetrapib (JTT-705, RO4607381) |
| Celastrol | GSK461364 | Neohesperidin Dihydrochalcone (Nhdc) | GSK503 | SB705498 |
| Epothilone A | R406 | Neohesperidin | FRAX486 | MK-2461 |
| Ki16425 | Lexibulin (CYT997) | Nobiletin | A17519 HCl | Nocodazole |
| Costunolide | A-966492 | Oleanolic Acid | MHY1485 | CPI-613 |
| Ginkgolide B | SGI-1776 free base | Oridonin | Itacitinib (INCB39110) | PF-5274857 |
| TG100-115 | Raf265 derivative | Osthole | AMG319 | GW842166X |
| Glesatinib? (MGCD265) | BMS-794833 | Oxymatrine | AI-10-49 | M344 |
| Ki8751 | NVP-BHG712 | Paeonol | MI-136 | RITA (NSC652287) |
| BMS-707035 | OSI-420 | (−)-Parthenolide | MI-463 | GW4064 |
| Pirarubicin | PIK-293 | Phloretin | MI-503 | Vistusertib (AZD2014) |
| Droxinostat | AZ 960 | Phlorizin | EPZ020411 2HCl | TAK-285 |
| Aurora A Inhibitor I | DAPT (GSI-IX) | Puerarin | Nazartinib (EGF816, NVS-816) | A-803467 |
| Tipifarnib | Torkinib (PP242) | Quercetin Dihydrate | 4-Hydroxytamoxifen | VU 0357121 |
| PHA-680632 | Momelotinib (CYT387) | Rotenone (Barbasco) | Licochalcone A | WP1066 |
| VX-745 | SB590885 | Rutaecarpine | SGC707 | AZD4547 |
| Thiazovivin | PF-3716556 | Salicin | OICR-9429 | Sirtinol |
| SP600125 | UK 383367 | Sclareol | Cyclo (-RGDfK) | CEP-33779 |
| AZD6482 | TAME | Sclareolide | I-BRD9 | Ipatasertib (GDC-0068) |
| Calcitriol | PIK-294 | Shikimic Acid | Endoxifen HCl | MPEP |
| GSK429286A | Belnacasan (VX-765) | Silymarin | BI-847325 | Sapanisertib (INK 128, MLN0128) |
| SB525334 | Telatinib | Sinomenine | Cyclo (RGDyK) | AT101 |
| MC1568 | Palomid 529 (P529) | Solanesol (Nonaisoprenol) | SirReal2 | Ciproxifan Maleate |
| HMN-214 | Tubacin | Synephrine | SGI-7079 | Tyrphostin AG 879 |
| AEE788 (NVP-AEE788) | Degrasyn (WP1130) | Tangeretin | BDA-366 | Torin 2 |
| PHA-793887 | AR-42 | Tanshinone I | AZD3264 | Tacedinaline (CI994) |
| PIK-93 | Buparlisib (BKM120, NVP-BKM120) | Tanshinone IIA | Brilanestrant (GDC-0810, ARN-810) | AM251 |
| Cefaclor | (−)-Epigallocatechin Gallate | Taxifolin (Dihydroquercetin) | 8-Bromo-cAMP | TAE226 (NVP-TAE226) |
| AT7519 | (+)-Usniacin | Tetrahydropapaverine HCl | SC79 | RG108 |
| Adavosertib (MK-1775) | 3-Indolebutyric acid (IBA) | Ursolic Acid | Oleuropein | 00000459 |
| LY2811376 | 4-Demethylepipodophyllotoxin (NSC-122819, VM-26) | Vanillylacetone | LJH685 | TPCA-1 |

TABLE 3-continued

| Pools of small molecules | | | | |
|---|---|---|---|---|
| Hesperadin | 4-Methylumbelliferone (4-MU) | Xanthone | LJI308 | ML133 HCl |
| BIX 02188 | Esculin | Aloin | NVP-CGM097 | JNJ-1661010 |
| BIX 02189 | Aloe-emodin | Biochanin A | ONO-4059 analogue | Epiandrosterone |
| AZD7762 | Amygdalin | Dioscin | BQ-123 | Apalutamide? (ARN-509) |
| R406 (free base) | Andrographolide | Diosmetin | AMI-1 | SAR131675 |
| Org 27569 | Apigenin | Gastrodin | SBI-0206965 | BI-D1870 |
| CP-673451 | Arbutin | Hematoxylin | CC-223 | Semaxanib (SU5416) |
| DMXAA (Vadimezan) | Asiatic Acid | Hordenine | Spautin-1 | Cathepsin Inhibitor 1 |
| AM1241 | Azomycin | Indirubin | Xanthohumol | SB269970 HCl |
| SB408124 | Baicalein | Lappaconite HBr | CC-115 | BRL-54443 |
| AZD8055 | Baicalin | Naringin Dihydrochalcone | Avadomide (CC-122) | BML-190 |
| PHT-427 | Bergenin | Polydatin | Sodium Tauroursodeoxy cholate (TUDC) | MRS 2578 |
| KRN 633 | Berberine chloride | Quercetin | GSK621 | SB 271046 hydrochloride |
| A17867 | Bilobalide | Sesamin | SW033291 | (−)-MK 801 maleate |
| BMS-777607 | Caffeic Acid | Naringenin | PFI-4 | StemRegenin 1 (SR1) |
| PD318088 | Chlorogenic Acid | Salidroside | Dp44mT | Golvatinib (E7050) |
| KU-60019 | Chrysin | Palmatine chloride | PD-1/PD-L1 inhibitor 1 | IEM 1754 2HBr |
| BS-181 HCl | Cinchonidine | Dihydromyricetin | BMS202 (PD-1/PD-L1 inhibitor 2) | CTEP (RO4956371) |
| Tie2 kinase inhibitor | Cinchonine (LA40221) | Sodium Danshensu | MCB-613 | VU 0364770 |
| H 89 2HCl | Cryptotanshinone | Isoliquiritigenin | Isoxazole 9 (ISX-9) | ML130 (Nodinitib-1) |
| TWS119 | Cytisine | Sophocarpine | B10-acetoxime | IMD 0354 |
| Lubiprostone | Daidzin | Chrysophanic Acid | Kenpaullone | VUF 10166 |
| Daidzein | Emodin | Curcumol | Bromodeoxyuridme (BrdU) | U-104 |
| Cyclocytidine HCl | Fisetin | Cephalomannine | DEL-22379 | WHI-P154 |
| PCI-34051 | Formononetin | 10-Deacetylbaccatin-III | Tiplaxtinin (PAI-039) | T0070907 |
| PF-573228 | Ferulic Acid | Paeoniflorin | SH5-07 (SH-5-07) | GW5074 |
| BMS-265246 | Genistin (Genistoside) | Geniposide | Bay K 8644 | (+)-MK 801 maleate |
| Suplatast Tosylate | Glycyrrhizin (Glycyrrhizic Acid) | Genipin | Lifirafenib (BGB-283) | IKK-16 (IKK Inhibitor VII) |
| ENMD-2076 L-(+)-Tartaric acid | gossypol-Acetic acid | Geniposidic acid | WZB117 | 4-Aminohippuric Acid |
| Ginkgolide A | Gramine | Astragaloside A | DASA-58 | Acesulfame Potassium |
| Cytidine | Gynostemma Extract | 20-Hydroxyecdysone | BEC HCl | A-205804 |
| Arbidol HCl | Hesperetin | (S)-10-Hydroxycamptothecin | Ixabepilone (BMS-247550) | PF-562271 |
| AZD8330 | Hesperidin | Apocynin | STF-31 | GW441756 |
| GSK1292263 | Honokiol | Rotundine | Indisulam | VU 0361737 |
| CGS 21680 HCl | Hyodeoxycholic acid (HDCA) | Synephrine HCl | Y-39983 HCl | SB742457 |
| LY2608204 | Icariin | Guanosine | KDO25 (SLx-2119) | Tyrphostin 9 |
| LY2886721 | Indole-3-carbinol | Gambogic Acid | Nemiralisib (GSK2269557) | ZM 323881 HCl |
| KW-2449 | Kaempferol | Forskolin | GSK2292767 | ZM 306416 |
| Almorexant HCl | Kinetin | Equol | Chetomin | MLN0905 |
| Pool 6 | Pool 7 | Pool 8 | Pool 9 | Pool 10 |
| GNF-2 | Euphorbiasteroid | TriacetonaMine | Maduramycin Ammonium | Tezacaftor? (VX-661) |
| CCG 50014 | Amentoflavone | Indole-3-carboxylic acid | SulfadiMethoxine sodium | PP1 |
| Lumiracoxib | Astaxanthin | Oxindole | 4-Aminophenylarsonic acid | Pinometostat (EPZ5676) |

TABLE 3-continued

| Pools of small molecules | | | | |
|---|---|---|---|---|
| PF-477736 | Loganin | 4-Hydroxyphenylacetic acid | Tabersonine hydrochloride | LY2090314 |
| JNJ-7777120 | 6-Gingerol | 2-Furoic acid | lutein | MK-8745 |
| Ki16198 | Echinocystic acid | Nicarbazin | Proanthocyanidins | GSK J4 HCl |
| Tempol | Carnosic acid | Propacetamol hydrochloride | Tylosin | (+)-Bicuculline |
| Go 6983 | 1-Deoxynojirimycin | Xanthinol Nicotinate | Ademetionine | NMDA (N-Methyl-D-aspartic acid) |
| WZ811 | Baohuoside I | Cefodizime Sodium | Safflower Yellow 7-Ethylcamptothecin | T0901317 |
| BAY 11-7082 | Eleutheroside B | Pyridoxal 5-phosphate monohydrate | | SGC 0946 |
| Dapivirine (TMC120) | Isoquercitrin | Cefazedone | alpha-Arbutin | RN486 |
| GW9662 | Madecassoside | Cephapirin Benzathine | Propyl gallate | IWR-1-endo |
| ML161 | Rosavin | Robenidine Hydrochoride | Hydroquinine | GSK2334470 |
| HC-030031 | Eupatilin | Calcium Dobesilate | Doramectin | UNC1215 |
| IOX2 | Panaxatriol | Resorantel | Olivetol | GSK923295 |
| PF-4981517 | Hydroxytyrosol Acetate | Lynestrenol | Abietic Acid | Zotarolimus (ABT-578) |
| Salubrinal | D-Galactose | Trans-Zeatin | Aleuritic Acid | SANT-1 |
| CHIR-99021 (CT99021) HCl | Glucosamine sulfate | Taurolidine | Spiculisporic Acid | IPA-3 |
| TDZD-8 | Camphor | Menbutone | Orsellinic acid ethyl ester | PF-3758309 |
| Apoptosis Activator 2 | Tetrahydropalmatine hydrochloride | Phenibut | Taurocholic acid sodium salt hydrate | KY02111 |
| TAK-715 | Ethyl ferulate | Cytosine | Casanthranol | HSP990 (NVP-HSP990) |
| Pifithrin-α (PFTα) HBr | Allantoin | D-Glucurone | Sodium erythorbate | PD123319 |
| Pifithrin-μ | 4-Hydroxybenzyl alcohol | Tenovin-6 | D(-)-Arabinose | (-)-Blebbistatin |
| PMSF | Lawsone | JNK-IN-8 | Hydroferulic acid | VE-822 |
| Piceatannol | Vanillyl Alcohol | QNZ (EVP4593) | Pyrithioxin | Taselisib (GDC0032) |
| Vanillin | Gallic acid trimethyl ether | JZL184 | D-(+)-Melezitose | AZD1208 |
| 2-Thiouracil | Methyl EudesMate | SC-514 | Citropten | AZD3463 |
| N6-methyladenosine (m6A) | Dulcitol | SN-38 | Neferine | Encorafenib (LGX818) |
| Catharanthine | Taurochenodeoxycholic acid | b-AP15 | Protoporphyrin IX | Pevonedistat (MLN4924) |
| Schisandrin B (Sch B) | Galanthamine | MNS (3,4-Methylenedioxy-β-nitrostyrene, MDBN) | 1,3,5-Trimethylpyrazole | (+)-JQ1 |
| Betulinic acid | (E)-Cardamoni Harmine | (R)-Nepicastat HCl Antiarol | Thymol Doxycycline | NLG919 Zebularine |
| Triptolide (PG490) | | | | |
| Borneol | Methyl protocatechuate | 4'-Hydroxychalcone | 4-Methoxysalicylic acid | NU6027 |
| Fangchinoline | D-Pinitol | Cedrol | Isovanillic acid | AMG-517 |
| Demethylzeylasteral (T-96) | Guaiacol | cis-Aconitic acid | 7-Methoxycoumarin | Go6976 |
| Berbamine (dihydrochloride) | Methyl 4-hydroxycinnamate | Maltol | Chlorotetracycline | MLN2480 |
| Cordycepin | Curcumenol | 4-Hydroxy-3,5-dimethoxybenzyl alcohol | Solvent Red 23 | XL888 |
| (+)-Fangchinoline | Alpinetin | Isovanillin | Benzoyleneurea | SC144 |
| Rosmarinic acid | Indigo | 2,3-Dihydroxybenzoic acid | Benzyl cinnamate | KPT-185 |
| Scoparone | Lysionotin | Fumaric acid | Anthraquinone | Marinopyrrole A (Maritoclax) |
| Dehydrocostus Lactone | Bavachinin | Usnic acid | 2,6-Dihydroxyanthraquinone | TIC10 Analogue |
| Asiaticoside | kaempferide | Glycocholic acid | Atrazine | PYR-41 |
| (20S)-Protopanaxatriol | Scopoletin | Skatole | Kojic acid | PR-619 |

TABLE 3-continued

| \multicolumn{5}{c}{Pools of small molecules} | | | | |
|---|---|---|---|---|
| Acetylspiramycin (ASPM) | Protopine | 3,4,5-Trimethoxycinnamic acid | (−)-Ambroxide | P5091 (P005091) |
| Diammonium Glycyrrhizinate | Jatrorrhizine | Purpurin | Diaveridine | P22077 |
| Quinolinic acid | Pyrogallol | Lactobionic acid | Acetylisovaleryltylosin Tartrate | IU1 |
| Tyramine | Quinic acid | Helecin | Quinocetone | LDN-57444 |
| Sesamol | L-Rhamnose monohydrate | 4-Methylesculetin | 4-Aminosalicylic acid | CGK 733 |
| Tryptamine | 3,4',5-Trimethoxy-trans-stilbene | Tropine | Imidazolidinyl Urea | BMS-833923 |
| BHQ | Arteether | Buparvaquone | Imidocarb dipropionate | CFTRinh-172 |
| Syringic acid | Leonurine | Iminostilbene | β-Estradiol 17-Acetate | TCID |
| Methyl Vanillate | Isopsoralen | Efonidipine | 2-Acetylphenothiazine (MLI71) | NSC697923 |
| Trichloroisocyanuric acid | Cycloastragenol | Azathramycin | NXY-059 (Disufenton sodium) | LGK-974 |
| Pyrrolidinedithioc arbamate ammonium | Sophoridine | Anamorelin | VX-702 | BMS-911543 |
| 6-Hydroxyflavone (6-HF) | (1R,2R)-trans-N-Boc-1,2-cyclohexanediamine | Cyclogalegenol | AP26113-analog (ALK-IN-1) | AZD1080 |
| Osalmid | (−)-Arctigenin | 2,2':5',2''-Terthiophene | AZD2932 | DMHI |
| Amitraz | Hydroxy Camptothecine | Sorbic acid | BAY-61-3606 | LDN-212854 |
| Sulfamonomethoxine | Hederagenin | Dimetghyl 4-Hydroxyisophthalate | PP2 | ML347 |
| Kitasamycin | Betulonic acid | Tiamulin fumarate | LCLI61 | NSC319726 |
| 4-Amino-5-imidazolecarboxamide | Astragaloside IV | AOA hemihydrochloride | GDC-0152 | C646 |
| 3-Nitropropionic acid | Ursonic acid | TBHQ | Merestinib (LY2801653) | 10058-F4 |
| Spermidine trihydrochloride | Lycorine | Methylcobalamin | VS-5584 (SB2343) | Glasdegib (PF-04449913) |
| Tauroursodeoxycholic Acid (TUDCA) | Isoimperatorin | Isoprinosine | CZC24832 | Mdivi-1 |
| Piribedil | Iso-Steviol | Indobufen | Stattic | Dyngo-4a |
| Promestriene | Astragalus polyphenols | Tilorone dihydrochloride | Embelin | UNCI999 |
| O6-Benzylguanine | Bulleyaconicine A | Etofylline | AZD246I | SSR128129E |
| Uniconazole | 4'-Demethylpodophyllotoxin | Melitracen hydrochloride | RG-7112 | Crenigacestat (LY3039478) |
| 2-Methoxy-1,4-naphthoquinone | Catalpol | Tiamulin | GSK2656157 | RO5126766 (CH5126766) |
| Trolox | 4,7-Dimethoxyisoflavone | Difloxacin hydrochloride | XL388 | GK1137831 |
| Ilaprazole | Veratramine | Benorylate | XL019 | ONX-0914 (PR-957) |
| Thymopentin | Cephalotaxine | Isoxepac | Wnt-C59 (C59) | Spebrutinib (CC-292, AVL-292) |
| Cefsulodin sodium | α-Hederin | Nomilin | Epoxomicin | Opaganib (ABC294640) |
| Levamlodipine | Gracillin | Clonixin | PD168393 | SKI II |
| Umbelliferone | Macranthoidin B | Methyl α-D-mannopyranoside | AZD3514 | PF-543 |
| Carbendazim | 4',7-Dimethoxy-5-Hydroxyflavone | Thiocolchicoside | CX-6258 HCl | JTE 013 |
| Cinnamic acid | Hederacoside C | Revaprazan Hydrochloride | Brefeldin A | AGI-5198 |
| PTP Inhibitor II | 7β-Hydroxylathyrol | Xipamide | Oprozomib (ONX 0912) | CID755673 |
| Flavanone | Lathyrol | Azamethiphos | AZ20 | I-BET-762 |
| NLRP3 Inflammasome Inhibitor I | (−)-epigallocatechin | Febantel | CGI1746 | PF-04620110 |
| Ethyl 3-Aminobenzoate methanesulfonate | Ginsenoside Rg1 | Rafoxanide | LY2874455 | 1-Azakenpaullone |

TABLE 3-continued

| Pools of small molecules | | | | |
|---|---|---|---|---|
| Pool 11 | Pool 12 | Pool 13 | Pool 14 | Pool 15 |
| ERK5-IN-1 | Fenbendazole | NSC12 | ZM241385 | Drospirenone |
| IPI-3063 | Alizarin | NCT-501 | NSC59984 | Ruxolitinib (INCB018424) |
| CW069 | Asaraldehyde | Bioymifi | GSK1016790A | Isotretinoin |
| SH-4-54 | L-Ascorbyl 6-palmitate | O4I1 | GSK591 | Lopinavir |
| AZ191 | Scopine | O4I2 | MS023 | Meropenem |
| AZD3965 | Daphnetin | KC7F2 | ICI-118551 Hydrochloride | Mianserin HCl |
| CH5138303 | Pioglitazone | PX-12 | GMX1778 (CH5828) | Mosapride Citrate |
| URMC-099 | Dehydroepiandrosterone (DHEA) | MR167307 HCl | RHPS 4 methosulfate | Nafamostat Mesylate |
| JSH-23 | Ribitol | MR168921 HCl | BMS-582949 | Naftopidil DiHCl |
| Bay 11-7085 | TAK-733 | Ochromycinone (STA-21) | Pamapimod (R-1503, Ro4402257) | Omeprazole |
| EPZ004777 | MG-132 | ETC-1002 | MK571 | Ondansetron HCl |
| ARQ 621 | AZD5438 | CP21R7 (CP21) | BAY 41-2272 | Oxcarbazepine |
| HS-173 | PP121 | EPI-001 | Salinomycin (from Streptomycesalbus) | Pelitinib (EKB-569) |
| PF-562271 HCl | Omecamtiv mecarbil (CK-1827452) | Lificiguat (YC-1) | Deguelin | Pizotifen Malate |
| K02288 | OSI-027 | SIS3 HCl | Resiquimod | Resveratrol |
| OTX015 | Rabusertib (LY2603618) | Larotrectinib (LOXO-101) sulfate | Sivelestat (ONO-5046) | Rocuronium Bromide |
| BRD7552 | Tubastatin A HCl | TIC10 | Capsazepine | Stavudine (d4T) |
| Atglistatin | PNU-120596 | PLX7904 | GNF-7 | Tenofovir Disoproxil Fumarate |
| AdipoRon | GW3965 HCl | AZD8835 | Cl-amidine | Tenofovir |
| LY2119620 | URB597 | P7C3 | Halofuginone | Tigecycline |
| GNE-0877 | BMS-378806 | AZD3759 | MS049 | Trilostane |
| GNE-9605 | NPS-2143 | L755507 | PD0166285 | Vecuronium Bromide |
| 4EGI-1 | Rebastinib (DCC-2036) | SBC-115076 | NSC348884 | Bimatoprost |
| 4E1RCat | CCT128930 | FG-2216 | RSL3 | Linezolid |
| PTC-209 | A66 | VPS34-IN1 | ARS-853 (ARS853) | Alfuzosin HCl |
| UNC669 | Fasiglifam? (TAK-875) | A-196 | GDC-0326 | Clopidogrel |
| AEBSF HCl | SNX-2112 (PF-04928473) | LDC4297 (LDC044297) | ON123300 | Ranolazine 2HCl |
| E-64 | PF-04929113 (SNX-5422) | SKF38393 HCl | GDC-0084 | Repaglinide |
| Leupeptin Hemisulfate | 5-hydroxymethyl Tolterodine (PNU 200577, 5-HMT, 5-HM) | SKF96365 | Cucurbitacin B | Rolipram |
| Pepstatin A | MK-0752 | Tenovin-1 | ONO-4059 (GS-4059) hydrochloride | Sildenafil Citrate |
| Phosphoramidon Disodium Salt | WYE-125132 (WYE-132) | GSK2636771 | AMG 337 | Sumatriptan Succinate |
| (−)-p-Bromotetramisole Oxalate | ICG-001 | PQ 401 | GSK481 | Tianeptine sodium |
| MG-101 (ALLN) | WAY-100635 Maleate | ZM 39923 HCl | Daprodustat (GSK1278863) | Tizanidine HCl |
| Z-FA-FMK | PF-3845 | SMI-4a | Ro 61-8048 | Topiramate |
| Loxistatin Acid (E-64C) | A-674563 | BIX 01294 | Verubecestat (MK-8931) Trifluoroacetat | Tranilast |
| Calpeptin | AS-252424 | VE-821 | VO-Ohpic trihydrate | Venlafaxine HCl |
| FLI-06 | PF-00562271 | AG-18 | BH3I-1 | Voriconazole |
| Anisomycin | A922500 | PRX-08066 Maleic acid | Wnt agonist 1 | Zileuton |
| Ascomycin (FK520) | BRL-15572 (dihydrochloride) | GW9508 | BI-7273 | Ziprasidone HCl |
| Caffeic Acid Phenethyl Ester | Flavopiridol HCl | CEP-32496 | PF-CBP1 HCl | Zonisamide |
| CA-074 methyl ester (CA-074 Me) | AS-604850 | Nirogacestat (PF-03084014, PF-3084014) | SBI-0640756 | Ispinesib (SB-715992) |

TABLE 3-continued

| \multicolumn{5}{|c|}{Pools of small molecules} |
|---|---|---|---|---|
| CGP 57380 | CAY10505 | AZD5363 | NSC87877 | Cilomilast |
| KN-62 | CHIR-124 | GW0742 | FPS-ZM1 | Zibotentan (ZD4054) |
| KN-93 Phosphate | KW-2478 | TCS 359 | BFH772 | Atazanavir Sulfate |
| PD 151746 | NVP-BSK805 2HCI | Tyrphostin AG 1296 | BAW2881 (NVP-BAW2881) | Moxifloxacin HCI |
| MI-2 (MALT1 inhibitor) | Mardepodect (PF-2545920) | GSK3787 | CPI-637 | Doxercalciferol |
| SB-3CT | R547 | Tariquidar | SUN11602 | Alfacalcidol |
| TAPI-1 | WAY-600 | WY-14643 (Pirinixic Acid) | Lanabecestat (AZD3293, LY3314814) | Calcifediol |
| AR-A014418 | ADX-47273 | NSC 23766 | umbralisib (TGR-1202) | Orantinib (TSU-68, SU6668) |
| NH125 | BMY 7378 Dihydrochloride | PRT062607 (P505-15, BIIB057) HCI | ML264 | Safinamide Mesylate |
| Sal003 | TG101209 | VU 0364439 | MK-4101 | Pimasertib (AS-703026) |
| ME0328 | Turofexorate Isopropyl (XL335) | Butein | BI-78D3 | Lomibuvir (VX-222, VCH-222) |
| WS3 | Nepicastat (SYN-117) HCI | Necrostatin-1 | PF-06447475 | Zosuquidar (LY335979) 3HCI |
| WS6 | Apitolisib (GDC-0980, RG7422) | UPF 1069 | Ivosidenib (AG-120) | Daclatasvir (BMS-790052) |
| AP-III-a4 (ENOblock) | A-769662 | PU-H71 | Hydroxyfasudil (HA-1100) HCI | Iloperidone |
| Pyridostatin Trifluoroacetate Salt | RS-127445 | GDC-0349 | HLCL-61 HCL | Naratriptan HCI |
| E3330 | CH5132799 | GW2580 | BAY 1217389 | Ponatinib (AP24534) |
| ZLN005 | KX2-391 | Scriptaid | PF-8380 | Fludarabine |
| CORM-3 | GSK1838705A | BMS-345541 | A51842856 | Pralatrexate |
| CR10044876 | Dibenzazepine (YO-01027) | Dynasore | Netarsudil (AR-13324) 2HCI | Betamethasone |
| FH1 (BRD-K4477) | Geldanamycin | ETP-46464 | N1157 | Mycophenolate Mofetil |
| FPH1 (BRD-6125) | LY411575 | ASP3026 | Ensartinib (X-396) | Dyphylline |
| FPH2 (BRD-9424) | CP-91149 | Lomeguatrib | RS-1 | Aztreonam |
| Osilodrostat (LCI699) | TAK-901 | P276-00 | MK-886 (L-663,536) | Alprostadil |
| XEN445 | AMG-900 | Sabutoclax | IC261 | Lactulose |
| VER-49009 | ZM 336372 | Nutlin-3b | SB366791 | Tadalafil |
| VER-50589 | JTC-801 | Chaetocin | SMER28 | Cyclosporine |
| BTB06584 | PH-797804 | UNC0638 | EAI045 | Pracinostat (SB939) |
| LDC000067 | AG-1478 (Tyrphostin AG-1478) | NSC 405020 | Etomoxir (Na salt) | Natamycin |
| PI-1840 | SB415286 | Optovin | Thiomyristoyl | Voxtalisib (SAR245409, XL765) Analogue |
| FTI 277 HCI | AZ 3146 | PluriSlin #1 (NSC 14613) | RK-33 | Quizartinib (AC220) |
| GGTI 298 TFA salt | PAC-1 | RI-1 | IQ-1 | Telaprevir (VX-950) |
| LB42708 | GSK1070916 | GlyH-101 | HPI-4 (Ciliobrevin A) | Saxagliptin |
| Triapine | PHA-767491 | Tubercidin | Necrosulfonamide | Selisistat (EX 527) |
| Nexturastat A | PF-04691502 | Mirin | CC1245737 | Febuxostat |
| MG149 | CHIR-98014 | C-DIM12 | FIN56 | Dapagliflozin |

TABLE 3-continued

| Pools of small molecules | | | | |
|---|---|---|---|---|
| EHT 1864 2HCI | AZ 628 | K03861 | GSK583 | Nebivolol HCI |
| DMOG | AMG-458 | CB-5083 | PRI-724 | Pimobendan |
| FH535 | Anacetrapib (MK-0859) | Z-VAD (OH)-FMK (Caspase Inhibitor VI) | GSK6853 | VX-809 (Lumacaftor) |
| MPI-0479605 | BG1226 (NVP-BGT226) | SCH58261 | CFSE | Pomalidomide |

REFERENCES AND NOTES

1 Yen, H. C., Xu, Q., Chou, D. M., Zhao, Z. & Elledge, S. J. Global protein stability profiling in mammalian cells. Science 322, 918-923, doi: 10.1126/science.1160489 (2008).

2 Lundberg, E. & Borner, G. H. H. Spatial proteomics: a powerful discovery tool for cell biology. Nat Rev Mol Cell Biol, doi: 10.1038/s41580-018-0094-y (2019).

3 Egelhofer, T. A. et al. An assessment of histone-modification antibody quality. Nat Struct Mol Biol 18, 91-93, doi: 10.1038/nsmb. 1972 (2011).

4 Meliopoulos, V. A. & Schultz-Cherry, S. Although it's painful: The importance of stringent antibody validation. PLOS Pathog 14, e1006701, doi: 10.1371/journal.ppat. 1006701 (2018).

5 Aebersold, R. & Mann, M. Mass-spectrometric exploration of proteome structure and function. Nature 537, 347-355, doi: 10.1038/nature19949 (2016).

6 Huh, W. K. et al. Global analysis of protein localization in budding yeast. Nature 425, 686-691, doi: 10.1038/nature02026 (2003).

7 Cohen, A. A. et al. Dynamic proteomics of individual cancer cells in response to a drug. Science 322, 1511-1516, doi: 10.1126/science. 1160165 (2008).

8 Dewari, P. S. et al. An efficient and scalable pipeline for epitope tagging in mammalian stem cells using Cas9 ribonucleoprotein. Elife 7, doi: 10.7554/eLife.35069 (2018).

9 Roberts, B. et al. Systematic gene tagging using CRISPR/Cas9 in human stem cells to illuminate cell organization. Mol Biol Cell 28, 2854-2874, doi: 10.1091/mbc.E17-03-0209 (2017).

10 Leonetti, M. D., Sekine, S., Kamiyama, D., Weissman, J. S. & Huang, B. A scalable strategy for high-throughput GFP tagging of endogenous human proteins. Proc Natl Acad Sci USA 113, E3501-3508, doi: 10.1073/pnas. 1606731113 (2016).

11 Sigal, A. et al. Generation of a fluorescently labeled endogenous protein library in living human cells. Nat Protoc 2, 1515-1527, doi: 10.1038/nprot.2007.197 (2007).

12 Schmid-Burgk, J. L., Honing, K., Ebert, T. S. & Hornung, V. CRISPaint allows modular base-specific gene tagging using a ligase-4-dependent mechanism. Nat Commun 7, 12338, doi: 10.1038/ncomms12338 (2016).

13 Tsai, S. Q. et al. GUIDE-seq enables genome-wide profiling of off-target cleavage by CRISPR-Cas nucleases. Nat Biotechnol 33, 187-197, doi: 10.1038/nbt.3117 (2015).

14 Palmer, E. & Freeman, T. Investigation into the use of C- and N-terminal GFP fusion proteins for subcellular localization studies using reverse transfection microarrays. Comp Funct Genomics 5, 342-353, doi: 10.1002/cfg.405 (2004).

15 Ishihama, Y. et al. Exponentially modified protein abundance index (emPAI) for estimation of absolute protein amount in proteomics by the number of sequenced peptides per protein. Mol Cell Proteomics 4, 1265-1272, doi: 10.1074/mcp.M500061-MCP200 (2005).

16 Sakaue-Sawano, A. et al. Visualizing spatiotemporal dynamics of multicellular cell-cycle progression. Cell 132, 487-498, doi: 10.1016/j.cell.2007.12.033 (2008).

17 Teicher, B. A., Ara, G., Herbst, R., Palombella, V. J. & Adams, J. The proteasome inhibitor PS-341 in cancer therapy. Clin Cancer Res 5, 2638-2645 (1999).

18 Kane, R. C., Bross, P. F., Farrell, A. T. & Pazdur, R. Velcade: U.S. FDA approval for the treatment of multiple myeloma progressing on prior therapy. Oncologist 8, 508-513 (2003).

19 Decaux, O. et al. Inhibition of mTORC1 activity by REDD1 induction in myeloma cells resistant to bortezomib cytotoxicity. Cancer Sci 101, 889-897, doi: 10.1111/j.1349-7006.2009.01467.x (2010).

20 Barakat, D. J. et al. C/EBPbeta regulates sensitivity to bortezomib in prostate cancer cells by inducing REDD1 and autophagosome-lysosome fusion. Cancer Lett 375, 152-161, doi: 10.1016/j.canlet.2016.03.005 (2016).

21 Sun, X. H., Copeland, N. G., Jenkins, N. A. & Baltimore, D. Id proteins Id1 and Id2 selectively inhibit DNA binding by one class of helix-loop-helix proteins. Mol Cell Biol 11, 5603-5611 (1991).

22 Bounpheng, M. A., Dimas, J. J., Dodds, S. G. & Christy, B. A. Degradation of Id proteins by the ubiquitin-proteasome pathway. FASEB J 13, 2257-2264 (1999).

23 Jariel-Encontre, I. et al. Ubiquitinylation is not an absolute requirement for degradation of c-Jun protein by the 26 S proteasome. J Biol Chem 270, 11623-11627 (1995).

24 Zengerle, M., Chan, K. H. & Ciulli, A. Selective Small Molecule Induced Degradation of the BET Bromodomain Protein BRD4. ACS Chem Biol 10, 1770-1777, doi: 10.1021/acschembio.5b00216 (2015).

25 Han, T. et al. Anticancer sulfonamides target splicing by inducing RBM39 degradation via recruitment to DCAF15. Science 356, doi: 10.1126/science.aal3755 (2017).

26 Birnboim, H. C., Motora, D. & Liteplo, R. G. Indomethacin shifts the peak of c-fos, egr-1, and c-myc gene expression in confluent fibroblasts induced by phorbol myristate acetate. Biochem Biophys Res Commun 161, 508-513 (1989).

27 Fisher, S. L. & Phillips, A. J. Targeted protein degradation and the enzymology of degraders. Curr Opin Chem Biol 44, 47-55, doi: 10.1016/j.cbpa.2018.05.004 (2018).

28 Feldman, D. et al. Pooled optical screens in human cells. bioRxiv, doi: 10.1101/383943 (2018).

29 Picelli, S. et al. Tn5 transposase and tagmentation procedures for massively scaled sequencing projects. Genome Res 24, 2033-2040, doi: 10.1101/gr.177881.114 (2014).

30 Schmid-Burgk, J. L. & Hornung, V. BrowserGenome.org: web-based RNA-seq data analysis and visualization. *Nat Methods* 12, 1001, doi: 10.1038/nmeth.3615 (2015).

Various modifications and variations of the described methods, pharmaceutical compositions, and kits of the invention will be apparent to those skilled in the art without departing from the scope and spirit of the invention. Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and including such departures from the present disclosure come within known customary practice within the art to which the invention pertains and may be applied to the essential features herein before set forth.

SEQUENCE LISTING (69341 sequences)

SEQ ID NO: 1 - DNA, 23 bp, Homo sapiens
tgagagacacatcagagccctgg

SEQ ID NO: 2 - DNA, 23 bp, Homo sapiens
tgagggacacatcagagccctgg

SEQ ID NO: 3 - DNA, 23 bp, Homo sapiens
cgaccctgtggagctcctggtgg

SEQ ID NO: 4 - DNA, 23 bp, Homo sapiens
actgcccgaggggatggatatgg

SEQ ID NO: 5 - DNA, 23 bp, Homo sapiens
agtctatgattactacgagacgg

SEQ ID NO: 6 - DNA, 23 bp, Homo sapiens
tattctgatccctgtgaatgagg

SEQ ID NO: 7 - DNA, 23 bp, Homo sapiens
ccaaggggtaccggctgctgcgg

SEQ ID NO: 8 - DNA, 23 bp, Homo sapiens
gccatgaaaatgtacttgtgagg

SEQ ID NO: 9 - DNA, 23 bp, Homo sapiens
gtgactggggagctgggtccagg

SEQ ID NO: 10 - DNA, 23 bp, Homo sapiens
tattcttagaggtgggaatgtgg

SEQ ID NO: 11 - DNA, 23 bp, Homo sapiens
cgggacatccctgagctgcaggg

SEQ ID NO: 12 - DNA, 23 bp, Homo sapiens
cctgcagctcagggatgtcccgg

SEQ ID NO: 13 - DNA, 23 bp, Homo sapiens
tcagtatattgagtggctaaagg

SEQ ID NO: 14 - DNA, 23 bp, Homo sapiens
agatatgtatgtaagttggctgg

SEQ ID NO: 15 - DNA, 23 bp, Homo sapiens
taatgcactcagaattctcatgg

SEQ ID NO: 16 - DNA, 23 bp, Homo sapiens
ctacagcattcacaatcttcagg

SEQ ID NO: 17 - DNA, 23 bp, Homo sapiens
aagttgtgctaatacctggaagg

SEQ ID NO: 18 - DNA, 23 bp, Homo sapiens
agtgcattttaagtcacacatgg

SEQ ID NO: 19 - DNA, 23 bp, Homo sapiens
agtgctcttcatcagatgaaagg

SEQ ID NO: 20 - DNA, 23 bp, Homo sapiens
tgctactgggtcacggctacagg

SEQ ID NO: 21 - DNA, 23 bp, Homo sapiens
aaggtgcatcttaagaatgatgg

SEQ ID NO: 22 - DNA, 23 bp, Homo sapiens
catcaaacatgtctgtgagctgg

SEQ ID NO: 23 - DNA, 23 bp, Homo sapiens
cctcttaaggctccatcagcagg

SEQ ID NO: 24 - DNA, 23 bp, Homo sapiens
gcaggggctgcagccattaacgg

SEQ ID NO: 25 - DNA, 23 bp, Homo sapiens
aggaacagcggctgctgaactgg

SEQ ID NO: 26 - DNA, 23 bp, Homo sapiens
ggcatcgagatgggctaactcgg

SEQ ID NO: 27 - DNA, 23 bp, Homo sapiens
gcgtgtgcatttctttattccgg

SEQ ID NO: 28 - DNA, 23 bp, Homo sapiens
ggggatgtaaagaactgagtggg

SEQ ID NO: 29 - DNA, 23 bp, Homo sapiens
gggcggacctgggtcagagctgg

SEQ ID NO: 30 - DNA, 23 bp, Homo sapiens
cgcagagtgctaaggagtgaggg

SEQ ID NO: 31 - DNA, 23 bp, Homo sapiens
tattgtctggatttattgggtgg

SEQ ID NO: 32 - DNA, 23 bp, Homo sapiens
tattttttgctctgatggtgagg

SEQ ID NO: 33 - DNA, 23 bp, Homo sapiens
tgtggaaactttattgtggtggg

SEQ ID NO: 34 - DNA, 23 bp, Homo sapiens
acctgaagatccttcattttggg

SEQ ID NO: 35 - DNA, 23 bp, Homo sapiens
ttggagcgaattaaagcagaagg

SEQ ID NO: 36 - DNA, 23 bp, Homo sapiens
gtgggcgatgtcaatccccgtgg

SEQ ID NO: 37 - DNA, 23 bp, Homo sapiens
tgccgggggtgagagtaaagagg

SEQ ID NO: 38 - DNA, 23 bp, Homo sapiens
tattgaggaacaggtgagcgtgg

SEQ ID NO: 39 - DNA, 23 bp, Homo sapiens
agttctcacatcttttctacagg

SEQ ID NO: 40 - DNA, 23 bp, Homo sapiens
tcattttaagggtcttcctgtgg

SEQ ID NO: 41 - DNA, 23 bp, Homo sapiens
ggaagtgttaagactccatctgg

SEQ ID NO: 42 - DNA, 23 bp, Homo sapiens
aaacttctttagtgctcagatgg

SEQ ID NO: 43 - DNA, 23 bp, Homo sapiens
ggcccagctgtccttcaacacgg

SEQ ID NO: 44 - DNA, 23 bp, Homo sapiens
cgcagaggaggggcgatgagggg

SEQ ID NO: 45 - DNA, 23 bp, Homo sapiens
tggagccagtcgacaagcccagg

SEQ ID NO: 46 - DNA, 23 bp, Homo sapiens
tttaaacagcacactttggtggg

SEQ ID NO: 47 - DNA, 23 bp, Homo sapiens
aaggttcatctgaatgagggagg

SEQ ID NO: 48 - DNA, 23 bp, Homo sapiens
ggaggctcagagcacagtctcgg

SEQ ID NO: 49 - DNA, 23 bp, Homo sapiens
tggggttttaaggctcttcctgg

SEQ ID NO: 50 - DNA, 23 bp, Homo sapiens
agctttaaggctcttcctgcagg

SEQ ID NO: 51 - DNA, 23 bp, Homo sapiens
ctcatacagtcagagttcactgg

SEQ ID NO: 52 - DNA, 23 bp, Homo sapiens
agctgctttcaaaaccaaatggg

SEQ ID NO: 53 - DNA, 23 bp, Homo sapiens
tcttgcattgggtcaactgatgg

SEQ ID NO: 54 - DNA, 23 bp, Homo sapiens
ataagttctgtgtcccagcctgg

SEQ ID NO: 55 - DNA, 23 bp, Homo sapiens
gtcagctgttcaagctgcactgg

SEQ ID NO: 56 - DNA, 23 bp, Homo sapiens
taggtcaaaatgaatacctgggg

SEQ ID NO: 57 - DNA, 23 bp, Homo sapiens
tctgcacaatggaaagataaagg

SEQ ID NO: 58 - DNA, 23 bp, Homo sapiens
aaacttttgtcaccgttccatgg

SEQ ID NO: 59 - DNA, 23 bp, Homo sapiens
gtcaatagtgtgaaaggctgtgg

SEQ ID NO: 60 - DNA, 23 bp, Homo sapiens
caccagcacaagtcctgagaagg

SEQ ID NO: 61 - DNA, 23 bp, Homo sapiens
ggatgaagccaccagcgctttgg

SEQ ID NO: 62 - DNA, 23 bp, Homo sapiens
ggcagtcacaaggcctgatgggg

SEQ ID NO: 63 - DNA, 23 bp, Homo sapiens
ctctggggctcacaccaagccgg

SEQ ID NO: 64 - DNA, 23 bp, Homo sapiens
ggagtccctgcctcactcggagg

SEQ ID NO: 65 - DNA, 23 bp, Homo sapiens
gccacttcttcactgagataagg

SEQ ID NO: 66 - DNA, 23 bp, Homo sapiens
cagcagaagtcagattgtagagg

SEQ ID NO: 67 - DNA, 23 bp, Homo sapiens
tactttatggctaaggaagctgg

SEQ ID NO: 68 - DNA, 23 bp, Homo sapiens
caggcatggccagggctcattgg

SEQ ID NO: 69 - DNA, 23 bp, Homo sapiens
tacgggatggccagagatgctgg

SEQ ID NO: 70 - DNA, 23 bp, Homo sapiens
tctcgctgtgttgtcctggctgg

SEQ ID NO: 71 - DNA, 23 bp, Homo sapiens
tgctgtctcgaaaatagttaagg

SEQ ID NO: 72 - DNA, 23 bp, Homo sapiens
gagaacaaggtcgctgtcaaggg

SEQ ID NO: 73 - DNA, 23 bp, Homo sapiens
ttcaggatggctgtattctgcgg

SEQ ID NO: 74 - DNA, 23 bp, Homo sapiens
gtctactttaagacttcaccagg

SEQ ID NO: 75 - DNA, 23 bp, Homo sapiens
tgagggtcctggctcagaccagg

SEQ ID NO: 76 - DNA, 23 bp, Homo sapiens
tggcaggtcacttgtctgcacgg

SEQ ID NO: 77 - DNA, 23 bp, Homo sapiens
cttgttggtcatcaccaaagtgg

SEQ ID NO: 78 - DNA, 23 bp, Homo sapiens
ttgttcgcgcagacatgtgaagg

SEQ ID NO: 79 - DNA, 23 bp, Homo sapiens
ccggggacggttgtgtcaggtgg

SEQ ID NO: 80 - DNA, 23 bp, Homo sapiens
attgagtctctgctgcattttgg

SEQ ID NO: 81 - DNA, 23 bp, Homo sapiens
aacgagtgcaattggagctcagg

SEQ ID NO: 82 - DNA, 23 bp, Homo sapiens
acagaagatacagttgagtttgg

SEQ ID NO: 83 - DNA, 23 bp, Homo sapiens
cacttcctctgtcagggcactgg

SEQ ID NO: 84 - DNA, 23 bp, Homo sapiens
ctcacaaggatggcctgaggagg

SEQ ID NO: 85 - DNA, 23 bp, Homo sapiens
ggagctgatgagaatcaaagtgg

SEQ ID NO: 86 - DNA, 23 bp, Homo sapiens
attcgtggcctatagttgtttgg

SEQ ID NO: 87 - DNA, 23 bp, Homo sapiens
tgggaaggaaagctcactctcgg

SEQ ID NO: 88 - DNA, 23 bp, Homo sapiens
ggtagagggctcacacgttgtgg

SEQ ID NO: 89 - DNA, 23 bp, Homo sapiens
gttcatgatgctcatggccttgg

SEQ ID NO: 90 - DNA, 23 bp, Homo sapiens
cctcagcctggtggccctagagg

SEQ ID NO: 91 - DNA, 23 bp, Homo sapiens
ggtacaaaatccgggcagagagg

SEQ ID NO: 92 - DNA, 23 bp, Homo sapiens
atgtactggcgaagaatatttgg

SEQ ID NO: 93 - DNA, 23 bp, Homo sapiens
atttcaggtaggcaattgtgagg

SEQ ID NO: 94 - DNA, 23 bp, Homo sapiens
gggtcaagtcagagagatagagg

SEQ ID NO: 95 - DNA, 23 bp, Homo sapiens
taagggatcatctcattagcagg

SEQ ID NO: 96 - DNA, 23 bp, Homo sapiens
aacagaaaccaagtcaagactgg

SEQ ID NO: 97 - DNA, 23 bp, Homo sapiens
cagctgtttctgtcctcagaagg

SEQ ID NO: 98 - DNA, 23 bp, Homo sapiens
gtttaatcagcttcctgttgagg

SEQ ID NO: 99 - DNA, 23 bp, Homo sapiens
tgtctgctttttccctcattcgg

SEQ ID NO: 100 - DNA, 23 bp, Homo sapiens
agagccgcataatctcagggtgg

SEQ ID NO: 101 - DNA, 23 bp, Homo sapiens
ccattcagtatataccctgaggg

SEQ ID NO: 102 - DNA, 23 bp, Homo sapiens
ttgccagcaactcttagaccagg

SEQ ID NO: 103 - DNA, 23 bp, Homo sapiens
cccacggccaggctcagtgctgg

SEQ ID NO: 104 - DNA, 23 bp, Homo sapiens
tcccagcatgtggtcagagctgg

SEQ ID NO: 105 - DNA, 23 bp, Homo sapiens
gagatttcctgagcaagcagtgg

SEQ ID NO: 106 - DNA, 23 bp, Homo sapiens
gagccattctcctgaagaaatgg

SEQ ID NO: 107 - DNA, 23 bp, Homo sapiens
gtgggttagttcaaggtagatgg

SEQ ID NO: 108 - DNA, 23 bp, Homo sapiens
gcagcagtgctgggcttcactgg

SEQ ID NO: 109 - DNA, 23 bp, Homo sapiens
actggaagcgatcatacacaagg

SEQ ID NO: 110 - DNA, 23 bp, Homo sapiens
gagtcccagttggtccctagagg

SEQ ID NO: 111 - DNA, 23 bp, Homo sapiens
gcatataggttacagccgccagg

SEQ ID NO: 112 - DNA, 23 bp, Homo sapiens
tgcccagccagcgcgcctagcgg

SEQ ID NO: 113 - DNA, 23 bp, Homo sapiens
acagtttgtgtcacaggaactgg

SEQ ID NO: 114 - DNA, 23 bp, Homo sapiens
agttgttgtcttcaggaattagg

SEQ ID NO: 115 - DNA, 23 bp, Homo sapiens
actagttagcgtatttatggagg

SEQ ID NO: 116 - DNA, 23 bp, Homo sapiens
gtggaggccgacctggagtgagg

SEQ ID NO: 117 - DNA, 23 bp, Homo sapiens
gtgcaagccatggttgagcatgg

SEQ ID NO: 118 - DNA, 23 bp, Homo sapiens
catcttcaatgctgtggtggagg

SEQ ID NO: 119 - DNA, 23 bp, Homo sapiens
aaaggagatctgcgacactgtgg

SEQ ID NO: 120 - DNA, 23 bp, Homo sapiens
aacaacaagaagctggactgagg

SEQ ID NO: 121 - DNA, 23 bp, Homo sapiens
agcggctacttcttgtcttctgg

SEQ ID NO: 122 - DNA, 23 bp, Homo sapiens
attgattcaacatagttcccagg

SEQ ID NO: 123 - DNA, 23 bp, Homo sapiens
atagactcaacgtaattcccagg

SEQ ID NO: 124 - DNA, 23 bp, Homo sapiens
agccctgggctgtcagcagctgg

SEQ ID NO: 125 - DNA, 23 bp, Homo sapiens
ggactacaattcctggaaaatgg

SEQ ID NO: 126 - DNA, 23 bp, Homo sapiens
aaatcagtgacatagtgcagagg

SEQ ID NO: 127 - DNA, 23 bp, Homo sapiens
aaatcagtgatgtggtgcagagg

SEQ ID NO: 128 - DNA, 23 bp, Homo sapiens
caatgttatgcacgtctgattgg

SEQ ID NO: 129 - DNA, 23 bp, Homo sapiens
atgtcgttgcgtctccaaagagg

SEQ ID NO: 130 - DNA, 23 bp, Homo sapiens
acagctttcactcacgtgagtgg

SEQ ID NO: 131 - DNA, 23 bp, Homo sapiens
agaaagcccttttgttctgacgg

SEQ ID NO: 132 - DNA, 23 bp, Homo sapiens
gaagcaagcccggctgttctagg

SEQ ID NO: 133 - DNA, 23 bp, Homo sapiens
tgtagacaggacccgtttagagg

SEQ ID NO: 134 - DNA, 23 bp, Homo sapiens
agcccctggcagccgctcacggg

SEQ ID NO: 135 - DNA, 23 bp, Homo sapiens
ccctgcctcgggctacacgtcgg

SEQ ID NO: 136 - DNA, 23 bp, Homo sapiens
aagagggcaaggggaggcttagg

SEQ ID NO: 137 - DNA, 23 bp, Homo sapiens
tgagtagcgtaatcacaacatgg

SEQ ID NO: 138 - DNA, 23 bp, Homo sapiens
ccaggagagctgcttctgcaagg

SEQ ID NO: 139 - DNA, 23 bp, Homo sapiens
agggttttggtgaatattcacgg

SEQ ID NO: 140 - DNA, 23 bp, Homo sapiens
ctgggaggtctgagtgttcctgg

SEQ ID NO: 141 - DNA, 23 bp, Homo sapiens
cccttgtcagggactcctgaggg

SEQ ID NO: 142 - DNA, 23 bp, Homo sapiens
cctgctcgtgtccatcggtctgg

SEQ ID NO: 143 - DNA, 23 bp, Homo sapiens
tacatcacctcccgggtgtgagg

SEQ ID NO: 144 - DNA, 23 bp, Homo sapiens
tgggacctcactcagttcccagg

SEQ ID NO: 145 - DNA, 23 bp, Homo sapiens
gaatgatgacagcaataccttgg

SEQ ID NO: 146 - DNA, 23 bp, Homo sapiens
ggcaggaagctcttcctacgtgg

SEQ ID NO: 147 - DNA, 23 bp, Homo sapiens
ctgggcgggccacggtcaggtgg

SEQ ID NO: 148 - DNA, 23 bp, Homo sapiens
cagccccaaggctctaaatgcgg

SEQ ID NO: 149 - DNA, 23 bp, Homo sapiens
ctgacagccaagatataaggagg

SEQ ID NO: 150 - DNA, 23 bp, Homo sapiens
gtgggttctactcctgaagcagg

SEQ ID NO: 151 - DNA, 23 bp, Homo sapiens
cctctggacaggacatgctgagg

SEQ ID NO: 152 - DNA, 23 bp, Homo sapiens
agagttcagccaatctatggtgg

SEQ ID NO: 153 - DNA, 23 bp, Homo sapiens
tgtacttgtcaatgtgttcacgg

SEQ ID NO: 154 - DNA, 23 bp, Homo sapiens
gtccgccgcgggctcagctccgg

SEQ ID NO: 155 - DNA, 23 bp, Homo sapiens
tgcatcgatatgctttgcaatgg

SEQ ID NO: 156 - DNA, 23 bp, Homo sapiens
gggagtattcagaagccaagtgg

SEQ ID NO: 157 - DNA, 23 bp, Homo sapiens
gtcctggaagctcttctcagtgg

SEQ ID NO: 158 - DNA, 23 bp, Homo sapiens
gggcctcgggtcacagcgtgtgg

SEQ ID NO: 159 - DNA, 23 bp, Homo sapiens
agaatttctgtgaatcttgctgg

SEQ ID NO: 160 - DNA, 23 bp, Homo sapiens
ctccacctggaagagagctaggg

SEQ ID NO: 161 - DNA, 23 bp, Homo sapiens
ctacagcttctgaattagcatgg

SEQ ID NO: 162 - DNA, 23 bp, Homo sapiens
ctgtgcattgggggtgggatggg

SEQ ID NO: 163 - DNA, 23 bp, Homo sapiens
acaactcctactctttgtggcgg

SEQ ID NO: 164 - DNA, 23 bp, Homo sapiens
ccactgacagtcacctcttttgg

SEQ ID NO: 165 - DNA, 23 bp, Homo sapiens
atgctgttcttctaaaccctagg

SEQ ID NO: 166 - DNA, 23 bp, Homo sapiens
tcggtcagactggagtgaagtgg

SEQ ID NO: 167 - DNA, 23 bp, Homo sapiens
gccttttattgcacagtggttgg

SEQ ID NO: 168 - DNA, 23 bp, Homo sapiens
ttttagacagtgtggtcaggagg

SEQ ID NO: 169 - DNA, 23 bp, Homo sapiens
gcagcggcacacaactggcaagg

SEQ ID NO: 170 - DNA, 23 bp, Homo sapiens
ggtctggaactcctgatctgagg

SEQ ID NO: 171 - DNA, 23 bp, Homo sapiens
agtgaccaacgcaggtgagctgg

SEQ ID NO: 172 - DNA, 23 bp, Homo sapiens
ggaggatgcaatgagggagtagg

SEQ ID NO: 173 - DNA, 23 bp, Homo sapiens
tcctgcgtgacgtctcacatcgg

SEQ ID NO: 174 - DNA, 23 bp, Homo sapiens
gtggagctgagacactcctgagg

SEQ ID NO: 175 - DNA, 23 bp, Homo sapiens
tctgaacatcatcagtgttttgg

SEQ ID NO: 176 - DNA, 23 bp, Homo sapiens
ggaaatccggggtgatgacaagg

SEQ ID NO: 177 - DNA, 23 bp, Homo sapiens
catcagtcaagatcacgtgatgg

SEQ ID NO: 178 - DNA, 23 bp, Homo sapiens
aaataatgggccgggcgcggtgg

SEQ ID NO: 179 - DNA, 23 bp, Homo sapiens
attcatcaatgcttcctgagagg

SEQ ID NO: 180 - DNA, 23 bp, Homo sapiens
gaggccgtgttcacagccgccgg

SEQ ID NO: 181 - DNA, 23 bp, Homo sapiens
gggggtcccgccggggtcacagg

SEQ ID NO: 182 - DNA, 23 bp, Homo sapiens
cggggtgggcgccgctagctggg

SEQ ID NO: 183 - DNA, 23 bp, Homo sapiens
agaactaggatttgcttccaagg

SEQ ID NO: 184 - DNA, 23 bp, Homo sapiens
accctaacaaggaggatgtgggg

SEQ ID NO: 185 - DNA, 23 bp, Homo sapiens
cctctccagggcagatcatttgg

SEQ ID NO: 186 - DNA, 23 bp, Homo sapiens
aaagtactggttggctctgtagg

SEQ ID NO: 187 - DNA, 23 bp, Homo sapiens
tgttacatgctcatgtgttccgg

SEQ ID NO: 188 - DNA, 23 bp, Homo sapiens
ggcaatgccctggcatttttggg

SEQ ID NO: 189 - DNA, 23 bp, Homo sapiens
ccaagtgcacgtctcctacttgg

SEQ ID NO: 190 - DNA, 23 bp, Homo sapiens
tgaaggaactgcaacagtgaggg

SEQ ID NO: 191 - DNA, 23 bp, Homo sapiens
tctatcacaaatctctcctgagg

SEQ ID NO: 192 - DNA, 23 bp, Homo sapiens
tggccactgagggcatctagagg

SEQ ID NO: 193 - DNA, 23 bp, Homo sapiens
tgtcttgaaggtatccaaatcgg

SEQ ID NO: 194 - DNA, 23 bp, Homo sapiens
tagagaatcctcctgatgatggg

SEQ ID NO: 195 - DNA, 23 bp, Homo sapiens
tgctgttctctcagtttcccagg

SEQ ID NO: 196 - DNA, 23 bp, Homo sapiens
ttgatgggattgtcccctcgtgg

SEQ ID NO: 197 - DNA, 23 bp, Homo sapiens
atttagggacagctgttttctgg

SEQ ID NO: 198 - DNA, 23 bp, Homo sapiens
gaaagtttgaatttgctgccagg

SEQ ID NO: 199 - DNA, 23 bp, Homo sapiens
gaggagggagtctagggctgagg

SEQ ID NO: 200 - DNA, 23 bp, Homo sapiens
acagcttgctctctgagacctgg

SEQ ID NO: 201 - DNA, 23 bp, Homo sapiens
ggtgttcttagggctccacaagg

SEQ ID NO: 202 - DNA, 23 bp, Homo sapiens
ccttgtgacacttcagagcttgg

SEQ ID NO: 203 - DNA, 23 bp, Homo sapiens
gaagtcaccaaccaatactcagg

SEQ ID NO: 204 - DNA, 23 bp, Homo sapiens
gagtccagaacaaagtcaggagg

SEQ ID NO: 205 - DNA, 23 bp, Homo sapiens
tctgaaatcgaagctctagtggg

SEQ ID NO: 206 - DNA, 23 bp, Homo sapiens
gctgggagccaagctctaacggg

SEQ ID NO: 207 - DNA, 23 bp, Homo sapiens
agggcacgaacctgcctcagtgg

SEQ ID NO: 208 - DNA, 23 bp, Homo sapiens
cttaggcagctcacagctcttgg

SEQ ID NO: 209 - DNA, 23 bp, Homo sapiens
ggctgagtggttgtcaggcgtgg

SEQ ID NO: 210 - DNA, 23 bp, Homo sapiens
gccctggtttctggctcacacgg

SEQ ID NO: 211 - DNA, 23 bp, Homo sapiens
agtcatgggagttcagggcctgg

SEQ ID NO: 212 - DNA, 23 bp, Homo sapiens
caaactcaggtgatggaagttgg

SEQ ID NO: 213 - DNA, 23 bp, Homo sapiens
gggagacttggtgctaactcagg

SEQ ID NO: 214 - DNA, 23 bp, Homo sapiens
agagctgccgccatccctagagg

SEQ ID NO: 215 - DNA, 23 bp, Homo sapiens
gtctgttcagatgttcccatagg

SEQ ID NO: 216 - DNA, 23 bp, Homo sapiens
tactgtcttcagtaccttgatgg

SEQ ID NO: 217 - DNA, 23 bp, Homo sapiens
gagaaccaggtcagatcaggagg

SEQ ID NO: 218 - DNA, 23 bp, Homo sapiens
ctaggccagttcggatgagctgg

SEQ ID NO: 219 - DNA, 23 bp, Homo sapiens
acctcttctcccatggaacgagg

SEQ ID NO: 220 - DNA, 23 bp, Homo sapiens
acagttttggagaagtacaaagg

SEQ ID NO: 221 - DNA, 23 bp, Homo sapiens
agctccatcaaagcagtcagtgg

SEQ ID NO: 222 - DNA, 23 bp, Homo sapiens
attcaaacttcgagagcagatgg

SEQ ID NO: 223 - DNA, 23 bp, Homo sapiens
cacttccacccctcatgacccgg

SEQ ID NO: 224 - DNA, 23 bp, Homo sapiens
tgacctctattccactatcaagg

SEQ ID NO: 225 - DNA, 23 bp, Homo sapiens
gcggacattgagcgaatgtatgg

SEQ ID NO: 226 - DNA, 23 bp, Homo sapiens
gacattgaacgaatgtatggggg

SEQ ID NO: 227 - DNA, 23 bp, Homo sapiens
taagtaccttatcctaatcctgg

SEQ ID NO: 228 - DNA, 23 bp, Homo sapiens
aactttccttgaacttcacatgg

SEQ ID NO: 229 - DNA, 23 bp, Homo sapiens
ggagactggtcagatgtaatcgg

SEQ ID NO: 230 - DNA, 23 bp, Homo sapiens
cttagatgtctcactgcgcacgg

SEQ ID NO: 231 - DNA, 23 bp, Homo sapiens
ggaaaagcccgtgcgcagtgagg

SEQ ID NO: 232 - DNA, 23 bp, Homo sapiens
aaagtttatatgggggtaagcgg

SEQ ID NO: 233 - DNA, 23 bp, Homo sapiens
atgaactgaggaagaaagaatgg

SEQ ID NO: 234 - DNA, 23 bp, Homo sapiens
ttaagagaccaagaatggagagg

SEQ ID NO: 235 - DNA, 23 bp, Homo sapiens
agggaactcctccggtgaattgg

SEQ ID NO: 236 - DNA, 23 bp, Homo sapiens
agtcaggagtgggggaaatgagg

SEQ ID NO: 237 - DNA, 23 bp, Homo sapiens
tggagtcttcggaggtctacggg

SEQ ID NO: 238 - DNA, 23 bp, Homo sapiens
gatgatgttgccaatgcattggg

SEQ ID NO: 239 - DNA, 23 bp, Homo sapiens
caggctgctgctaagtgagctgg

SEQ ID NO: 240 - DNA, 23 bp, Homo sapiens
gacttgttagagcactaacttgg

SEQ ID NO: 241 - DNA, 23 bp, Homo sapiens
aaggtcaggatcatgttcactgg

SEQ ID NO: 242 - DNA, 23 bp, Homo sapiens
gcttcagcatttcttctacgtgg

SEQ ID NO: 243 - DNA, 23 bp, Homo sapiens
agtgtgtctagaagcatttgcgg

SEQ ID NO: 244 - DNA, 23 bp, Homo sapiens
tgttttagaagcatttgcggtgg

SEQ ID NO: 245 - DNA, 23 bp, Homo sapiens
ccaccgcaaatgcttctaggcgg

SEQ ID NO: 246 - DNA, 23 bp, Homo sapiens
cattttctgtgaacgataggagg

SEQ ID NO: 247 - DNA, 23 bp, Homo sapiens
aggcatcttagaagcatttgcgg

SEQ ID NO: 248 - DNA, 23 bp, Homo sapiens
ccaccgcaaatgcttctaaacgg

SEQ ID NO: 249 - DNA, 23 bp, Homo sapiens
gactttagaagcacttcctgtgg

SEQ ID NO: 250 - DNA, 23 bp, Homo sapiens
gaacacatcgtacagcagcctgg

SEQ ID NO: 251 - DNA, 23 bp, Homo sapiens
gcttgggaactctttctcaaggg

SEQ ID NO: 252 - DNA, 23 bp, Homo sapiens
gtggggaggagtgccatcagggg

SEQ ID NO: 253 - DNA, 23 bp, Homo sapiens
ggcctttcttcctctacagaagg

SEQ ID NO: 254 - DNA, 23 bp, Homo sapiens
ggctcagcacttgctgtagatgg

SEQ ID NO: 255 - DNA, 23 bp, Homo sapiens
aggagtatggtgagcatatgagg

SEQ ID NO: 256 - DNA, 23 bp, Homo sapiens
taccgcaaatgctactgaccagg

SEQ ID NO: 257 - DNA, 23 bp, Homo sapiens
ggccgggcggggtggattagagg

SEQ ID NO: 258 - DNA, 23 bp, Homo sapiens
gttctcttccgcactctacgggg

SEQ ID NO: 259 - DNA, 23 bp, Homo sapiens
acctcagtggttggggtcaaagg

SEQ ID NO: 260 - DNA, 23 bp, Homo sapiens
tcaggtctctggggcctcacagg

SEQ ID NO: 261 - DNA, 23 bp, Homo sapiens
gaaaatgctctcttcatcagagg

SEQ ID NO: 262 - DNA, 23 bp, Homo sapiens
gatgatgtcccgacattagaagg

SEQ ID NO: 263 - DNA, 23 bp, Homo sapiens
aagttttgcgatgaatagcacgg

SEQ ID NO: 264 - DNA, 23 bp, Homo sapiens
gtccgtgtgctagagaaacttgg

SEQ ID NO: 265 - DNA, 23 bp, Homo sapiens
tacgacatgactccaaacactgg

SEQ ID NO: 266 - DNA, 23 bp, Homo sapiens
ctaggacatgactccaaagacgg

SEQ ID NO: 267 - DNA, 23 bp, Homo sapiens
tgtcgcccaggccagaatgcagg

SEQ ID NO: 268 - DNA, 23 bp, Homo sapiens
caatgaaatggaggtgacagagg

SEQ ID NO: 269 - DNA, 23 bp, Homo sapiens
tataccaagcttggctacgcagg

SEQ ID NO: 270 - DNA, 23 bp, Homo sapiens
tggaggtggtgctggtgagcagg

SEQ ID NO: 271 - DNA, 23 bp, Homo sapiens
attacttatgcctgggaaggtgg

SEQ ID NO: 272 - DNA, 23 bp, Homo sapiens
gctgcgtttgtgtggtgaatggg

SEQ ID NO: 273 - DNA, 23 bp, Homo sapiens
ggacatctgtggttcaaagaagg

SEQ ID NO: 274 - DNA, 23 bp, Homo sapiens
tgcagagaagatgcttctgaagg

SEQ ID NO: 275 - DNA, 23 bp, Homo sapiens
gcatctttggtgtactatgttgg

SEQ ID NO: 276 - DNA, 23 bp, Homo sapiens
agtcagttttcaatttgtcgagg

SEQ ID NO: 277 - DNA, 23 bp, Homo sapiens
cctctcccagctcagcgtgcagg

SEQ ID NO: 278 - DNA, 23 bp, Homo sapiens
tcttaatacgaagagcagttagg

SEQ ID NO: 279 - DNA, 23 bp, Homo sapiens
catagactagattctttgggagg

SEQ ID NO: 280 - DNA, 23 bp, Homo sapiens
gcttagatgcttgactctttagg

SEQ ID NO: 281 - DNA, 23 bp, Homo sapiens
ctgggctattgaatcactttagg

SEQ ID NO: 282 - DNA, 23 bp, Homo sapiens
ttccagggctcagctgtcactgg

SEQ ID NO: 283 - DNA, 23 bp, Homo sapiens
tgtgtcttgggttaggaagctgg

SEQ ID NO: 284 - DNA, 23 bp, Homo sapiens
gctttgtcgatgtgtgatttagg

SEQ ID NO: 285 - DNA, 23 bp, Homo sapiens
agagtattcaagcttagagatgg

SEQ ID NO: 286 - DNA, 23 bp, Homo sapiens
attcatcagctccggaagctggg

SEQ ID NO: 287 - DNA, 23 bp, Homo sapiens
cagaccactgcactccagcatgg

SEQ ID NO: 288 - DNA, 23 bp, Homo sapiens
tggaggagtggcgtcttcagagg

SEQ ID NO: 289 - DNA, 23 bp, Homo sapiens
gcagatgtggctacaaagtgagg

SEQ ID NO: 290 - DNA, 23 bp, Homo sapiens
gcagggagatttcacaatccagg

SEQ ID NO: 291 - DNA, 23 bp, Homo sapiens
tttctgaatttgcccaccagtgg

SEQ ID NO: 292 - DNA, 23 bp, Homo sapiens
gggagagacagagagtcatctgg

SEQ ID NO: 293 - DNA, 23 bp, Homo sapiens
tatgtaacactctgggcttcagg

SEQ ID NO: 294 - DNA, 23 bp, Homo sapiens
ccccgagagagttatcaaatggg

SEQ ID NO: 295 - DNA, 23 bp, Homo sapiens
gggtggcacttaggcccctccgg

SEQ ID NO: 296 - DNA, 23 bp, Homo sapiens
ggctcagatgagtgtcagtgagg

SEQ ID NO: 297 - DNA, 23 bp, Homo sapiens
gtcggcttctcacttaatatagg

SEQ ID NO: 298 - DNA, 23 bp, Homo sapiens
ggaacctccggagaggtcagagg

SEQ ID NO: 299 - DNA, 23 bp, Homo sapiens
ggctggaatcccgcccctagtgg

SEQ ID NO: 300 - DNA, 23 bp, Homo sapiens
gggcaagaccaggtgtgagaagg

SEQ ID NO: 301 - DNA, 23 bp, Homo sapiens
attctgacgctgcagtttaaagg

SEQ ID NO: 302 - DNA, 23 bp, Homo sapiens
acagtcacctgtgagtttaaagg

SEQ ID NO: 303 - DNA, 23 bp, Homo sapiens
gtatcagaaagcgatgacgtggg

SEQ ID NO: 304 - DNA, 23 bp, Homo sapiens
acagatcacagagggctggaggg

SEQ ID NO: 305 - DNA, 23 bp, Homo sapiens
agtgaacctaaagggtagtctgg

SEQ ID NO: 306 - DNA, 23 bp, Homo sapiens
actattgtgccttcttcctttgg

SEQ ID NO: 307 - DNA, 23 bp, Homo sapiens
gaaactaaggctcattcatcagg

SEQ ID NO: 308 - DNA, 23 bp, Homo sapiens
aagtgaaccgacaaagtgccagg

SEQ ID NO: 309 - DNA, 23 bp, Homo sapiens
aggaagcggagtttcacatctgg

SEQ ID NO: 310 - DNA, 23 bp, Homo sapiens
tactcagttgaattagaccgagg

SEQ ID NO: 311 - DNA, 23 bp, Homo sapiens
tccagcgcagctgattcagatgg

SEQ ID NO: 312 - DNA, 23 bp, Homo sapiens
tagctgttgcttcatgcttttgg

SEQ ID NO: 313 - DNA, 23 bp, Homo sapiens
tttcccctgtgcatgtgcgaagg

SEQ ID NO: 314 - DNA, 23 bp, Homo sapiens
caactgaggttggctctaggagg

SEQ ID NO: 315 - DNA, 23 bp, Homo sapiens
tttcttgacactctttgctttgg

SEQ ID NO: 316 - DNA, 23 bp, Homo sapiens
ttgggtactgtcctgtgatttgg

SEQ ID NO: 317 - DNA, 23 bp, Homo sapiens
aagatcctgcctctggtgagagg

SEQ ID NO: 318 - DNA, 23 bp, Homo sapiens
cctgcaagtaaagattcaagagg

SEQ ID NO: 319 - DNA, 23 bp, Homo sapiens
ggccaaccctggtccagctgagg

SEQ ID NO: 320 - DNA, 23 bp, Homo sapiens
gctcccacagcaccctagggggg

SEQ ID NO: 321 - DNA, 23 bp, Homo sapiens
gtgagggaactatataaaggagg

SEQ ID NO: 322 - DNA, 23 bp, Homo sapiens
aagcctggaactgattgcggagg

SEQ ID NO: 323 - DNA, 23 bp, Homo sapiens
aatggcagaatgcagttaagtgg

SEQ ID NO: 324 - DNA, 23 bp, Homo sapiens
gggtgccgcgcgccccctagtgg

SEQ ID NO: 325 - DNA, 23 bp, Homo sapiens
caaaacagattcttcaacccagg

SEQ ID NO: 326 - DNA, 23 bp, Homo sapiens
cccaaaggcaaagaaggcaacgg

SEQ ID NO: 327 - DNA, 23 bp, Homo sapiens
agggaaaggaaggaacctgaggg

SEQ ID NO: 328 - DNA, 23 bp, Homo sapiens
cagggcacagctcatgtcaccgg

SEQ ID NO: 329 - DNA, 23 bp, Homo sapiens
gtcctgaggccgtgctgagtggg

SEQ ID NO: 330 - DNA, 23 bp, Homo sapiens
tctaagtccaacttgtgagttgg

SEQ ID NO: 331 - DNA, 23 bp, Homo sapiens
gggactgcgtgtcacgagttcgg

SEQ ID NO: 332 - DNA, 23 bp, Homo sapiens
aatgctgcaagtcatgcacaagg

SEQ ID NO: 333 - DNA, 23 bp, Homo sapiens
aactcttctgctgcagcttttgg

SEQ ID NO: 334 - DNA, 23 bp, Homo sapiens
caaggtaggtggatcgcctgagg

SEQ ID NO: 335 - DNA, 23 bp, Homo sapiens
atgcggaagaaagagatgctcgg

SEQ ID NO: 336 - DNA, 23 bp, Homo sapiens
tgtcttcctcacatgactactgg

SEQ ID NO: 337 - DNA, 23 bp, Homo sapiens
actttctcatctttctaaggtgg

SEQ ID NO: 338 - DNA, 23 bp, Homo sapiens
ctgccctgggaggcagtgatggg

SEQ ID NO: 339 - DNA, 23 bp, Homo sapiens
ggcggcgcccctgggcgggcagg

SEQ ID NO: 340 - DNA, 23 bp, Homo sapiens
aagcattgcttaaacgcagaagg

SEQ ID NO: 341 - DNA, 23 bp, Homo sapiens
tttctgtgggtcagtgtccttgg

SEQ ID NO: 342 - DNA, 23 bp, Homo sapiens
gtgcatcctggcgcagtcagcgg

SEQ ID NO: 343 - DNA, 23 bp, Homo sapiens
cccctgcccccctgaatcacagg

SEQ ID NO: 344 - DNA, 23 bp, Homo sapiens
gctataaaactcgcacctccagg

SEQ ID NO: 345 - DNA, 23 bp, Homo sapiens
ctgtgcttttacaacttacgagg

SEQ ID NO: 346 - DNA, 23 bp, Homo sapiens
tctcgctgctgtggaacttgtgg

SEQ ID NO: 347 - DNA, 23 bp, Homo sapiens
gcagctgccgggcctaggagtgg

SEQ ID NO: 348 - DNA, 23 bp, Homo sapiens
agagggataaacctttggagggg

SEQ ID NO: 349 - DNA, 23 bp, Homo sapiens
tgctgccagtcatgtcaagaggg

SEQ ID NO: 350 - DNA, 23 bp, Homo sapiens
ccccaggatccctcctgaaaggg

SEQ ID NO: 351 - DNA, 23 bp, Homo sapiens
acaagtttattgagctatgctgg

SEQ ID NO: 352 - DNA, 23 bp, Homo sapiens
gctcctgcaggggctcagccagg

SEQ ID NO: 353 - DNA, 23 bp, Homo sapiens
ggacaggcccatgctgccccagg

SEQ ID NO: 354 - DNA, 23 bp, Homo sapiens
cagagagtggccgcagcagcagg

SEQ ID NO: 355 - DNA, 23 bp, Homo sapiens
gtcactggagcatactatactgg

SEQ ID NO: 356 - DNA, 23 bp, Homo sapiens
aaaggagtaccaggccgccaagg

SEQ ID NO: 357 - DNA, 23 bp, Homo sapiens
cttggactcatggtacacgttgg

SEQ ID NO: 358 - DNA, 23 bp, Homo sapiens
ttctcactcacgccctgacccgg

SEQ ID NO: 359 - DNA, 23 bp, Homo sapiens
gcagtttctactgactctctagg

SEQ ID NO: 360 - DNA, 23 bp, Homo sapiens
tatcaccagttcaagtgagaagg

SEQ ID NO: 361 - DNA, 23 bp, Homo sapiens
atatcgggctgaggaagcagtgg

SEQ ID NO: 362 - DNA, 23 bp, Homo sapiens
ctggctggaccccgacacgtagg

SEQ ID NO: 363 - DNA, 23 bp, Homo sapiens
gttccctgctccactctgagtgg

SEQ ID NO: 364 - DNA, 23 bp, Homo sapiens
ccagtgtgccccccgtgatgggg

SEQ ID NO: 365 - DNA, 23 bp, Homo sapiens
taccagtacctggagacctaggg

SEQ ID NO: 366 - DNA, 23 bp, Homo sapiens
cagctgggaaggaggcttagtgg

SEQ ID NO: 367 - DNA, 23 bp, Homo sapiens
tggtctcccaccctgcaacgggg

SEQ ID NO: 368 - DNA, 23 bp, Homo sapiens
cctgatgagagctaataccgtgg

SEQ ID NO: 369 - DNA, 23 bp, Homo sapiens
gtccctttcccagagcaacgtgg

SEQ ID NO: 370 - DNA, 23 bp, Homo sapiens
ggtggtggacaactcctgaatgg

SEQ ID NO: 371 - DNA, 23 bp, Homo sapiens
ggcgagtgcaatctcagcctagg

SEQ ID NO: 372 - DNA, 23 bp, Homo sapiens
gccaacagctgctaactgagcgg

SEQ ID NO: 373 - DNA, 23 bp, Homo sapiens
gggggccccagcagttaacaggg

SEQ ID NO: 374 - DNA, 23 bp, Homo sapiens
aggggctggggctgaactgaggg

SEQ ID NO: 375 - DNA, 23 bp, Homo sapiens
tgaagtgagctcatttaaacggg

SEQ ID NO: 376 - DNA, 23 bp, Homo sapiens
gagcctggagcccaggctgaagg

SEQ ID NO: 377 - DNA, 23 bp, Homo sapiens
gtttcaaagagtgtgtgaggcgg

SEQ ID NO: 378 - DNA, 23 bp, Homo sapiens
agggaagaggtataaacaaaggg

SEQ ID NO: 379 - DNA, 23 bp, Homo sapiens
ggaggggagcatggctcaggtgg

SEQ ID NO: 380 - DNA, 23 bp, Homo sapiens
actcccatcaagctggaggaagg

SEQ ID NO: 381 - DNA, 23 bp, Homo sapiens
cttcttgctcttcttcagaaagg

SEQ ID NO: 382 - DNA, 23 bp, Homo sapiens
aggtgggtatgaggactcagggg

SEQ ID NO: 383 - DNA, 23 bp, Homo sapiens
gacttggaaggagagactaaagg

SEQ ID NO: 384 - DNA, 23 bp, Homo sapiens
gagcaaaaagaaggagaaagtgg

SEQ ID NO: 385 - DNA, 23 bp, Homo sapiens
ttttcagaaaagaaggagtgcgg

SEQ ID NO: 386 - DNA, 23 bp, Homo sapiens
tttttctgtgtgtcaggagctgg

SEQ ID NO: 387 - DNA, 23 bp, Homo sapiens
aacgaaactactgtgtagatggg

SEQ ID NO: 388 - DNA, 23 bp, Homo sapiens
agcgaaactaccgtctaaggtgg

SEQ ID NO: 389 - DNA, 23 bp, Homo sapiens
gcaatgttaggactggattatgg

SEQ ID NO: 390 - DNA, 23 bp, Homo sapiens
ctccagaccgaggtctgagcggg

SEQ ID NO: 391 - DNA, 23 bp, Homo sapiens
gtggcactcacacctctgtctgg

SEQ ID NO: 392 - DNA, 23 bp, Homo sapiens
ttgcctctggatgtgcaagaggg

SEQ ID NO: 393 - DNA, 23 bp, Homo sapiens
gacctgtcagccgtgtgagccgg

SEQ ID NO: 394 - DNA, 23 bp, Homo sapiens
catgccatccgcttccaagacgg

SEQ ID NO: 395 - DNA, 23 bp, Homo sapiens
tgacacctccaaacccagcacgg

SEQ ID NO: 396 - DNA, 23 bp, Homo sapiens
tattttctcttcacttgtcctgg

SEQ ID NO: 397 - DNA, 23 bp, Homo sapiens
catcagagtccggcatatgaagg

SEQ ID NO: 398 - DNA, 23 bp, Homo sapiens
ctgagttagcatgatgttgtcgg

SEQ ID NO: 399 - DNA, 23 bp, Homo sapiens
tgtgccattgcactccaacttgg

SEQ ID NO: 400 - DNA, 23 bp, Homo sapiens
agaggctactcaaccctttaagg

SEQ ID NO: 401 - DNA, 23 bp, Homo sapiens
gagaaagcctagttctcacctgg

SEQ ID NO: 402 - DNA, 23 bp, Homo sapiens
tggccctcctcagaggacatggg

SEQ ID NO: 403 - DNA, 23 bp, Homo sapiens
aaggaggaagcgacactgccagg

SEQ ID NO: 404 - DNA, 23 bp, Homo sapiens
gcatcactaggcccaaccaatgg

SEQ ID NO: 405 - DNA, 23 bp, Homo sapiens
gttgagcaacgaagaagcactgg

SEQ ID NO: 406 - DNA, 23 bp, Homo sapiens
gtgggctggaggcctagatgcgg

SEQ ID NO: 407 - DNA, 23 bp, Homo sapiens
ctcagaaggacttcaaagcgggg

SEQ ID NO: 408 - DNA, 23 bp, Homo sapiens
tccgcatctcaagaataggaagg

SEQ ID NO: 409 - DNA, 23 bp, Homo sapiens
caacttcacaaatcaaggagagg

SEQ ID NO: 410 - DNA, 23 bp, Homo sapiens
accgtagagcgagtttaagatgg

SEQ ID NO: 411 - DNA, 23 bp, Homo sapiens
tcccaaacaacacagtagtccgg

SEQ ID NO: 412 - DNA, 23 bp, Homo sapiens
aaactttgtgctgtggctgaagg

SEQ ID NO: 413 - DNA, 23 bp, Homo sapiens
tcaaaactggcccatgctgatgg

SEQ ID NO: 414 - DNA, 23 bp, Homo sapiens
ctctgaaagtgacaatgcaaagg

SEQ ID NO: 415 - DNA, 23 bp, Homo sapiens
agctggtcaccagtctctgaggg

SEQ ID NO: 416 - DNA, 23 bp, Homo sapiens
agcacttcaacacttaatcaagg

SEQ ID NO: 417 - DNA, 23 bp, Homo sapiens
gtctgtctgctcaggctatctgg

SEQ ID NO: 418 - DNA, 23 bp, Homo sapiens
tagagaaggacaaatgcagctgg

SEQ ID NO: 419 - DNA, 23 bp, Homo sapiens
tcgctattcctctggcacacagg

SEQ ID NO: 420 - DNA, 23 bp, Homo sapiens
ttcaaaaggaccggctcatttgg

SEQ ID NO: 421 - DNA, 23 bp, Homo sapiens
ttgccatggttaccattcagtgg

SEQ ID NO: 422 - DNA, 23 bp, Homo sapiens
aaaaatgtcccctgttgttttgg

SEQ ID NO: 423 - DNA, 23 bp, Homo sapiens
aatggttagtgaggtgctacagg

SEQ ID NO: 424 - DNA, 23 bp, Homo sapiens
gatttgacctgcttcactctggg

SEQ ID NO: 425 - DNA, 23 bp, Homo sapiens
cgtaccgtcctgacgttttgagg

SEQ ID NO: 426 - DNA, 23 bp, Homo sapiens
attgtttcaaaacgtcaggacgg

SEQ ID NO: 427 - DNA, 23 bp, Homo sapiens
cctggcatcttcaaaagatgagg

SEQ ID NO: 428 - DNA, 23 bp, Homo sapiens
gcctttgaactgatgcattctgg

SEQ ID NO: 429 - DNA, 23 bp, Homo sapiens
cagacagcacatccctaaactgg

SEQ ID NO: 430 - DNA, 23 bp, Homo sapiens
actttggatctcaaaacgtcagg

SEQ ID NO: 431 - DNA, 23 bp, Homo sapiens
tccccagtcagaagaggatctgg

SEQ ID NO: 432 - DNA, 23 bp, Homo sapiens
tcccaggcagcactgctaggcgg

SEQ ID NO: 433 - DNA, 23 bp, Homo sapiens
ctctggaggctttcacatgtcgg

SEQ ID NO: 434 - DNA, 23 bp, Homo sapiens
ctgagttagtggtgatcagttgg

SEQ ID NO: 435 - DNA, 23 bp, Homo sapiens
caggtgggaaggctcagagaagg

SEQ ID NO: 436 - DNA, 23 bp, Homo sapiens
cggcgggggctgcagtgaagagg

SEQ ID NO: 437 - DNA, 23 bp, Homo sapiens
agtctccctgctgtcatttcagg

SEQ ID NO: 438 - DNA, 23 bp, Homo sapiens
gttttcagctcttccatcagtgg

SEQ ID NO: 439 - DNA, 23 bp, Homo sapiens
aagtgctccccactttctttagg

SEQ ID NO: 440 - DNA, 23 bp, Homo sapiens
tgggacaggagggggagcgtggg

SEQ ID NO: 441 - DNA, 23 bp, Homo sapiens
tccccgggctgcgactaggttgg

SEQ ID NO: 442 - DNA, 23 bp, Homo sapiens
aacctggcacttaggcctgttgg

SEQ ID NO: 443 - DNA, 23 bp, Homo sapiens
cacaagccttctgtacttttagg

SEQ ID NO: 444 - DNA, 23 bp, Homo sapiens
ctgggcgccagtggcttcaaggg

SEQ ID NO: 445 - DNA, 23 bp, Homo sapiens
gaaggcggggtctagtcatcagg

SEQ ID NO: 446 - DNA, 23 bp, Homo sapiens
cccctggcccaggatggagcagg

SEQ ID NO: 447 - DNA, 23 bp, Homo sapiens
gaggcgagagcctagatcatagg

SEQ ID NO: 448 - DNA, 23 bp, Homo sapiens
ctgccatccctctgattctttgg

SEQ ID NO: 449 - DNA, 23 bp, Homo sapiens
ggaagtacaccctcactattagg

SEQ ID NO: 450 - DNA, 23 bp, Homo sapiens
tgaacatcacgtctccctaaagg

SEQ ID NO: 451 - DNA, 23 bp, Homo sapiens
atggctttacttctcctctgtgg

SEQ ID NO: 452 - DNA, 23 bp, Homo sapiens
gtcttccagaagagttgatgagg

SEQ ID NO: 453 - DNA, 23 bp, Homo sapiens
aaaatgatgttgaaagggagagg

SEQ ID NO: 454 - DNA, 23 bp, Homo sapiens
atcaagcatccatctgactaagg

SEQ ID NO: 455 - DNA, 23 bp, Homo sapiens
atgatgccaccgtggagaaaggg

SEQ ID NO: 456 - DNA, 23 bp, Homo sapiens
gccaccaggccgacgccaccagg

SEQ ID NO: 457 - DNA, 23 bp, Homo sapiens
ggaaagacacctgtggggtttgg

SEQ ID NO: 458 - DNA, 23 bp, Homo sapiens
gggaagctggcttcatgtcatgg

SEQ ID NO: 459 - DNA, 23 bp, Homo sapiens
tgagaacggggaggaagtctagg

SEQ ID NO: 460 - DNA, 23 bp, Homo sapiens
ctggcgcccgggcagttttaggg

SEQ ID NO: 461 - DNA, 23 bp, Homo sapiens
ctacgggagaccgatatttaagg

SEQ ID NO: 462 - DNA, 23 bp, Homo sapiens
gacaggaagcggatcgtgtgagg

SEQ ID NO: 463 - DNA, 23 bp, Homo sapiens
gcagcgcaggcgggctcaccagg

SEQ ID NO: 464 - DNA, 23 bp, Homo sapiens
gacggaggagaaggggcttcagg

SEQ ID NO: 465 - DNA, 23 bp, Homo sapiens
gcctcggaatccaaggtgtaggg

SEQ ID NO: 466 - DNA, 23 bp, Homo sapiens
ataacattgattcacaagggagg

SEQ ID NO: 467 - DNA, 23 bp, Homo sapiens
ggcttcttggggagtttcttagg

SEQ ID NO: 468 - DNA, 23 bp, Homo sapiens
gacggcgcgtggctcagtccagg

SEQ ID NO: 469 - DNA, 23 bp, Homo sapiens
accatatgaaagcgtgatgaagg

SEQ ID NO: 470 - DNA, 23 bp, Homo sapiens
acacagacatatcaaatgcaagg

SEQ ID NO: 471 - DNA, 23 bp, Homo sapiens
cagtctgtgactaaaacagctgg

SEQ ID NO: 472 - DNA, 23 bp, Homo sapiens
tgaggcagccacggaagaagagg

SEQ ID NO: 473 - DNA, 23 bp, Homo sapiens
gacctacacagtgaactttgggg

SEQ ID NO: 474 - DNA, 23 bp, Homo sapiens
caaagatactgccttgcttttgg

SEQ ID NO: 475 - DNA, 23 bp, Homo sapiens
tgccgcagaagaggttgaagagg

SEQ ID NO: 476 - DNA, 23 bp, Homo sapiens
caggacagaaggaattgagaagg

SEQ ID NO: 477 - DNA, 23 bp, Homo sapiens
ggcgagaagtcggattagcaggg

SEQ ID NO: 478 - DNA, 23 bp, Homo sapiens
aattgaagaacgggacctagggg

SEQ ID NO: 479 - DNA, 23 bp, Homo sapiens
atgggaaatgaagaagacctagg

SEQ ID NO: 480 - DNA, 23 bp, Homo sapiens
tcaggcaactgccaaactgtagg

SEQ ID NO: 481 - DNA, 23 bp, Homo sapiens
tcctttcttctcccattccttgg

SEQ ID NO: 482 - DNA, 23 bp, Homo sapiens
aaaattctagctgcccttaaagg

SEQ ID NO: 483 - DNA, 23 bp, Homo sapiens
acgagaagctttcactttattgg

SEQ ID NO: 484 - DNA, 23 bp, Homo sapiens
ggggctccattaaggtgttttgg

SEQ ID NO: 485 - DNA, 23 bp, Homo sapiens
cgatgcccacttgttgtagtggg

SEQ ID NO: 486 - DNA, 23 bp, Homo sapiens
aacagcgcccacctgtcataggg

SEQ ID NO: 487 - DNA, 23 bp, Homo sapiens
aagatatcaacttggcatcctgg

SEQ ID NO: 488 - DNA, 23 bp, Homo sapiens
caaaagtggcagttacttcttgg

SEQ ID NO: 489 - DNA, 23 bp, Homo sapiens
cctccctctgggcctctagttgg

SEQ ID NO: 490 - DNA, 23 bp, Homo sapiens
tggcttcagttgccaatttttgg

SEQ ID NO: 491 - DNA, 23 bp, Homo sapiens
ccaagtatcgtcagaactactgg

SEQ ID NO: 492 - DNA, 23 bp, Homo sapiens
tcaaaaactcgtgctgctttggg

SEQ ID NO: 493 - DNA, 23 bp, Homo sapiens
agctctcaagaaaaagcagacgg

SEQ ID NO: 494 - DNA, 23 bp, Homo sapiens
tcagccaactgaggaaaaagtgg

SEQ ID NO: 495 - DNA, 23 bp, Homo sapiens
ccggggccatgatgaattagcgg

SEQ ID NO: 496 - DNA, 23 bp, Homo sapiens
agggtgcccaccatcatctgagg

SEQ ID NO: 497 - DNA, 23 bp, Homo sapiens
cagatactacacgcactcgtcgg

SEQ ID NO: 498 - DNA, 23 bp, Homo sapiens
cgccgacgccccggttgcgctgg

SEQ ID NO: 499 - DNA, 23 bp, Homo sapiens
caccaactggtcttctaatttgg

SEQ ID NO: 500 - DNA, 23 bp, Homo sapiens
gccctcttcctgggccttatagg

SEQ ID NO: 501 - DNA, 23 bp, Homo sapiens
cagatactacacacacttgtcgg

SEQ ID NO: 502 - DNA, 23 bp, Homo sapiens
cagatactacacacactcgtcgg

SEQ ID NO: 503 - DNA, 23 bp, Homo sapiens
tcctgacggggtggacgtcatgg

SEQ ID NO: 504 - DNA, 23 bp, Homo sapiens
atttcctgccaaagcatatttgg

SEQ ID NO: 505 - DNA, 23 bp, Homo sapiens
cacagcccaggctcacctacggg

SEQ ID NO: 506 - DNA, 23 bp, Homo sapiens
agctagattaactctccctttgg

SEQ ID NO: 507 - DNA, 23 bp, Homo sapiens
ccaaaatgccagaggacaagagg

SEQ ID NO: 508 - DNA, 23 bp, Homo sapiens
aggactccgtgtctttaaaaagg

SEQ ID NO: 509 - DNA, 23 bp, Homo sapiens
cataaaggcattatcagacccgg

SEQ ID NO: 510 - DNA, 23 bp, Homo sapiens
gttgtctggggcattgctggggg

SEQ ID NO: 511 - DNA, 23 bp, Homo sapiens
agaaaaccaggaggaagaggagg

SEQ ID NO: 512 - DNA, 23 bp, Homo sapiens
agcccccaacacatgtgactggg

SEQ ID NO: 513 - DNA, 23 bp, Homo sapiens
gaatcagtcggaggaacctgagg

SEQ ID NO: 514 - DNA, 23 bp, Homo sapiens
tagtactggagggccttgagggg

SEQ ID NO: 515 - DNA, 23 bp, Homo sapiens
ttggttgatgagcttcctgttgg

SEQ ID NO: 516 - DNA, 23 bp, Homo sapiens
aaaaacacagtgctacaagaagg

SEQ ID NO: 517 - DNA, 23 bp, Homo sapiens
taaaagggactttagagtgaagg

SEQ ID NO: 518 - DNA, 23 bp, Homo sapiens
gcttgtcttctgctgctcactgg

SEQ ID NO: 519 - DNA, 23 bp, Homo sapiens
aagaatagtagcaattgaccagg

SEQ ID NO: 520 - DNA, 23 bp, Homo sapiens
tgaagagcacaagactcagacgg

SEQ ID NO: 521 - DNA, 23 bp, Homo sapiens
aacaactcacctctcacccttgg

SEQ ID NO: 522 - DNA, 23 bp, Homo sapiens
gcaccatgtacttcgcttgaagg

SEQ ID NO: 523 - DNA, 23 bp, Homo sapiens
aacatgtcaagcaaagtacatgg

SEQ ID NO: 524 - DNA, 23 bp, Homo sapiens
agcgaagtacattgtgcgtaagg

SEQ ID NO: 525 - DNA, 23 bp, Homo sapiens
aggcaaaatacatcgtgtgctgg

SEQ ID NO: 526 - DNA, 23 bp, Homo sapiens
tgaagaagcctgggggcggtggg

SEQ ID NO: 527 - DNA, 23 bp, Homo sapiens
cctgccgtggtctgggctactgg

SEQ ID NO: 528 - DNA, 23 bp, Homo sapiens
aaactcttggtttccgtagctgg

SEQ ID NO: 529 - DNA, 23 bp, Homo sapiens
cttgctgtcagagttgccgtagg

SEQ ID NO: 530 - DNA, 23 bp, Homo sapiens
atgctttaatagtaacccacagg

SEQ ID NO: 531 - DNA, 23 bp, Homo sapiens
gtggaccccaataacatctttgg

SEQ ID NO: 532 - DNA, 23 bp, Homo sapiens
acagttagagccgatatcactgg

SEQ ID NO: 533 - DNA, 23 bp, Homo sapiens
attgtacacatatgagcctcggg

SEQ ID NO: 534 - DNA, 23 bp, Homo sapiens
ccctgccccaccccatgagctgg

SEQ ID NO: 535 - DNA, 23 bp, Homo sapiens
tccctgcagccgcacctagctgg

SEQ ID NO: 536 - DNA, 23 bp, Homo sapiens
aacccgctgagcacagcatgagg

SEQ ID NO: 537 - DNA, 23 bp, Homo sapiens
gatggcagcgggctcaaggtagg

SEQ ID NO: 538 - DNA, 23 bp, Homo sapiens
gaagcctgcaccatgttttgagg

SEQ ID NO: 539 - DNA, 23 bp, Homo sapiens
ctctcacgtttaagacacaaagg

SEQ ID NO: 540 - DNA, 23 bp, Homo sapiens
cacatgtaccgggagcgcggggg

SEQ ID NO: 541 - DNA, 23 bp, Homo sapiens
gtggctggcttcagtaccctcgg

SEQ ID NO: 542 - DNA, 23 bp, Homo sapiens
tacggtcctgagaagacccaagg

SEQ ID NO: 543 - DNA, 23 bp, Homo sapiens
ggcaggtcacagcttcttcttgg

SEQ ID NO: 544 - DNA, 23 bp, Homo sapiens
tagctcttctttccatgtgttgg

SEQ ID NO: 545 - DNA, 23 bp, Homo sapiens
atcagccgaatttctatgggagg

SEQ ID NO: 546 - DNA, 23 bp, Homo sapiens
tgacaggaacaggtcttggaagg

SEQ ID NO: 547 - DNA, 23 bp, Homo sapiens
gcagacctggctctcagtagcgg

SEQ ID NO: 548 - DNA, 23 bp, Homo sapiens
atctgggactcaacaaaaatggg

SEQ ID NO: 549 - DNA, 23 bp, Homo sapiens
ccttcaagcctaattactacagg

SEQ ID NO: 550 - DNA, 23 bp, Homo sapiens
ggcacttcagttggcactacagg

SEQ ID NO: 551 - DNA, 23 bp, Homo sapiens
atgaggaagaacaagcaagcagg

SEQ ID NO: 552 - DNA, 23 bp, Homo sapiens
aagtcccaggacttcagactagg

SEQ ID NO: 553 - DNA, 23 bp, Homo sapiens
ctgatgtagaatctcttgagcgg

SEQ ID NO: 554 - DNA, 23 bp, Homo sapiens
tcagtctccaccccaaatgcagg

SEQ ID NO: 555 - DNA, 23 bp, Homo sapiens
ttccacaaagaaagagtagcagg

SEQ ID NO: 556 - DNA, 23 bp, Homo sapiens
gggaccaaatgaaggctgagagg

SEQ ID NO: 557 - DNA, 23 bp, Homo sapiens
aaaattgggcttggaattacagg

SEQ ID NO: 558 - DNA, 23 bp, Homo sapiens
ggtggtcactgcgctatggcagg

SEQ ID NO: 559 - DNA, 23 bp, Homo sapiens
tatggcgcacgcttattttaggg

SEQ ID NO: 560 - DNA, 23 bp, Homo sapiens
atcacgttagggggggatgtggg

SEQ ID NO: 561 - DNA, 23 bp, Homo sapiens
ctgcagctgacccccctaaatgg

SEQ ID NO: 562 - DNA, 23 bp, Homo sapiens
gatcagacacttcaaggtctagg

SEQ ID NO: 563 - DNA, 23 bp, Homo sapiens
ggctgggtccctgagctaggagg

SEQ ID NO: 564 - DNA, 23 bp, Homo sapiens
cgagacgcatttcgtactttggg

SEQ ID NO: 565 - DNA, 23 bp, Homo sapiens
tctacatcaaactttgcacaagg

SEQ ID NO: 566 - DNA, 23 bp, Homo sapiens
caactcagagatagctttcttgg

SEQ ID NO: 567 - DNA, 23 bp, Homo sapiens
gacattgctagcctgccctgagg

SEQ ID NO: 568 - DNA, 23 bp, Homo sapiens
tgatctcagaggtgacaggaggg

SEQ ID NO: 569 - DNA, 23 bp, Homo sapiens
ggcctgtgctcttggcagaaagg

SEQ ID NO: 570 - DNA, 23 bp, Homo sapiens
ttaaccgaatgccaatagcaagg

SEQ ID NO: 571 - DNA, 23 bp, Homo sapiens
tgaggcagtctccaccttgatgg

SEQ ID NO: 572 - DNA, 23 bp, Homo sapiens
atgtcctggcttacggggaaagg

SEQ ID NO: 573 - DNA, 23 bp, Homo sapiens
atcccagggtggctgaatcacgg

SEQ ID NO: 574 - DNA, 23 bp, Homo sapiens
tgttcagaacttctcccagcagg

SEQ ID NO: 575 - DNA, 23 bp, Homo sapiens
tggagttcatagcaccataaagg

SEQ ID NO: 576 - DNA, 23 bp, Homo sapiens
gctcaaaccatgagcaacagtgg

SEQ ID NO: 577 - DNA, 23 bp, Homo sapiens
cagttacggcaattcacttaagg

SEQ ID NO: 578 - DNA, 23 bp, Homo sapiens
gcactttggcaaagtcagcctgg

SEQ ID NO: 579 - DNA, 23 bp, Homo sapiens
gggccaagtgctcctgtcaatgg

SEQ ID NO: 580 - DNA, 23 bp, Homo sapiens
cagtgctgcagcgagtgccctgg

SEQ ID NO: 581 - DNA, 23 bp, Homo sapiens
tgcaggggcggacagtgaggggg

SEQ ID NO: 582 - DNA, 23 bp, Homo sapiens
cccggccatctggggtcaggagg

SEQ ID NO: 583 - DNA, 23 bp, Homo sapiens
gtttgaaatctcctgctgactgg

SEQ ID NO: 584 - DNA, 23 bp, Homo sapiens
ccatccttggaagtctgcagtgg

SEQ ID NO: 585 - DNA, 23 bp, Homo sapiens
gattgcagctcagatatagttgg

SEQ ID NO: 586 - DNA, 23 bp, Homo sapiens
taatagctcagaagtactcttgg

SEQ ID NO: 587 - DNA, 23 bp, Homo sapiens
ggctccagcgttgctactttagg

SEQ ID NO: 588 - DNA, 23 bp, Homo sapiens
caaagccacatgtaaagacttgg

SEQ ID NO: 589 - DNA, 23 bp, Homo sapiens
cccggtgatgtcatctttcatgg

SEQ ID NO: 590 - DNA, 23 bp, Homo sapiens
ggccttctgatactaggatgtgg

SEQ ID NO: 591 - DNA, 23 bp, Homo sapiens
tggctttggagaaggctgctagg

SEQ ID NO: 592 - DNA, 23 bp, Homo sapiens
aaagcttcagttactccatgagg

SEQ ID NO: 593 - DNA, 23 bp, Homo sapiens
gcagggtcaatatgcttctttgg

SEQ ID NO: 594 - DNA, 23 bp, Homo sapiens
agttgaagaaaaacgtcctctgg

SEQ ID NO: 595 - DNA, 23 bp, Homo sapiens
tcttgaaatggattgagcagtgg

SEQ ID NO: 596 - DNA, 23 bp, Homo sapiens
cgaagaccctgttgattttctgg

SEQ ID NO: 597 - DNA, 23 bp, Homo sapiens
ttcaagtttcactgtgcttcagg

SEQ ID NO: 598 - DNA, 23 bp, Homo sapiens
cctggctctgaacccatcagggg

SEQ ID NO: 599 - DNA, 23 bp, Homo sapiens
aagtcaatggctctgaactgagg

SEQ ID NO: 600 - DNA, 23 bp, Homo sapiens
tacttggacctcaatattcaggg

SEQ ID NO: 601 - DNA, 23 bp, Homo sapiens
aagcacgaaaagaagtaacatgg

SEQ ID NO: 602 - DNA, 23 bp, Homo sapiens
ctaggctatgcatttgcattagg

SEQ ID NO: 603 - DNA, 23 bp, Homo sapiens
ggaagcagcatgggggtcaaagg

SEQ ID NO: 604 - DNA, 23 bp, Homo sapiens
agtcagtgacattatgcagcagg

SEQ ID NO: 605 - DNA, 23 bp, Homo sapiens
gtcgctgtttgattggctcttgg

SEQ ID NO: 606 - DNA, 23 bp, Homo sapiens
gatcacaccccaagcacaggagg

SEQ ID NO: 607 - DNA, 23 bp, Homo sapiens
gcgtcagaagtatcagcagaggg

SEQ ID NO: 608 - DNA, 23 bp, Homo sapiens
ggtgaattcactgtggaaaaggg

SEQ ID NO: 609 - DNA, 23 bp, Homo sapiens
tcagacacgattgaataagaagg

SEQ ID NO: 610 - DNA, 23 bp, Homo sapiens
tgcccgtcattacctgttccagg

SEQ ID NO: 611 - DNA, 23 bp, Homo sapiens
gcagtggggttgccgattacagg

SEQ ID NO: 612 - DNA, 23 bp, Homo sapiens
ggagtcaaggatcagctcacagg

SEQ ID NO: 613 - DNA, 23 bp, Homo sapiens
agaacagctggttaatgaaatgg

SEQ ID NO: 614 - DNA, 23 bp, Homo sapiens
acaggttaaagttttggggctgg

SEQ ID NO: 615 - DNA, 23 bp, Homo sapiens
gcaatgacaatgagaacaacagg

SEQ ID NO: 616 - DNA, 23 bp, Homo sapiens
gggaaatgagcatcattctgtgg

SEQ ID NO: 617 - DNA, 23 bp, Homo sapiens
ccgccccgagctcgggtcacggg

SEQ ID NO: 618 - DNA, 23 bp, Homo sapiens
tcaactactcaatttcatgctgg

SEQ ID NO: 619 - DNA, 23 bp, Homo sapiens
agtgatggtcaacatcacacagg

SEQ ID NO: 620 - DNA, 23 bp, Homo sapiens
ttatgcgacggtatgggacaagg

SEQ ID NO: 621 - DNA, 23 bp, Homo sapiens
tatttactctacggcaggttggg

SEQ ID NO: 622 - DNA, 23 bp, Homo sapiens
gcccccagtgaagtcagaagagg

SEQ ID NO: 623 - DNA, 23 bp, Homo sapiens
ttgctaaagcacagaggtggagg

SEQ ID NO: 624 - DNA, 23 bp, Homo sapiens
aagaagctgtggtctcagtacgg

SEQ ID NO: 625 - DNA, 23 bp, Homo sapiens
cacagcttcaaaactcttcatgg

SEQ ID NO: 626 - DNA, 23 bp, Homo sapiens
cccttcaatgcagaatattgagg

SEQ ID NO: 627 - DNA, 23 bp, Homo sapiens
cccttcgatgcagaatattgagg

SEQ ID NO: 628 - DNA, 23 bp, Homo sapiens
aggacatagggattttaacatgg

SEQ ID NO: 629 - DNA, 23 bp, Homo sapiens
atttctgtttaggccatctatgg

SEQ ID NO: 630 - DNA, 23 bp, Homo sapiens
aatagtggagatttctgtctagg

SEQ ID NO: 631 - DNA, 23 bp, Homo sapiens
tcattctccaatgtctctaaagg

SEQ ID NO: 632 - DNA, 23 bp, Homo sapiens
tgaattccagttgacatcagagg

SEQ ID NO: 633 - DNA, 23 bp, Homo sapiens
tcatcatgaaatgggtattcagg

SEQ ID NO: 634 - DNA, 23 bp, Homo sapiens
tttcaacatccagcgaggggtgg

SEQ ID NO: 635 - DNA, 23 bp, Homo sapiens
cctttccacatagaatactgagg

SEQ ID NO: 636 - DNA, 23 bp, Homo sapiens
ctgagccatgatgggcctagcgg

SEQ ID NO: 637 - DNA, 23 bp, Homo sapiens
ctgagaaacgatgggcctagcgg

SEQ ID NO: 638 - DNA, 23 bp, Homo sapiens
atgagcttagatgaagtagttgg

SEQ ID NO: 639 - DNA, 23 bp, Homo sapiens
gccagcggcacggcctgaggcgg

SEQ ID NO: 640 - DNA, 23 bp, Homo sapiens
gcgacttccagaagctgaagcgg

SEQ ID NO: 641 - DNA, 23 bp, Homo sapiens
gtgggcagactgctcactcgcgg

SEQ ID NO: 642 - DNA, 23 bp, Homo sapiens
attgtggcatgctgggtaactgg

SEQ ID NO: 643 - DNA, 23 bp, Homo sapiens
caattttcctactctgcaagtgg

SEQ ID NO: 644 - DNA, 23 bp, Homo sapiens
ctgaaaggctgtactgagccagg

SEQ ID NO: 645 - DNA, 23 bp, Homo sapiens
agtggctgaaggaggaatgatgg

SEQ ID NO: 646 - DNA, 23 bp, Homo sapiens
gagcaagttggtatctgctcagg

SEQ ID NO: 647 - DNA, 23 bp, Homo sapiens
gcagctggcttctcaggcatagg

SEQ ID NO: 648 - DNA, 23 bp, Homo sapiens
gctgcaagtcaagctgccttagg

SEQ ID NO: 649 - DNA, 23 bp, Homo sapiens
aaacaaggacctcggtaatatgg

SEQ ID NO: 650 - DNA, 23 bp, Homo sapiens
tgaggcacctacaatagtcaagg

SEQ ID NO: 651 - DNA, 23 bp, Homo sapiens
ttgttgctggtgtcgtctactgg

SEQ ID NO: 652 - DNA, 23 bp, Homo sapiens
ctcaggcatcagtcccccatagg

SEQ ID NO: 653 - DNA, 23 bp, Homo sapiens
ttttcctggctcttttcagttgg

SEQ ID NO: 654 - DNA, 23 bp, Homo sapiens
cggtttccatgaatatacagagg

SEQ ID NO: 655 - DNA, 23 bp, Homo sapiens
ccccagaagaactcctaagaagg

SEQ ID NO: 656 - DNA, 23 bp, Homo sapiens
gagccccgcctttccttcagggg

SEQ ID NO: 657 - DNA, 23 bp, Homo sapiens
tgctcttacgagttcttctgagg

SEQ ID NO: 658 - DNA, 23 bp, Homo sapiens
gacctttcttcagtattcgaagg

SEQ ID NO: 659 - DNA, 23 bp, Homo sapiens
caaaaccaagacggtgacactgg

SEQ ID NO: 660 - DNA, 23 bp, Homo sapiens
gttgggcgagtacgggctgcagg

SEQ ID NO: 661 - DNA, 23 bp, Homo sapiens
gagcaacccctcctcagtgctgg

SEQ ID NO: 662 - DNA, 23 bp, Homo sapiens
tggtgttcatctctgcttactgg

SEQ ID NO: 663 - DNA, 23 bp, Homo sapiens
tgtagccgctgtgcttgtcaagg

SEQ ID NO: 664 - DNA, 23 bp, Homo sapiens
gcagtgtgcagctgcagccttgg

SEQ ID NO: 665 - DNA, 23 bp, Homo sapiens
gaggcgggtgggacgctcacagg

SEQ ID NO: 666 - DNA, 23 bp, Homo sapiens
cacataagcccctgggggactgg

SEQ ID NO: 667 - DNA, 23 bp, Homo sapiens
tgtgtgttacgggggcttgtagg

SEQ ID NO: 668 - DNA, 23 bp, Homo sapiens
aacttgtttctaacggcccatgg

SEQ ID NO: 669 - DNA, 23 bp, Homo sapiens
aaagaccttcctctggcccaagg

SEQ ID NO: 670 - DNA, 23 bp, Homo sapiens
agatcagtgtttaacggtgatgg

SEQ ID NO: 671 - DNA, 23 bp, Homo sapiens
gtgtgtggagatgggtgatgtgg

SEQ ID NO: 672 - DNA, 23 bp, Homo sapiens
ctctaaccacgcctattaagcgg

SEQ ID NO: 673 - DNA, 23 bp, Homo sapiens
ggcgggcattggaccctagtagg

SEQ ID NO: 674 - DNA, 23 bp, Homo sapiens
gtatggagtggatactcagtagg

SEQ ID NO: 675 - DNA, 23 bp, Homo sapiens
gctccgatgggatgagagctggg

SEQ ID NO: 676 - DNA, 23 bp, Homo sapiens
aggacattcaaaggtttatgtgg

SEQ ID NO: 677 - DNA, 23 bp, Homo sapiens
caaggtacaacccagaaacaagg

SEQ ID NO: 678 - DNA, 23 bp, Homo sapiens
agtgacattcctatcatctgtgg

SEQ ID NO: 679 - DNA, 23 bp, Homo sapiens
ctcccccggccgtcctgaggggg

SEQ ID NO: 680 - DNA, 23 bp, Homo sapiens
gctggatcttacataccctgagg

SEQ ID NO: 681 - DNA, 23 bp, Homo sapiens
atgcagaaaatttttctggctgg

SEQ ID NO: 682 - DNA, 23 bp, Homo sapiens
ggcaagcttctagtgtctcaagg

SEQ ID NO: 683 - DNA, 23 bp, Homo sapiens
tcacagggtgaagccagatttgg

SEQ ID NO: 684 - DNA, 23 bp, Homo sapiens
tttgtcaaacaattcgcccaagg

SEQ ID NO: 685 - DNA, 23 bp, Homo sapiens
actgggaggcgctgctcaaaagg

SEQ ID NO: 686 - DNA, 23 bp, Homo sapiens
agaaaaccgcctggtctttgagg

SEQ ID NO: 687 - DNA, 23 bp, Homo sapiens
ccgatatgttaccaaactgctgg

SEQ ID NO: 688 - DNA, 23 bp, Homo sapiens
gggaaaggggtggacttcagtgg

SEQ ID NO: 689 - DNA, 23 bp, Homo sapiens
cctggaggcttgagcaaactcgg

SEQ ID NO: 690 - DNA, 23 bp, Homo sapiens
attatgtgggattccaaaagtgg

SEQ ID NO: 691 - DNA, 23 bp, Homo sapiens
cagtaggcatcacatatgcttgg

SEQ ID NO: 692 - DNA, 23 bp, Homo sapiens
cagtgaagagcagaggaaagagg

SEQ ID NO: 693 - DNA, 23 bp, Homo sapiens
caaatcaggaagaaaagtggagg

SEQ ID NO: 694 - DNA, 23 bp, Homo sapiens
ccattaacttctccttgactggg

SEQ ID NO: 695 - DNA, 23 bp, Homo sapiens
gaagagcagaaccaacttacagg

SEQ ID NO: 696 - DNA, 23 bp, Homo sapiens
tgccaagaatactgagaaacagg

SEQ ID NO: 697 - DNA, 23 bp, Homo sapiens
tgcgaccgagctcagggcccagg

SEQ ID NO: 698 - DNA, 23 bp, Homo sapiens
agggtagttttgctaggtctggg

SEQ ID NO: 699 - DNA, 23 bp, Homo sapiens
tgtcagtccagtgtgcatggagg

SEQ ID NO: 700 - DNA, 23 bp, Homo sapiens
atctccaagtctcagctgtcagg

SEQ ID NO: 701 - DNA, 23 bp, Homo sapiens
cgaaaagtcagattcacccgtgg

SEQ ID NO: 702 - DNA, 23 bp, Homo sapiens
tcatcattagtaagctcccgtgg

SEQ ID NO: 703 - DNA, 23 bp, Homo sapiens
ctcaaagctctgacgtcaccagg

SEQ ID NO: 704 - DNA, 23 bp, Homo sapiens
agccaaggaggcggttcacacgg

SEQ ID NO: 705 - DNA, 23 bp, Homo sapiens
cccgaaaggtgaagatgcggcgg

SEQ ID NO: 706 - DNA, 23 bp, Homo sapiens
ctggcggtcacttgcccagcagg

SEQ ID NO: 707 - DNA, 23 bp, Homo sapiens
tctgtagggtcatcgtcctctgg

SEQ ID NO: 708 - DNA, 23 bp, Homo sapiens
gtagaaagctgggggtcagcagg

SEQ ID NO: 709 - DNA, 23 bp, Homo sapiens
ctggtgtgtgattcttcaaaagg

SEQ ID NO: 710 - DNA, 23 bp, Homo sapiens
cggggctttgtgtgtgttaaggg

SEQ ID NO: 711 - DNA, 23 bp, Homo sapiens
aataaacttgtgtcagtcccagg

SEQ ID NO: 712 - DNA, 23 bp, Homo sapiens
gagtcactctagggctcagatgg

SEQ ID NO: 713 - DNA, 23 bp, Homo sapiens
atgctgttctcaatcagcaccgg

SEQ ID NO: 714 - DNA, 23 bp, Homo sapiens
aaagggtggcgacgcttagatgg

SEQ ID NO: 715 - DNA, 23 bp, Homo sapiens
gtgttcccctgggatttagatgg

SEQ ID NO: 716 - DNA, 23 bp, Homo sapiens
agactggcagtgtgctcagatgg

SEQ ID NO: 717 - DNA, 23 bp, Homo sapiens
agttagggaatgagaagtagagg

SEQ ID NO: 718 - DNA, 23 bp, Homo sapiens
ggtatttgggggtggttagatgg

SEQ ID NO: 719 - DNA, 23 bp, Homo sapiens
gtggggcactcagggagcagcgg

SEQ ID NO: 720 - DNA, 23 bp, Homo sapiens
ttctttgactagaccttcaatgg

SEQ ID NO: 721 - DNA, 23 bp, Homo sapiens
cgttaggttttcttttcgcctgg

SEQ ID NO: 722 - DNA, 23 bp, Homo sapiens
gctccaaggcccagggcatgcgg

SEQ ID NO: 723 - DNA, 23 bp, Homo sapiens
ccctgagcgtcctgttctgaggg

SEQ ID NO: 724 - DNA, 23 bp, Homo sapiens
acgggacactcagggagcagtgg

SEQ ID NO: 725 - DNA, 23 bp, Homo sapiens
tcagcgtgagaagcttaactagg

SEQ ID NO: 726 - DNA, 23 bp, Homo sapiens
tgtctagagttgaactgtatggg

SEQ ID NO: 727 - DNA, 23 bp, Homo sapiens
tccagggagctctggtagcctgg

SEQ ID NO: 728 - DNA, 23 bp, Homo sapiens
gtgcaagatggtagcaagaaagg

SEQ ID NO: 729 - DNA, 23 bp, Homo sapiens
ggcctgactgtggtgctcatggg

SEQ ID NO: 730 - DNA, 23 bp, Homo sapiens
gcacaccgccaatatttcatggg

SEQ ID NO: 731 - DNA, 23 bp, Homo sapiens
tctgaactggaccacgtgatcgg

SEQ ID NO: 732 - DNA, 23 bp, Homo sapiens
atttcctgggccacatgacaggg

SEQ ID NO: 733 - DNA, 23 bp, Homo sapiens
gatttgctggtctgtttaactgg

SEQ ID NO: 734 - DNA, 23 bp, Homo sapiens
ggtcctgagatctttatttctgg

SEQ ID NO: 735 - DNA, 23 bp, Homo sapiens
taagctgataaatctcttcgcgg

SEQ ID NO: 736 - DNA, 23 bp, Homo sapiens
ttctacgagctgctgatcaaagg

SEQ ID NO: 737 - DNA, 23 bp, Homo sapiens
cttagagctgtcagggctcttgg

SEQ ID NO: 738 - DNA, 23 bp, Homo sapiens
cagaccggccagttgtcagttgg

SEQ ID NO: 739 - DNA, 23 bp, Homo sapiens
ctaggggagaaccacggaacagg

SEQ ID NO: 740 - DNA, 23 bp, Homo sapiens
ttgctgcttcttagcaaaactgg

SEQ ID NO: 741 - DNA, 23 bp, Homo sapiens
catttgatttaccagttcggagg

SEQ ID NO: 742 - DNA, 23 bp, Homo sapiens
ctgggcagggcctcgcctgaggg

SEQ ID NO: 743 - DNA, 23 bp, Homo sapiens
gacgcagctaggcagtgacaagg

SEQ ID NO: 744 - DNA, 23 bp, Homo sapiens
caagaccaagcgggaggaagtgg

SEQ ID NO: 745 - DNA, 23 bp, Homo sapiens
caagaccaagcaggaggaagtgg

SEQ ID NO: 746 - DNA, 23 bp, Homo sapiens
cttggctaggtttccattcatgg

SEQ ID NO: 747 - DNA, 23 bp, Homo sapiens
gacagtgccaaaaagttgtgagg

SEQ ID NO: 748 - DNA, 23 bp, Homo sapiens
atgtgagcctgtcctacagatgg

SEQ ID NO: 749 - DNA, 23 bp, Homo sapiens
gaaggcaagggagcgctaggagg

SEQ ID NO: 750 - DNA, 23 bp, Homo sapiens
ccgcgcggcgcaggggtcaccgg

SEQ ID NO: 751 - DNA, 23 bp, Homo sapiens
aggagctccctcagcccatcagg

SEQ ID NO: 752 - DNA, 23 bp, Homo sapiens
tgcatatttacacaggagaaagg

SEQ ID NO: 753 - DNA, 23 bp, Homo sapiens
acgcccattgtggtgtgagcagg

SEQ ID NO: 754 - DNA, 23 bp, Homo sapiens
aattaagtggacgccacaaaagg

SEQ ID NO: 755 - DNA, 23 bp, Homo sapiens
ctgggcagtctaggttgtcatgg

SEQ ID NO: 756 - DNA, 23 bp, Homo sapiens
cggctcagtgtcaggaataatgg

SEQ ID NO: 757 - DNA, 23 bp, Homo sapiens
gtcaggagtaatgattgtagagg

SEQ ID NO: 758 - DNA, 23 bp, Homo sapiens
ggccgaggccgaggcctgagcgg

SEQ ID NO: 759 - DNA, 23 bp, Homo sapiens
acaaactaaagcaagtgacatgg

SEQ ID NO: 760 - DNA, 23 bp, Homo sapiens
agagcctgatgcagagatggtgg

SEQ ID NO: 761 - DNA, 23 bp, Homo sapiens
acagggatggcagttagatgagg

SEQ ID NO: 762 - DNA, 23 bp, Homo sapiens
tggtggagatactgatctgaagg

SEQ ID NO: 763 - DNA, 23 bp, Homo sapiens
tggcctatcgctatgaaacctgg

SEQ ID NO: 764 - DNA, 23 bp, Homo sapiens
ttcatggaccaggctcattgagg

SEQ ID NO: 765 - DNA, 23 bp, Homo sapiens
tgtcaaatgctggacctagttgg

SEQ ID NO: 766 - DNA, 23 bp, Homo sapiens
ttcacccgacgcttagattaggg

SEQ ID NO: 767 - DNA, 23 bp, Homo sapiens
ctggtccgtcactcagaagcagg

SEQ ID NO: 768 - DNA, 23 bp, Homo sapiens
ccctgagccagcttcacttgagg

SEQ ID NO: 769 - DNA, 23 bp, Homo sapiens
gccaccacagaatcagcaaatgg

SEQ ID NO: 770 - DNA, 23 bp, Homo sapiens
aaaattaatggcaactgcacagg

SEQ ID NO: 771 - DNA, 23 bp, Homo sapiens
acatactgtgatgtcatttctgg

SEQ ID NO: 772 - DNA, 23 bp, Homo sapiens
ttctattagtaactctgctgagg

SEQ ID NO: 773 - DNA, 23 bp, Homo sapiens
ggccccccgtccctgggatgggg

SEQ ID NO: 774 - DNA, 23 bp, Homo sapiens
ctcacagcacatgcccgagtcgg

SEQ ID NO: 775 - DNA, 23 bp, Homo sapiens
gctgcttcagttcccagctgtgg

SEQ ID NO: 776 - DNA, 23 bp, Homo sapiens
ctggctgttctccaaaaatgagg

SEQ ID NO: 777 - DNA, 23 bp, Homo sapiens
agacacggtcacatcaccattgg

SEQ ID NO: 778 - DNA, 23 bp, Homo sapiens
agttggtggaaccaagtggctgg

SEQ ID NO: 779 - DNA, 23 bp, Homo sapiens
ccagtagaagagagctccattgg

SEQ ID NO: 780 - DNA, 23 bp, Homo sapiens
tcacaaccttcaagaaattcggg

SEQ ID NO: 781 - DNA, 23 bp, Homo sapiens
cgacctggctctcgctggagggg

SEQ ID NO: 782 - DNA, 23 bp, Homo sapiens
tccaccttgttgcagctcagggg

SEQ ID NO: 783 - DNA, 23 bp, Homo sapiens
aggcaggaagccgcagctgaggg

SEQ ID NO: 784 - DNA, 23 bp, Homo sapiens
agccaagcgtcagtttccaatgg

SEQ ID NO: 785 - DNA, 23 bp, Homo sapiens
tcagagagatggaaggatcttgg

SEQ ID NO: 786 - DNA, 23 bp, Homo sapiens
atagggtggttgtttctgcctgg

SEQ ID NO: 787 - DNA, 23 bp, Homo sapiens
tcaggaccagtggatgatctagg

SEQ ID NO: 788 - DNA, 23 bp, Homo sapiens
caggcagtatcaacctgaagagg

SEQ ID NO: 789 - DNA, 23 bp, Homo sapiens
gatgtgtcagctgcagttcttgg

SEQ ID NO: 790 - DNA, 23 bp, Homo sapiens
ctagattaggagtctagctcagg

SEQ ID NO: 791 - DNA, 23 bp, Homo sapiens
ttgataaaccatctctagagagg

SEQ ID NO: 792 - DNA, 23 bp, Homo sapiens
accagtatagtatagcactaagg

SEQ ID NO: 793 - DNA, 23 bp, Homo sapiens
tggttcggcatgcagtgaggggg

SEQ ID NO: 794 - DNA, 23 bp, Homo sapiens
ggcccgctggttacggacgacgg

SEQ ID NO: 795 - DNA, 23 bp, Homo sapiens
gtgttggaagagatggtgatggg

SEQ ID NO: 796 - DNA, 23 bp, Homo sapiens
gaagtcaccgccccatgacaggg

SEQ ID NO: 797 - DNA, 23 bp, Homo sapiens
agtctgaactttgccaataaagg

SEQ ID NO: 798 - DNA, 23 bp, Homo sapiens
aggtcgaatcatcatagttgtgg

SEQ ID NO: 799 - DNA, 23 bp, Homo sapiens
tgggatgtttagaaatctgctgg

SEQ ID NO: 800 - DNA, 23 bp, Homo sapiens
gcagtgagaaccagctatacagg

SEQ ID NO: 801 - DNA, 23 bp, Homo sapiens
gctgctcgttagatgtccaaagg

SEQ ID NO: 802 - DNA, 23 bp, Homo sapiens
agtgtctctcttcagtcaatagg

SEQ ID NO: 803 - DNA, 23 bp, Homo sapiens
aggagggggagctggcttagtgg

SEQ ID NO: 804 - DNA, 23 bp, Homo sapiens
tcaaagctttctgaatctgttgg

SEQ ID NO: 805 - DNA, 23 bp, Homo sapiens
ggcccagccaggacgctaggagg

SEQ ID NO: 806 - DNA, 23 bp, Homo sapiens
cttgacaggtgagttgtttttgg

SEQ ID NO: 807 - DNA, 23 bp, Homo sapiens
gaacacagagtcacagcttcagg

SEQ ID NO: 808 - DNA, 23 bp, Homo sapiens
agaagacttcaagccttaaaagg

SEQ ID NO: 809 - DNA, 23 bp, Homo sapiens
ccatccaggcagattcaggctgg

SEQ ID NO: 810 - DNA, 23 bp, Homo sapiens
tcctggggatagctcagcccagg

SEQ ID NO: 811 - DNA, 23 bp, Homo sapiens
gcagagtgtgtggggttcagggg

SEQ ID NO: 812 - DNA, 23 bp, Homo sapiens
agcgggccagcctgaaaaggggg

SEQ ID NO: 813 - DNA, 23 bp, Homo sapiens
agccaaagatgactttgaagagg

SEQ ID NO: 814 - DNA, 23 bp, Homo sapiens
gagtgacaccgagcagtcagagg

SEQ ID NO: 815 - DNA, 23 bp, Homo sapiens
tggacacaccgtggtaaagaagg

SEQ ID NO: 816 - DNA, 23 bp, Homo sapiens
tgaccgttcgctgttacgagtgg

SEQ ID NO: 817 - DNA, 23 bp, Homo sapiens
atgttttattagccttctgcagg

SEQ ID NO: 818 - DNA, 23 bp, Homo sapiens
ccattgtactccagccagccagg

SEQ ID NO: 819 - DNA, 23 bp, Homo sapiens
tatgaagagctggtacacgcagg

SEQ ID NO: 820 - DNA, 23 bp, Homo sapiens
tgctatgacttaggtcttcaagg

SEQ ID NO: 821 - DNA, 23 bp, Homo sapiens
cctcttcagatgtttgaacttgg

SEQ ID NO: 822 - DNA, 23 bp, Homo sapiens
tgatgtactgactctgggtgggg

SEQ ID NO: 823 - DNA, 23 bp, Homo sapiens
atgagagaggagaatgaataagg

SEQ ID NO: 824 - DNA, 23 bp, Homo sapiens
agatgcatgtttccaatatgagg

SEQ ID NO: 825 - DNA, 23 bp, Homo sapiens
tagtagcttacaagcatcaaagg

SEQ ID NO: 826 - DNA, 23 bp, Homo sapiens
atttcaaattgtgcgtcatcggg

SEQ ID NO: 827 - DNA, 23 bp, Homo sapiens
cacctcaaacctcaagtgactgg

SEQ ID NO: 828 - DNA, 23 bp, Homo sapiens
ttctaagccaggagccgagatgg

SEQ ID NO: 829 - DNA, 23 bp, Homo sapiens
aactccccagcactcagccccgg

SEQ ID NO: 830 - DNA, 23 bp, Homo sapiens
cccatctctggtttcagaagggg

SEQ ID NO: 831 - DNA, 23 bp, Homo sapiens
gagcccagcgccaagcctacagg

SEQ ID NO: 832 - DNA, 23 bp, Homo sapiens
acgtgcagctgctgcttcactgg

SEQ ID NO: 833 - DNA, 23 bp, Homo sapiens
tgcagggccacaggtgtctgagg

SEQ ID NO: 834 - DNA, 23 bp, Homo sapiens
atggatctagctgtagccctagg

SEQ ID NO: 835 - DNA, 23 bp, Homo sapiens
tctcgcatagctacattctgagg

SEQ ID NO: 836 - DNA, 23 bp, Homo sapiens
aatggttcagatgacaattctgg

SEQ ID NO: 837 - DNA, 23 bp, Homo sapiens
gtcagcgtctctaggagccgtgg

SEQ ID NO: 838 - DNA, 23 bp, Homo sapiens
gccgtcccgcggtgtcatgccgg

SEQ ID NO: 839 - DNA, 23 bp, Homo sapiens
ggaagtactgactgctatatagg

SEQ ID NO: 840 - DNA, 23 bp, Homo sapiens
gtgacagctgtaagacttgctgg

SEQ ID NO: 841 - DNA, 23 bp, Homo sapiens
cggcagggggcgctactgctcgg

SEQ ID NO: 842 - DNA, 23 bp, Homo sapiens
ttccacgtcagttaaagatcagg

SEQ ID NO: 843 - DNA, 23 bp, Homo sapiens
gctcagtgagtgacagctgcagg

SEQ ID NO: 844 - DNA, 23 bp, Homo sapiens
ggccatagcgcaatgacataagg

SEQ ID NO: 845 - DNA, 23 bp, Homo sapiens
tctcctgcagtcgggactgaagg

SEQ ID NO: 846 - DNA, 23 bp, Homo sapiens
atgaaccagcttggctgatgagg

SEQ ID NO: 847 - DNA, 23 bp, Homo sapiens
ctgcaagaacttcttgactgagg

SEQ ID NO: 848 - DNA, 23 bp, Homo sapiens
gtcattctcaaaggggaagctgg

SEQ ID NO: 849 - DNA, 23 bp, Homo sapiens
gggctggggcacgcattcactgg

SEQ ID NO: 850 - DNA, 23 bp, Homo sapiens
agaaggagtagtaagtatcaagg

SEQ ID NO: 851 - DNA, 23 bp, Homo sapiens
caaagaggctttattgagagtgg

SEQ ID NO: 852 - DNA, 23 bp, Homo sapiens
agagctcactggatattgcacgg

SEQ ID NO: 853 - DNA, 23 bp, Homo sapiens
ggcggtgctgcggtcagcaccgg

SEQ ID NO: 854 - DNA, 23 bp, Homo sapiens
ctgggcctggcctttctcagcgg

SEQ ID NO: 855 - DNA, 23 bp, Homo sapiens
agcatcaagagaatatgtacagg

SEQ ID NO: 856 - DNA, 23 bp, Homo sapiens
tagtgcttcccggtcctaacagg

SEQ ID NO: 857 - DNA, 23 bp, Homo sapiens
cgattctgagacctactgagagg

SEQ ID NO: 858 - DNA, 23 bp, Homo sapiens
attagtgctcgaacttcatcagg

SEQ ID NO: 859 - DNA, 23 bp, Homo sapiens
ggagctaagttagctctttctgg

SEQ ID NO: 860 - DNA, 23 bp, Homo sapiens
gaacaaacacactgaacagcagg

SEQ ID NO: 861 - DNA, 23 bp, Homo sapiens
ctagattcagcatttagccaagg

SEQ ID NO: 862 - DNA, 23 bp, Homo sapiens
gaagttttgtgtggaatgtgagg

SEQ ID NO: 863 - DNA, 23 bp, Homo sapiens
caggctgggaacaggtaatcagg

SEQ ID NO: 864 - DNA, 23 bp, Homo sapiens
ccagaatggcacagaagtagggg

SEQ ID NO: 865 - DNA, 23 bp, Homo sapiens
cctggaagaagaggacgtgaggg

SEQ ID NO: 866 - DNA, 23 bp, Homo sapiens
tggggagccagggcgctgagagg

SEQ ID NO: 867 - DNA, 23 bp, Homo sapiens
ttagggaaaatcggaactgttgg

SEQ ID NO: 868 - DNA, 23 bp, Homo sapiens
tttgcatagaatgccttctgagg

SEQ ID NO: 869 - DNA, 23 bp, Homo sapiens
cttagcatggaagaggagtgagg

SEQ ID NO: 870 - DNA, 23 bp, Homo sapiens
tgaagaatgcagcaaggtatagg

SEQ ID NO: 871 - DNA, 23 bp, Homo sapiens
aacaggatgaccaaattgagcgg

SEQ ID NO: 872 - DNA, 23 bp, Homo sapiens
aacaggatgaacaaattgagcgg

SEQ ID NO: 873 - DNA, 23 bp, Homo sapiens
tagaaaataccagtgggaaaagg

SEQ ID NO: 874 - DNA, 23 bp, Homo sapiens
agatagggtggcggctcagctgg

SEQ ID NO: 875 - DNA, 23 bp, Homo sapiens
ctgaaaggccttgctataacagg

SEQ ID NO: 876 - DNA, 23 bp, Homo sapiens
ggctctttggacttgaatcctgg

SEQ ID NO: 877 - DNA, 23 bp, Homo sapiens
ctggaggggtgtttgtgagaagg

SEQ ID NO: 878 - DNA, 23 bp, Homo sapiens
ggctccacagggatctaaggagg

SEQ ID NO: 879 - DNA, 23 bp, Homo sapiens
gtagtcgttcatactccagctgg

SEQ ID NO: 880 - DNA, 23 bp, Homo sapiens
gtgagtcaaacaaagagaagagg

SEQ ID NO: 881 - DNA, 23 bp, Homo sapiens
ttttgacatatcagtcagtctgg

SEQ ID NO: 882 - DNA, 23 bp, Homo sapiens
tatttttgcggtaacctacttgg

SEQ ID NO: 883 - DNA, 23 bp, Homo sapiens
tctttttgtacagcggttccagg

SEQ ID NO: 884 - DNA, 23 bp, Homo sapiens
ttacagaacgtatgttcagttgg

SEQ ID NO: 885 - DNA, 23 bp, Homo sapiens
acactgacctagagattagatgg

SEQ ID NO: 886 - DNA, 23 bp, Homo sapiens
agcctgaactggtgcattaaagg

SEQ ID NO: 887 - DNA, 23 bp, Homo sapiens
tacctctttgaaattgtggaagg

SEQ ID NO: 888 - DNA, 23 bp, Homo sapiens
gctctgaagcttcagattgaagg

SEQ ID NO: 889 - DNA, 23 bp, Homo sapiens
cccggcgccattgggttagatgg

SEQ ID NO: 890 - DNA, 23 bp, Homo sapiens
taactttatgggttggtttgtgg

SEQ ID NO: 891 - DNA, 23 bp, Homo sapiens
tggattcctttggagaagaaggg

SEQ ID NO: 892 - DNA, 23 bp, Homo sapiens
agatgcagagcatggagaagagg

SEQ ID NO: 893 - DNA, 23 bp, Homo sapiens
attttcatcactggtggggttgg

SEQ ID NO: 894 - DNA, 23 bp, Homo sapiens
actaaggactagggtgcagaagg

SEQ ID NO: 895 - DNA, 23 bp, Homo sapiens
gttcccaccaggagctaatgagg

SEQ ID NO: 896 - DNA, 23 bp, Homo sapiens
ctgggaggtcttatttcaagagg

SEQ ID NO: 897 - DNA, 23 bp, Homo sapiens
gtcaacagttactctgtagctgg

SEQ ID NO: 898 - DNA, 23 bp, Homo sapiens
gctgcgtgctcagcggtaaacgg

SEQ ID NO: 899 - DNA, 23 bp, Homo sapiens
ctgctgtctggctcagcccgtgg

SEQ ID NO: 900 - DNA, 23 bp, Homo sapiens
tcggctcagcagaagccccacgg

SEQ ID NO: 901 - DNA, 23 bp, Homo sapiens
ttctcatactctcctccccttgg

SEQ ID NO: 902 - DNA, 23 bp, Homo sapiens
tagcatgtttcttctttccatgg

SEQ ID NO: 903 - DNA, 23 bp, Homo sapiens
ggacctcactggcaaaggctagg

SEQ ID NO: 904 - DNA, 23 bp, Homo sapiens
accccaaaccagactctaagcgg

SEQ ID NO: 905 - DNA, 23 bp, Homo sapiens
atcagagagacacactgaggagg

SEQ ID NO: 906 - DNA, 23 bp, Homo sapiens
cggcgagtatcagaaaatcgtgg

SEQ ID NO: 907 - DNA, 23 bp, Homo sapiens
gccagagtcttttgctcagatgg

SEQ ID NO: 908 - DNA, 23 bp, Homo sapiens
gctgaacgggaagaagtggcggg

SEQ ID NO: 909 - DNA, 23 bp, Homo sapiens
aggccaaaactctccatcacagg

SEQ ID NO: 910 - DNA, 23 bp, Homo sapiens
cgggaaggaggatcacgcacagg

SEQ ID NO: 911 - DNA, 23 bp, Homo sapiens
cacacgctgtcagacctcctcgg

SEQ ID NO: 912 - DNA, 23 bp, Homo sapiens
tctactgcttagctgtggcaagg

SEQ ID NO: 913 - DNA, 23 bp, Homo sapiens
agctgtaagagatcaggaagagg

SEQ ID NO: 914 - DNA, 23 bp, Homo sapiens
cctattggaaagccttaaaccgg

SEQ ID NO: 915 - DNA, 23 bp, Homo sapiens
agccccgctggcatagctacagg

SEQ ID NO: 916 - DNA, 23 bp, Homo sapiens
aatggaaagcgggaaggagaagg

SEQ ID NO: 917 - DNA, 23 bp, Homo sapiens
cagggccatgactagaccccagg

SEQ ID NO: 918 - DNA, 23 bp, Homo sapiens
aggctgaactgctcacacattgg

SEQ ID NO: 919 - DNA, 23 bp, Homo sapiens
gtgtcaactaaggccattcatgg

SEQ ID NO: 920 - DNA, 23 bp, Homo sapiens
gaaaagcacaccacaacgagtgg

SEQ ID NO: 921 - DNA, 23 bp, Homo sapiens
tgaggaaaacaaagcacagctgg

SEQ ID NO: 922 - DNA, 23 bp, Homo sapiens
atatgggggtgatagctgagcgg

SEQ ID NO: 923 - DNA, 23 bp, Homo sapiens
gatacagaaaaacacggagttgg

SEQ ID NO: 924 - DNA, 23 bp, Homo sapiens
ccaggcgtcactgctgcagctgg

SEQ ID NO: 925 - DNA, 23 bp, Homo sapiens
ccatgccctcaggcctcatgcgg

SEQ ID NO: 926 - DNA, 23 bp, Homo sapiens
gtagagctaatgccagccgctgg

SEQ ID NO: 927 - DNA, 23 bp, Homo sapiens
gccaggagcacagacgtgtaggg

SEQ ID NO: 928 - DNA, 23 bp, Homo sapiens
ggagaaggcttgtaatgatgtgg

SEQ ID NO: 929 - DNA, 23 bp, Homo sapiens
gggagaagatgatgactaagtgg

SEQ ID NO: 930 - DNA, 23 bp, Homo sapiens
aagagagaaacagatgatgaagg

SEQ ID NO: 931 - DNA, 23 bp, Homo sapiens
gagcttggtgaagaagaaagggg

SEQ ID NO: 932 - DNA, 23 bp, Homo sapiens
cttagaccttttcacttgcgagg

SEQ ID NO: 933 - DNA, 23 bp, Homo sapiens
agatgctgaagacgatggagagg

SEQ ID NO: 934 - DNA, 23 bp, Homo sapiens
ggagagggagaagaggaagtggg

SEQ ID NO: 935 - DNA, 23 bp, Homo sapiens
tgctgttttctgtgaaccactgg

SEQ ID NO: 936 - DNA, 23 bp, Homo sapiens
aactttgggctctagacagaagg

SEQ ID NO: 937 - DNA, 23 bp, Homo sapiens
accccctgccgaggagagtgagg

SEQ ID NO: 938 - DNA, 23 bp, Homo sapiens
ccccacaacagctgcttgcatgg

SEQ ID NO: 939 - DNA, 23 bp, Homo sapiens
aggagatgaggtttgtatatggg

SEQ ID NO: 940 - DNA, 23 bp, Homo sapiens
cgagttccatctcagtaaaaggg

SEQ ID NO: 941 - DNA, 23 bp, Homo sapiens
ccctcagagcccaacttctaagg

SEQ ID NO: 942 - DNA, 23 bp, Homo sapiens
atcctggtggctctttgtggagg

SEQ ID NO: 943 - DNA, 23 bp, Homo sapiens
catctgtgctggtgatgctgagg

SEQ ID NO: 944 - DNA, 23 bp, Homo sapiens
attctgctgaagatctgtggtgg

SEQ ID NO: 945 - DNA, 23 bp, Homo sapiens
ctggcttggctcagtgcaagagg

SEQ ID NO: 946 - DNA, 23 bp, Homo sapiens
gcgctgctgtacctgtgtggtgg

SEQ ID NO: 947 - DNA, 23 bp, Homo sapiens
gcgtgctgttcacggatctgtgg

SEQ ID NO: 948 - DNA, 23 bp, Homo sapiens
acactcttaaaaatctgtggtgg

SEQ ID NO: 949 - DNA, 23 bp, Homo sapiens
gtactgcttgttctctgtggagg

SEQ ID NO: 950 - DNA, 23 bp, Homo sapiens
aaagctcttctgctgctctgtgg

SEQ ID NO: 951 - DNA, 23 bp, Homo sapiens
ctctgtggtggtgaggactaggg

SEQ ID NO: 952 - DNA, 23 bp, Homo sapiens
gctattgtgggccagtaggaggg

SEQ ID NO: 953 - DNA, 23 bp, Homo sapiens
cttgttcttctgtgcctcagggg

SEQ ID NO: 954 - DNA, 23 bp, Homo sapiens
agccctcctggccttgtgcaggg

SEQ ID NO: 955 - DNA, 23 bp, Homo sapiens
aaaggttatttcaggaacagcgg

SEQ ID NO: 956 - DNA, 23 bp, Homo sapiens
gagaggctcagtgcccgccttgg

SEQ ID NO: 957 - DNA, 23 bp, Homo sapiens
gaactgggggctggtcacacagg

SEQ ID NO: 958 - DNA, 23 bp, Homo sapiens
accctcaggactagaagccgtgg

SEQ ID NO: 959 - DNA, 23 bp, Homo sapiens
gggcttctctcacaactaggcgg

SEQ ID NO: 960 - DNA, 23 bp, Homo sapiens
cagaaaaccagctgtcacccagg

SEQ ID NO: 961 - DNA, 23 bp, Homo sapiens
attcagatgggtacattccaagg

SEQ ID NO: 962 - DNA, 23 bp, Homo sapiens
acagatcaacagactcgataggg

SEQ ID NO: 963 - DNA, 23 bp, Homo sapiens
ggccggggtctcagttcttgagg

SEQ ID NO: 964 - DNA, 23 bp, Homo sapiens
cccctcagtcctggcaatgaggg

SEQ ID NO: 965 - DNA, 23 bp, Homo sapiens
acaacttgcctgtggaatcgtgg

SEQ ID NO: 966 - DNA, 23 bp, Homo sapiens
tggctgcgacagcccctcactgg

SEQ ID NO: 967 - DNA, 23 bp, Homo sapiens
caacttcgtaccagctagaaggg

SEQ ID NO: 968 - DNA, 23 bp, Homo sapiens
tgtgctggaggagatgggtttgg

SEQ ID NO: 969 - DNA, 23 bp, Homo sapiens
atttcttcaagaacactacgtgg

SEQ ID NO: 970 - DNA, 23 bp, Homo sapiens
tgaagactctgatatgttacagg

SEQ ID NO: 971 - DNA, 23 bp, Homo sapiens
ccgtcacctgtgtgagctgctgg

SEQ ID NO: 972 - DNA, 23 bp, Homo sapiens
gctcacgctgcgcacaagtaagg

SEQ ID NO: 973 - DNA, 23 bp, Homo sapiens
agtctctcaatacatctatcagg

SEQ ID NO: 974 - DNA, 23 bp, Homo sapiens
gagtttcataaatgccactgcgg

SEQ ID NO: 975 - DNA, 23 bp, Homo sapiens
tgctacagtccctggagtgaggg

SEQ ID NO: 976 - DNA, 23 bp, Homo sapiens
tgaagcctgtcctgtctcagggg

SEQ ID NO: 977 - DNA, 23 bp, Homo sapiens
gctagagactctccactctccgg

SEQ ID NO: 978 - DNA, 23 bp, Homo sapiens
tcacagcatttggaagtcactgg

SEQ ID NO: 979 - DNA, 23 bp, Homo sapiens
cgcaggcagctctcaacacttgg

SEQ ID NO: 980 - DNA, 23 bp, Homo sapiens
cctcttctcatgtcctcacttgg

SEQ ID NO: 981 - DNA, 23 bp, Homo sapiens
gttccaagttcgaacctgaaggg

SEQ ID NO: 982 - DNA, 23 bp, Homo sapiens
tatttaaaagagggcaggtttgg

SEQ ID NO: 983 - DNA, 23 bp, Homo sapiens
ttcagtctcccagacaggacagg

SEQ ID NO: 984 - DNA, 23 bp, Homo sapiens
aacctgtcccagtttgtctgagg

SEQ ID NO: 985 - DNA, 23 bp, Homo sapiens
atctgcatttctgagtttccagg

SEQ ID NO: 986 - DNA, 23 bp, Homo sapiens
cagtgtcaaaaggtgatggaggg

SEQ ID NO: 987 - DNA, 23 bp, Homo sapiens
gcctatgtcattcggatctgagg

SEQ ID NO: 988 - DNA, 23 bp, Homo sapiens
cactacaccctggatctcctggg

SEQ ID NO: 989 - DNA, 23 bp, Homo sapiens
taagatgtcagaaagctgaaagg

SEQ ID NO: 990 - DNA, 23 bp, Homo sapiens
tcccctggctattcagtagatgg

SEQ ID NO: 991 - DNA, 23 bp, Homo sapiens
ggactacctccgtgggctggcgg

SEQ ID NO: 992 - DNA, 23 bp, Homo sapiens
gcccctgctccagtaacatatgg

SEQ ID NO: 993 - DNA, 23 bp, Homo sapiens
ccatcccaacgaggaatcagcgg

SEQ ID NO: 994 - DNA, 23 bp, Homo sapiens
cggcctcatgccagggtgaaggg

SEQ ID NO: 995 - DNA, 23 bp, Homo sapiens
tatgtgactgtggataatcttgg

SEQ ID NO: 996 - DNA, 23 bp, Homo sapiens
tcacagaccttctacacaaatgg

SEQ ID NO: 997 - DNA, 23 bp, Homo sapiens
ggccgcggtcagatgtaaacagg

SEQ ID NO: 998 - DNA, 23 bp, Homo sapiens
cagggctggtttaaacaatttgg

SEQ ID NO: 999 - DNA, 23 bp, Homo sapiens
ggagaccccgctgtacatctagg

SEQ ID NO: 1000 - DNA, 23 bp, Homo sapiens
gcaagggatgaggtggtcacagg

SEQ ID NO: 1001 - DNA, 23 bp, Homo sapiens
gaaggtgggggcttcttcatggg

SEQ ID NO: 1002 - DNA, 23 bp, Homo sapiens
aagagaggcaacgtgtcctaggg

SEQ ID NO: 1003 - DNA, 23 bp, Homo sapiens
catgtgcagctatggcatttcgg

SEQ ID NO: 1004 - DNA, 23 bp, Homo sapiens
ccagataagtttagggcatatgg

SEQ ID NO: 1005 - DNA, 23 bp, Homo sapiens
tcacaaggtaagacccagaatgg

SEQ ID NO: 1006 - DNA, 23 bp, Homo sapiens
ccgccaccctcctggaatagtgg

SEQ ID NO: 1007 - DNA, 23 bp, Homo sapiens
gccttgtccctctgctgcattgg

SEQ ID NO: 1008 - DNA, 23 bp, Homo sapiens
aagtccaatgtcatagccagtgg

SEQ ID NO: 1009 - DNA, 23 bp, Homo sapiens
aaacccttggtgtgggtctgagg

SEQ ID NO: 1010 - DNA, 23 bp, Homo sapiens
ctctggctacgcacacacttggg

SEQ ID NO: 1011 - DNA, 23 bp, Homo sapiens
ctgggccacaagttcatatctgg

SEQ ID NO: 1012 - DNA, 23 bp, Homo sapiens
aggggtggtgtcacagtgctagg

SEQ ID NO: 1013 - DNA, 23 bp, Homo sapiens
caggcctccattggttcagctgg

SEQ ID NO: 1014 - DNA, 23 bp, Homo sapiens
gcatcccacccgaggactgaggg

SEQ ID NO: 1015 - DNA, 23 bp, Homo sapiens
tcagcgcagcctcttgtgtaagg

SEQ ID NO: 1016 - DNA, 23 bp, Homo sapiens
gctggttccctgaggttatctgg

SEQ ID NO: 1017 - DNA, 23 bp, Homo sapiens
acacgaggaaatcgtagtcgggg

SEQ ID NO: 1018 - DNA, 23 bp, Homo sapiens
ggagccttcaggggaagtagagg

SEQ ID NO: 1019 - DNA, 23 bp, Homo sapiens
cagctcccagttggagaaaatgg

SEQ ID NO: 1020 - DNA, 23 bp, Homo sapiens
agatgaagagaaggaagatgtgg

SEQ ID NO: 1021 - DNA, 23 bp, Homo sapiens
taggtctccaaagtcagtccagg

SEQ ID NO: 1022 - DNA, 23 bp, Homo sapiens
gagacccttgtggttgactaggg

SEQ ID NO: 1023 - DNA, 23 bp, Homo sapiens
ctggaggaacgaccctgacccgg

SEQ ID NO: 1024 - DNA, 23 bp, Homo sapiens
ggagcagatgcagatttaggtgg

SEQ ID NO: 1025 - DNA, 23 bp, Homo sapiens
tctgggagggctaaacagcctgg

SEQ ID NO: 1026 - DNA, 23 bp, Homo sapiens
ggcggcggcgggcgcctcactgg

SEQ ID NO: 1027 - DNA, 23 bp, Homo sapiens
caatggtctggacacttcactgg

SEQ ID NO: 1028 - DNA, 23 bp, Homo sapiens
ggggcagctcagctctccaaagg

SEQ ID NO: 1029 - DNA, 23 bp, Homo sapiens
ctgggcaggtagatcctcagggg

SEQ ID NO: 1030 - DNA, 23 bp, Homo sapiens
aggatgatagtaagttctcctgg

SEQ ID NO: 1031 - DNA, 23 bp, Homo sapiens
tctgtggcttggagatgaatagg

SEQ ID NO: 1032 - DNA, 23 bp, Homo sapiens
ttggcagacatcctgaagtaggg

SEQ ID NO: 1033 - DNA, 23 bp, Homo sapiens
tccagaatcagggaaactgaagg

SEQ ID NO: 1034 - DNA, 23 bp, Homo sapiens
ggcccagggagacccctcactgg

SEQ ID NO: 1035 - DNA, 23 bp, Homo sapiens
ggaacaaggcagaccctagaggg

SEQ ID NO: 1036 - DNA, 23 bp, Homo sapiens
gcaggagattctcgagtgagggg

SEQ ID NO: 1037 - DNA, 23 bp, Homo sapiens
taaaactggacgtagtaagtggg

SEQ ID NO: 1038 - DNA, 23 bp, Homo sapiens
tccagaatcaggaaaactgaagg

SEQ ID NO: 1039 - DNA, 23 bp, Homo sapiens
tgggggagattctcaggtgaggg

SEQ ID NO: 1040 - DNA, 23 bp, Homo sapiens
acgtgcgcagggtcgttacatgg

SEQ ID NO: 1041 - DNA, 23 bp, Homo sapiens
ccataaagcgacggcttgagagg

SEQ ID NO: 1042 - DNA, 23 bp, Homo sapiens
acagtttgcaagtagcaaggagg

SEQ ID NO: 1043 - DNA, 23 bp, Homo sapiens
gagcaccgggtctcagtcactgg

SEQ ID NO: 1044 - DNA, 23 bp, Homo sapiens
aaactcaagattgactcatgagg

SEQ ID NO: 1045 - DNA, 23 bp, Homo sapiens
tctttctgtgctgaagggagagg

SEQ ID NO: 1046 - DNA, 23 bp, Homo sapiens
attgaggtctcaggcagccacgg

SEQ ID NO: 1047 - DNA, 23 bp, Homo sapiens
gtctgtggggacaaggaccaggg

SEQ ID NO: 1048 - DNA, 23 bp, Homo sapiens
tgccccaagctctcgtaaccagg

SEQ ID NO: 1049 - DNA, 23 bp, Homo sapiens
cggcgttcagtgattgtcgctgg

SEQ ID NO: 1050 - DNA, 23 bp, Homo sapiens
atgacttagatcctggggctggg

SEQ ID NO: 1051 - DNA, 23 bp, Homo sapiens
gatgtaaagccatgctaaggtgg

SEQ ID NO: 1052 - DNA, 23 bp, Homo sapiens
tgccctgtggtcacagttcttgg

SEQ ID NO: 1053 - DNA, 23 bp, Homo sapiens
ctgcactgctctggggtcattgg

SEQ ID NO: 1054 - DNA, 23 bp, Homo sapiens
ctgcactggtctggggtcagtgg

SEQ ID NO: 1055 - DNA, 23 bp, Homo sapiens
tcagagtctaaaagcaggctagg

SEQ ID NO: 1056 - DNA, 23 bp, Homo sapiens
tctcattgtcggtgtcttcccgg

SEQ ID NO: 1057 - DNA, 23 bp, Homo sapiens
agcatgtgtggatgtggctgtgg

SEQ ID NO: 1058 - DNA, 23 bp, Homo sapiens
tctctgctgaccagcgtgcaggg

SEQ ID NO: 1059 - DNA, 23 bp, Homo sapiens
tgaagttacaggtcagttattgg

SEQ ID NO: 1060 - DNA, 23 bp, Homo sapiens
ggagttttctacttagttccagg

SEQ ID NO: 1061 - DNA, 23 bp, Homo sapiens
acatatctatatcttctgggtgg

SEQ ID NO: 1062 - DNA, 23 bp, Homo sapiens
acaaaagaagaggagcaactagg

SEQ ID NO: 1063 - DNA, 23 bp, Homo sapiens
aagtggccctggaaaggatttgg

SEQ ID NO: 1064 - DNA, 23 bp, Homo sapiens
agaaatggcggacttctacaagg

SEQ ID NO: 1065 - DNA, 23 bp, Homo sapiens
ctgggcctgagaactgaatcagg

SEQ ID NO: 1066 - DNA, 23 bp, Homo sapiens
catctgctcaaagaacttgtagg

SEQ ID NO: 1067 - DNA, 23 bp, Homo sapiens
tcgagggaccgagctgctgaggg

SEQ ID NO: 1068 - DNA, 23 bp, Homo sapiens
gagagtgatttgggagaaggagg

SEQ ID NO: 1069 - DNA, 23 bp, Homo sapiens
ggcgcaagtgagttatgcttcgg

SEQ ID NO: 1070 - DNA, 23 bp, Homo sapiens
cctgtggtcactcatactgcagg

SEQ ID NO: 1071 - DNA, 23 bp, Homo sapiens
gtggatgatctgctggccactgg

SEQ ID NO: 1072 - DNA, 23 bp, Homo sapiens
aagaacatctcaggaagcactgg

SEQ ID NO: 1073 - DNA, 23 bp, Homo sapiens
ggcaaggagaatcaaaatcctgg

SEQ ID NO: 1074 - DNA, 23 bp, Homo sapiens
agcaattacggtagaatcccagg

SEQ ID NO: 1075 - DNA, 23 bp, Homo sapiens
gagatgaagcccaaatagaaggg

SEQ ID NO: 1076 - DNA, 23 bp, Homo sapiens
ctggagtgtaagctatgattagg

SEQ ID NO: 1077 - DNA, 23 bp, Homo sapiens
gtatggttgttatgcagccatgg

SEQ ID NO: 1078 - DNA, 23 bp, Homo sapiens
ggggccacattccagctgagtgg

SEQ ID NO: 1079 - DNA, 23 bp, Homo sapiens
cacggggtaccaaggcctgaggg

SEQ ID NO: 1080 - DNA, 23 bp, Homo sapiens
agtggcccttggacagtcagtgg

SEQ ID NO: 1081 - DNA, 23 bp, Homo sapiens
cacaaggagcagatctgagtggg

SEQ ID NO: 1082 - DNA, 23 bp, Homo sapiens
ggggaaagaccaatctggagagg

SEQ ID NO: 1083 - DNA, 23 bp, Homo sapiens
ccctgcctgacactggtcagcgg

SEQ ID NO: 1084 - DNA, 23 bp, Homo sapiens
gggttcgggagccgtggagatgg

SEQ ID NO: 1085 - DNA, 23 bp, Homo sapiens
cctgaaattggaggattctgtgg

SEQ ID NO: 1086 - DNA, 23 bp, Homo sapiens
ggacccacagaaaaactcaaagg

SEQ ID NO: 1087 - DNA, 23 bp, Homo sapiens
tctctgcttagaagtgctctagg

SEQ ID NO: 1088 - DNA, 23 bp, Homo sapiens
cccgcctcatcctgaaggctcgg

SEQ ID NO: 1089 - DNA, 23 bp, Homo sapiens
aactcagtgtcatcatgtagtgg

SEQ ID NO: 1090 - DNA, 23 bp, Homo sapiens
ttggttggtgctgtcattggagg

SEQ ID NO: 1091 - DNA, 23 bp, Homo sapiens
aggactacagtttggctacttgg

SEQ ID NO: 1092 - DNA, 23 bp, Homo sapiens
aatagtgcaatcatttctgctgg

SEQ ID NO: 1093 - DNA, 23 bp, Homo sapiens
gggtggaaagtaatagtcaatgg

SEQ ID NO: 1094 - DNA, 23 bp, Homo sapiens
gggtgtttggagtctcagaatgg

SEQ ID NO: 1095 - DNA, 23 bp, Homo sapiens
gtcagcctttcttcagggtctgg

SEQ ID NO: 1096 - DNA, 23 bp, Homo sapiens
tagggtttccaatgcttcactgg

SEQ ID NO: 1097 - DNA, 23 bp, Homo sapiens
cgcagcccgccttgtgccttagg

SEQ ID NO: 1098 - DNA, 23 bp, Homo sapiens
tcagctaaggcatccctacctgg

SEQ ID NO: 1099 - DNA, 23 bp, Homo sapiens
gagtgtggctgccttcaccgcgg

SEQ ID NO: 1100 - DNA, 23 bp, Homo sapiens
ggatgagcagattttgaagtagg

SEQ ID NO: 1101 - DNA, 23 bp, Homo sapiens
gctggtcctagggtcatgtgagg

SEQ ID NO: 1102 - DNA, 23 bp, Homo sapiens
ccggacccagcccgagtagaggg

SEQ ID NO: 1103 - DNA, 23 bp, Homo sapiens
cacagagaccactttcctagtgg

SEQ ID NO: 1104 - DNA, 23 bp, Homo sapiens
aagaaacttcgacaagagaatgg

SEQ ID NO: 1105 - DNA, 23 bp, Homo sapiens
agcgagggttgcgagggctttgg

SEQ ID NO: 1106 - DNA, 23 bp, Homo sapiens
aggggggtcgcgttcacttctgg

SEQ ID NO: 1107 - DNA, 23 bp, Homo sapiens
gtacgaaggcctggactggctgg

SEQ ID NO: 1108 - DNA, 23 bp, Homo sapiens
gtctgtatgaaggacttgactgg

SEQ ID NO: 1109 - DNA, 23 bp, Homo sapiens
gttagcgctttgacagctcgtgg

SEQ ID NO: 1110 - DNA, 23 bp, Homo sapiens
gactctatgaggggctcacatgg

SEQ ID NO: 1111 - DNA, 23 bp, Homo sapiens
tctggtctatgttgctgttttgg

SEQ ID NO: 1112 - DNA, 23 bp, Homo sapiens
tgggacaaccagaactggtaggg

SEQ ID NO: 1113 - DNA, 23 bp, Homo sapiens
gtcacagagctcggatcagtagg

SEQ ID NO: 1114 - DNA, 23 bp, Homo sapiens
tggagtcgtgacttcaattcagg

SEQ ID NO: 1115 - DNA, 23 bp, Homo sapiens
caaccacctgaacaggaacttgg

SEQ ID NO: 1116 - DNA, 23 bp, Homo sapiens
ggcagccagggctaccacactgg

SEQ ID NO: 1117 - DNA, 23 bp, Homo sapiens
acacaatgatgtcatagacacgg

SEQ ID NO: 1118 - DNA, 23 bp, Homo sapiens
tactgttcttcaagccaagatgg

SEQ ID NO: 1119 - DNA, 23 bp, Homo sapiens
tgagaaaccctcctggctagagg

SEQ ID NO: 1120 - DNA, 23 bp, Homo sapiens
gcggcagagggacatcacgtagg

SEQ ID NO: 1121 - DNA, 23 bp, Homo sapiens
cagaccacttccggggtcacggg

SEQ ID NO: 1122 - DNA, 23 bp, Homo sapiens
tcggccctcacagggtgagtggg

SEQ ID NO: 1123 - DNA, 23 bp, Homo sapiens
tgtttccacatttacttaggtgg

SEQ ID NO: 1124 - DNA, 23 bp, Homo sapiens
tcaagcacgtgtgagaatttagg

SEQ ID NO: 1125 - DNA, 23 bp, Homo sapiens
acctccaatatggtagacttggg

SEQ ID NO: 1126 - DNA, 23 bp, Homo sapiens
gtccttctcattaaaaacccagg

SEQ ID NO: 1127 - DNA, 23 bp, Homo sapiens
gggccaggttcagagcccgctgg

SEQ ID NO: 1128 - DNA, 23 bp, Homo sapiens
agcagcttgacgtagttctgtgg

SEQ ID NO: 1129 - DNA, 23 bp, Homo sapiens
agagtggaatcaggaaaagcagg

SEQ ID NO: 1130 - DNA, 23 bp, Homo sapiens
ggttctccaaaacatcctatcgg

SEQ ID NO: 1131 - DNA, 23 bp, Homo sapiens
agaaagagaagacaacgtgtagg

SEQ ID NO: 1132 - DNA, 23 bp, Homo sapiens
taagaatcaacgtccgaagatgg

SEQ ID NO: 1133 - DNA, 23 bp, Homo sapiens
cagtaagatcttcggctcagagg

SEQ ID NO: 1134 - DNA, 23 bp, Homo sapiens
tgggaaagggctttcttcacagg

SEQ ID NO: 1135 - DNA, 23 bp, Homo sapiens
gcttaacccaaatgctgagtggg

SEQ ID NO: 1136 - DNA, 23 bp, Homo sapiens
gggaagaaagaggggaaaaaagg

SEQ ID NO: 1137 - DNA, 23 bp, Homo sapiens
tggtctgcgacattgaggacagg

SEQ ID NO: 1138 - DNA, 23 bp, Homo sapiens
tttcatccctgtctttaaactgg

SEQ ID NO: 1139 - DNA, 23 bp, Homo sapiens
ggatcagcttttctactacaagg

SEQ ID NO: 1140 - DNA, 23 bp, Homo sapiens
tgccagggccccaaagtaaaagg

SEQ ID NO: 1141 - DNA, 23 bp, Homo sapiens
gggatcacagacactgatgcagg

SEQ ID NO: 1142 - DNA, 23 bp, Homo sapiens
ccgagagaggaaacacaatatgg

SEQ ID NO: 1143 - DNA, 23 bp, Homo sapiens
aacccaagaccgaggcttaaggg

SEQ ID NO: 1144 - DNA, 23 bp, Homo sapiens
ctgctggggcccacggttagagg

SEQ ID NO: 1145 - DNA, 23 bp, Homo sapiens
ccacctctgtccgaagacttcgg

SEQ ID NO: 1146 - DNA, 23 bp, Homo sapiens
tcacaggccagcagtcagtgcgg

SEQ ID NO: 1147 - DNA, 23 bp, Homo sapiens
ttaatcacccattctgcttgagg

SEQ ID NO: 1148 - DNA, 23 bp, Homo sapiens
tgacatccctacacaaattgtgg

SEQ ID NO: 1149 - DNA, 23 bp, Homo sapiens
aaaggtgaaggactgtgattagg

SEQ ID NO: 1150 - DNA, 23 bp, Homo sapiens
ttctggatggaagaagtgggagg

SEQ ID NO: 1151 - DNA, 23 bp, Homo sapiens
ctcgcagggctcattctgcatgg

SEQ ID NO: 1152 - DNA, 23 bp, Homo sapiens
ctggtgctcagcagtagcttcgg

SEQ ID NO: 1153 - DNA, 23 bp, Homo sapiens
ggtggctcacagcgtgtgttcgg

SEQ ID NO: 1154 - DNA, 23 bp, Homo sapiens
gaagtagctgacgccagttttgg

SEQ ID NO: 1155 - DNA, 23 bp, Homo sapiens
atggagggtgtgctgtagcgggg

SEQ ID NO: 1156 - DNA, 23 bp, Homo sapiens
ccagcagcggcacctcagtgtgg

SEQ ID NO: 1157 - DNA, 23 bp, Homo sapiens
tgagactcgcagggtttaggtgg

SEQ ID NO: 1158 - DNA, 23 bp, Homo sapiens
gcaacttatgaaggcaaaacagg

SEQ ID NO: 1159 - DNA, 23 bp, Homo sapiens
ctgtagacatgctttccccaggg

SEQ ID NO: 1160 - DNA, 23 bp, Homo sapiens
gatgggcggtgtcatgtcagagg

SEQ ID NO: 1161 - DNA, 23 bp, Homo sapiens
cagccggaattcgtgtgagctgg

SEQ ID NO: 1162 - DNA, 23 bp, Homo sapiens
caattacaaacggatcctcttgg

SEQ ID NO: 1163 - DNA, 23 bp, Homo sapiens
ataagggagagacgaagagaagg

SEQ ID NO: 1164 - DNA, 23 bp, Homo sapiens
cgatgccctgcccgagacgctgg

SEQ ID NO: 1165 - DNA, 23 bp, Homo sapiens
caaaatgaacagctctaacctgg

SEQ ID NO: 1166 - DNA, 23 bp, Homo sapiens
gcaacactagagacgtcttctgg

SEQ ID NO: 1167 - DNA, 23 bp, Homo sapiens
ccccatttccgtgctgcccttgg

SEQ ID NO: 1168 - DNA, 23 bp, Homo sapiens
ttcttccttccctgcatcagggg

SEQ ID NO: 1169 - DNA, 23 bp, Homo sapiens
caccatcaagaaggactggaagg

SEQ ID NO: 1170 - DNA, 23 bp, Homo sapiens
gttaaggcatcatggttagacgg

SEQ ID NO: 1171 - DNA, 23 bp, Homo sapiens
ctccacatgttaaggcatcatgg

SEQ ID NO: 1172 - DNA, 23 bp, Homo sapiens
acctgtcgattaagaaggagtgg

SEQ ID NO: 1173 - DNA, 23 bp, Homo sapiens
ctgcatctgccaggactggaagg

SEQ ID NO: 1174 - DNA, 23 bp, Homo sapiens
ccccagcctggctgcacttgagg

SEQ ID NO: 1175 - DNA, 23 bp, Homo sapiens
cctctgctgaatatataagcagg

SEQ ID NO: 1176 - DNA, 23 bp, Homo sapiens
ggggaggcgctatagcatcaagg

SEQ ID NO: 1177 - DNA, 23 bp, Homo sapiens
ggtttgtacggttatggtcctgg

SEQ ID NO: 1178 - DNA, 23 bp, Homo sapiens
attctttgccaaaggctggctgg

SEQ ID NO: 1179 - DNA, 23 bp, Homo sapiens
ctcctcagcctgcattagggtgg

SEQ ID NO: 1180 - DNA, 23 bp, Homo sapiens
ggagcgtctgcgggtggagacgg

SEQ ID NO: 1181 - DNA, 23 bp, Homo sapiens
gacagggtcacaccctccacagg

SEQ ID NO: 1182 - DNA, 23 bp, Homo sapiens
agacgtcatcttcttctaaaagg

SEQ ID NO: 1183 - DNA, 23 bp, Homo sapiens
gggggaggctcctgtgtgatggg

SEQ ID NO: 1184 - DNA, 23 bp, Homo sapiens
gtagcctccgagagctaaggggg

SEQ ID NO: 1185 - DNA, 23 bp, Homo sapiens
ggatgaagatgagctgtaactgg

SEQ ID NO: 1186 - DNA, 23 bp, Homo sapiens
ctgccctgggacacagcagcggg

SEQ ID NO: 1187 - DNA, 23 bp, Homo sapiens
ccatctgagagactacacgttgg

SEQ ID NO: 1188 - DNA, 23 bp, Homo sapiens
caagatggggaaactggagatgg

SEQ ID NO: 1189 - DNA, 23 bp, Homo sapiens
tcctgtggaaacagcaggcacgg

SEQ ID NO: 1190 - DNA, 23 bp, Homo sapiens
tgttttacacagctgttccttgg

SEQ ID NO: 1191 - DNA, 23 bp, Homo sapiens
gactgaggagtcacctgacaagg

SEQ ID NO: 1192 - DNA, 23 bp, Homo sapiens
tccaaagagggtaccctaagagg

SEQ ID NO: 1193 - DNA, 23 bp, Homo sapiens
aagcataagtcatctttccaagg

SEQ ID NO: 1194 - DNA, 23 bp, Homo sapiens
tgtatccagtccttaaagtaagg

SEQ ID NO: 1195 - DNA, 23 bp, Homo sapiens
ctggtaccacagtctgacttggg

SEQ ID NO: 1196 - DNA, 23 bp, Homo sapiens
cctcaggcctggtggctagctgg

SEQ ID NO: 1197 - DNA, 23 bp, Homo sapiens
gcacccttccgcaagtgaactgg

SEQ ID NO: 1198 - DNA, 23 bp, Homo sapiens
cccaccacgcctctgtgacctgg

SEQ ID NO: 1199 - DNA, 23 bp, Homo sapiens
gactgccaaactacagctggtgg

SEQ ID NO: 1200 - DNA, 23 bp, Homo sapiens
tgatggttatggaagaattgagg

SEQ ID NO: 1201 - DNA, 23 bp, Homo sapiens
gctcagaagtgcattagttctgg

SEQ ID NO: 1202 - DNA, 23 bp, Homo sapiens
gggatgagaccaatctataaggg

SEQ ID NO: 1203 - DNA, 23 bp, Homo sapiens
cattctggcaaaacttcagcagg

SEQ ID NO: 1204 - DNA, 23 bp, Homo sapiens
tgtcccacggctgtcatgactgg

SEQ ID NO: 1205 - DNA, 23 bp, Homo sapiens
tgtgatgtactgtttcagattgg

SEQ ID NO: 1206 - DNA, 23 bp, Homo sapiens
aatattcagaatgtggtcgcagg

SEQ ID NO: 1207 - DNA, 23 bp, Homo sapiens
gttcataaaggcatttggcaagg

SEQ ID NO: 1208 - DNA, 23 bp, Homo sapiens
ttaaggcaacgagttatttgagg

SEQ ID NO: 1209 - DNA, 23 bp, Homo sapiens
agctgggtcctgcccatcagagg

SEQ ID NO: 1210 - DNA, 23 bp, Homo sapiens
cagggcaagatgctggaaggggg

SEQ ID NO: 1211 - DNA, 23 bp, Homo sapiens
atgtacttgctgtagaatgcagg

SEQ ID NO: 1212 - DNA, 23 bp, Homo sapiens
atggaatgtcagttgagtgcagg

SEQ ID NO: 1213 - DNA, 23 bp, Homo sapiens
ccacctcaacaccaagctgtagg

SEQ ID NO: 1214 - DNA, 23 bp, Homo sapiens
gcaccccagtacaaaactgtagg

SEQ ID NO: 1215 - DNA, 23 bp, Homo sapiens
agatctgtgggagtacattgagg

SEQ ID NO: 1216 - DNA, 23 bp, Homo sapiens
ggagaaccagatgcatatagcgg

SEQ ID NO: 1217 - DNA, 23 bp, Homo sapiens
agctcatccttagatttaactgg

SEQ ID NO: 1218 - DNA, 23 bp, Homo sapiens
gatttccatgacacctaagttgg

SEQ ID NO: 1219 - DNA, 23 bp, Homo sapiens
ggaccggttgtcaaatgatgtgg

SEQ ID NO: 1220 - DNA, 23 bp, Homo sapiens
gccttgatgaggcaatggaatgg

SEQ ID NO: 1221 - DNA, 23 bp, Homo sapiens
caaaaacaaaacaccatgcctgg

SEQ ID NO: 1222 - DNA, 23 bp, Homo sapiens
ttggagctcctctcctaggctgg

SEQ ID NO: 1223 - DNA, 23 bp, Homo sapiens
agagcccatggggctgagcgcgg

SEQ ID NO: 1224 - DNA, 23 bp, Homo sapiens
tcaatcctatactcactgagagg

SEQ ID NO: 1225 - DNA, 23 bp, Homo sapiens
acatcatgagcatcactgttagg

SEQ ID NO: 1226 - DNA, 23 bp, Homo sapiens
gcgttcttcaagcagaactgagg

SEQ ID NO: 1227 - DNA, 23 bp, Homo sapiens
tttgctcatacagccacttgcgg

SEQ ID NO: 1228 - DNA, 23 bp, Homo sapiens
atatacaagagcacctagtcagg

SEQ ID NO: 1229 - DNA, 23 bp, Homo sapiens
ttcacattcttacagcttcatgg

SEQ ID NO: 1230 - DNA, 23 bp, Homo sapiens
tctgccgtgcagtcaatcgttgg

SEQ ID NO: 1231 - DNA, 23 bp, Homo sapiens
catcctctggaaatcagctgtgg

SEQ ID NO: 1232 - DNA, 23 bp, Homo sapiens
agcagtggcatcaacttgtcagg

SEQ ID NO: 1233 - DNA, 23 bp, Homo sapiens
ggcatcatctgtccaagagatgg

SEQ ID NO: 1234 - DNA, 23 bp, Homo sapiens
tcacgtaaatgctttttcagggg

SEQ ID NO: 1235 - DNA, 23 bp, Homo sapiens
tggaaaaaatgctgccacagagg

SEQ ID NO: 1236 - DNA, 23 bp, Homo sapiens
ttttcaaatgctgcacacagagg

SEQ ID NO: 1237 - DNA, 23 bp, Homo sapiens
ttcagtcagctgtgaaaatgcgg

SEQ ID NO: 1238 - DNA, 23 bp, Homo sapiens
ccagaacaatctgcggcactagg

SEQ ID NO: 1239 - DNA, 23 bp, Homo sapiens
tctcacaggagagggcgttcagg

SEQ ID NO: 1240 - DNA, 23 bp, Homo sapiens
ataggagatggcctaaaggaagg

SEQ ID NO: 1241 - DNA, 23 bp, Homo sapiens
ccctcaagcagaagaagaagcgg

SEQ ID NO: 1242 - DNA, 23 bp, Homo sapiens
ctcggggtggcaagaagagacgg

SEQ ID NO: 1243 - DNA, 23 bp, Homo sapiens
gattgtgccaaggacttgaatgg

SEQ ID NO: 1244 - DNA, 23 bp, Homo sapiens
aaagttatctcacaccaatccgg

SEQ ID NO: 1245 - DNA, 23 bp, Homo sapiens
acttcagtggatggaatctcagg

SEQ ID NO: 1246 - DNA, 23 bp, Homo sapiens
agaacatcaaagataaaccctgg

SEQ ID NO: 1247 - DNA, 23 bp, Homo sapiens
cttttcatgtcttcacagtctgg

SEQ ID NO: 1248 - DNA, 23 bp, Homo sapiens
aagtttgtttatctccctcttgg

SEQ ID NO: 1249 - DNA, 23 bp, Homo sapiens
gagctgggttgcttccctgaggg

SEQ ID NO: 1250 - DNA, 23 bp, Homo sapiens
gggtacatcacaaacagagctgg

SEQ ID NO: 1251 - DNA, 23 bp, Homo sapiens
tgactatatcagcaaagtgaagg

SEQ ID NO: 1252 - DNA, 23 bp, Homo sapiens
ctccagtgtgggtttacatgagg

SEQ ID NO: 1253 - DNA, 23 bp, Homo sapiens
gcatggggggttggttctttggg

SEQ ID NO: 1254 - DNA, 23 bp, Homo sapiens
ttattcaacactcgaagtcacgg

SEQ ID NO: 1255 - DNA, 23 bp, Homo sapiens
aattagctgtttctcatccaagg

SEQ ID NO: 1256 - DNA, 23 bp, Homo sapiens
gctgcagatgtgcagtgaccagg

SEQ ID NO: 1257 - DNA, 23 bp, Homo sapiens
acccagaaggtggagctagctgg

SEQ ID NO: 1258 - DNA, 23 bp, Homo sapiens
tgatgcagaggtgaaggaaaagg

SEQ ID NO: 1259 - DNA, 23 bp, Homo sapiens
taaagtaggaacgactgggctgg

SEQ ID NO: 1260 - DNA, 23 bp, Homo sapiens
atctgcatcatgttagaaagagg

SEQ ID NO: 1261 - DNA, 23 bp, Homo sapiens
cttcagggtttatcttgaagtgg

SEQ ID NO: 1262 - DNA, 23 bp, Homo sapiens
gatgaagttgagaagtcgagagg

SEQ ID NO: 1263 - DNA, 23 bp, Homo sapiens
gctggctcttgctacagagaagg

SEQ ID NO: 1264 - DNA, 23 bp, Homo sapiens
gggacgtcaacagtctaggcagg

SEQ ID NO: 1265 - DNA, 23 bp, Homo sapiens
tcaggacagtgctgaaccaatgg

SEQ ID NO: 1266 - DNA, 23 bp, Homo sapiens
gggcctggggtcatggcgccagg

SEQ ID NO: 1267 - DNA, 23 bp, Homo sapiens
ggaggagaatgagaccctggtgg

SEQ ID NO: 1268 - DNA, 23 bp, Homo sapiens
cgggctcaggtgcatgagcgtgg

SEQ ID NO: 1269 - DNA, 23 bp, Homo sapiens
tccatggatcagcgctgccgtgg

SEQ ID NO: 1270 - DNA, 23 bp, Homo sapiens
ttcattgcaacatggtcccacgg

SEQ ID NO: 1271 - DNA, 23 bp, Homo sapiens
gcagcagtacctggcatgatggg

SEQ ID NO: 1272 - DNA, 23 bp, Homo sapiens
gtcctgacagccagcaggcaggg

SEQ ID NO: 1273 - DNA, 23 bp, Homo sapiens
agccagtctcacaggaagtaagg

SEQ ID NO: 1274 - DNA, 23 bp, Homo sapiens
cctttagccctgacttacactgg

SEQ ID NO: 1275 - DNA, 23 bp, Homo sapiens
acagactccaaattagagtttgg

SEQ ID NO: 1276 - DNA, 23 bp, Homo sapiens
tcactttcactaagaggtcatgg

SEQ ID NO: 1277 - DNA, 23 bp, Homo sapiens
acatatgttcccaaagagccagg

SEQ ID NO: 1278 - DNA, 23 bp, Homo sapiens
tcaactctctctttcacctcagg

SEQ ID NO: 1279 - DNA, 23 bp, Homo sapiens
atgactttatctctcacttcggg

SEQ ID NO: 1280 - DNA, 23 bp, Homo sapiens
tgttcgagagggccgtttatggg

SEQ ID NO: 1281 - DNA, 23 bp, Homo sapiens
ctatcatccacactgcagcaagg

SEQ ID NO: 1282 - DNA, 23 bp, Homo sapiens
gagctcctaaatcaagtcaaagg

SEQ ID NO: 1283 - DNA, 23 bp, Homo sapiens
tagttctattctgaaaagggggg

SEQ ID NO: 1284 - DNA, 23 bp, Homo sapiens
ggccgcagctactcagaaaacgg

SEQ ID NO: 1285 - DNA, 23 bp, Homo sapiens
gcaacatgtagtgtttacagcgg

SEQ ID NO: 1286 - DNA, 23 bp, Homo sapiens
tcaaaggctagagggtccactgg

SEQ ID NO: 1287 - DNA, 23 bp, Homo sapiens
tgacaatgatgacacagccatgg

SEQ ID NO: 1288 - DNA, 23 bp, Homo sapiens
tcactcagcttcacattatccgg

SEQ ID NO: 1289 - DNA, 23 bp, Homo sapiens
tcacaggtcatttgatcttgagg

SEQ ID NO: 1290 - DNA, 23 bp, Homo sapiens
cctcttattcccaagattagcgg

SEQ ID NO: 1291 - DNA, 23 bp, Homo sapiens
ttcaggacctggacagtgaaggg

SEQ ID NO: 1292 - DNA, 23 bp, Homo sapiens
aaaaaaatctgtcccggcccagg

SEQ ID NO: 1293 - DNA, 23 bp, Homo sapiens
ggaactcttcagccacaatgcgg

SEQ ID NO: 1294 - DNA, 23 bp, Homo sapiens
cgaccacaggcaaggccttgagg

SEQ ID NO: 1295 - DNA, 23 bp, Homo sapiens
gcaagaaaaactgtgtagtctgg

SEQ ID NO: 1296 - DNA, 23 bp, Homo sapiens
gccttagcagtaggaggactagg

SEQ ID NO: 1297 - DNA, 23 bp, Homo sapiens
tggggcagaggacgaggagtggg

SEQ ID NO: 1298 - DNA, 23 bp, Homo sapiens
ttcttcagcgcagttgtaaatgg

SEQ ID NO: 1299 - DNA, 23 bp, Homo sapiens
cttgttgctagcaagctggctgg

SEQ ID NO: 1300 - DNA, 23 bp, Homo sapiens
accaggaggtgaaagtcttcagg

SEQ ID NO: 1301 - DNA, 23 bp, Homo sapiens
gaccgaggctggctggctagggg

SEQ ID NO: 1302 - DNA, 23 bp, Homo sapiens
tatgagcaatgctggttggcagg

SEQ ID NO: 1303 - DNA, 23 bp, Homo sapiens
tggaggctgagggagatgagggg

SEQ ID NO: 1304 - DNA, 23 bp, Homo sapiens
cagctcaacaacagatagacggg

SEQ ID NO: 1305 - DNA, 23 bp, Homo sapiens
ctatgatgatcaactctgctagg

SEQ ID NO: 1306 - DNA, 23 bp, Homo sapiens
tcaatgaggttggtgtccacagg

SEQ ID NO: 1307 - DNA, 23 bp, Homo sapiens
ccgcagctctgctcataagacgg

SEQ ID NO: 1308 - DNA, 23 bp, Homo sapiens
gcagcacggggtcagctctcagg

SEQ ID NO: 1309 - DNA, 23 bp, Homo sapiens
gcgctgcatgacttgctgaacgg

SEQ ID NO: 1310 - DNA, 23 bp, Homo sapiens
catcctgcccctctcgttgaagg

SEQ ID NO: 1311 - DNA, 23 bp, Homo sapiens
gttcagagaatgaaggaaacagg

SEQ ID NO: 1312 - DNA, 23 bp, Homo sapiens
aaagttcgggcacttaattctgg

SEQ ID NO: 1313 - DNA, 23 bp, Homo sapiens
gcccagatccccatgcctgaggg

SEQ ID NO: 1314 - DNA, 23 bp, Homo sapiens
ggtgtggggcccttggatgtagg

SEQ ID NO: 1315 - DNA, 23 bp, Homo sapiens
tacaacagcagcgagcactcagg

SEQ ID NO: 1316 - DNA, 23 bp, Homo sapiens
ctcacagtcctggcattcagggg

SEQ ID NO: 1317 - DNA, 23 bp, Homo sapiens
ttaagaatctgcagcctcactgg

SEQ ID NO: 1318 - DNA, 23 bp, Homo sapiens
ttcactgcagacatttattgtgg

SEQ ID NO: 1319 - DNA, 23 bp, Homo sapiens
ctcttctcgttaggaccccgagg

SEQ ID NO: 1320 - DNA, 23 bp, Homo sapiens
gcatcatcagtggaattcaaagg

SEQ ID NO: 1321 - DNA, 23 bp, Homo sapiens
tctgttatgcggcttgacagcgg

SEQ ID NO: 1322 - DNA, 23 bp, Homo sapiens
ggaagatgacatccttcccatgg

SEQ ID NO: 1323 - DNA, 23 bp, Homo sapiens
taatgtcccaacggatctgatgg

SEQ ID NO: 1324 - DNA, 23 bp, Homo sapiens
tattatcgagccaaatttgctgg

SEQ ID NO: 1325 - DNA, 23 bp, Homo sapiens
tgccattcaggtgttacttgtgg

SEQ ID NO: 1326 - DNA, 23 bp, Homo sapiens
aaactgctcttggattcatatgg

SEQ ID NO: 1327 - DNA, 23 bp, Homo sapiens
tcccgtgtctcatgcatcaaagg

SEQ ID NO: 1328 - DNA, 23 bp, Homo sapiens
gctgcttccacagtttgggatgg

SEQ ID NO: 1329 - DNA, 23 bp, Homo sapiens
tttggaaaagatgatgacactgg

SEQ ID NO: 1330 - DNA, 23 bp, Homo sapiens
agttccagctctcaggggttggg

SEQ ID NO: 1331 - DNA, 23 bp, Homo sapiens
ttcttgcttctcaaggctgctgg

SEQ ID NO: 1332 - DNA, 23 bp, Homo sapiens
cctgcggctgcctgggctgaggg

SEQ ID NO: 1333 - DNA, 23 bp, Homo sapiens
cagagtatggaatgggatgttgg

SEQ ID NO: 1334 - DNA, 23 bp, Homo sapiens
caggcatgcaagctagacccagg

SEQ ID NO: 1335 - DNA, 23 bp, Homo sapiens
cgggcaaggaggtgtgctaaagg

SEQ ID NO: 1336 - DNA, 23 bp, Homo sapiens
gatgctgctggaggctgctgtgg

SEQ ID NO: 1337 - DNA, 23 bp, Homo sapiens
gccctgacccttgtataggttgg

SEQ ID NO: 1338 - DNA, 23 bp, Homo sapiens
tagttacaacttcaaaagccggg

SEQ ID NO: 1339 - DNA, 23 bp, Homo sapiens
ctgcgttttgctagtcagacagg

SEQ ID NO: 1340 - DNA, 23 bp, Homo sapiens
ataaagtgcacaaatgacaccgg

SEQ ID NO: 1341 - DNA, 23 bp, Homo sapiens
aaaagttgcacagaacttgctgg

SEQ ID NO: 1342 - DNA, 23 bp, Homo sapiens
cagcacttggagtctactcatgg

SEQ ID NO: 1343 - DNA, 23 bp, Homo sapiens
tacctgcagctggattttgaggg

SEQ ID NO: 1344 - DNA, 23 bp, Homo sapiens
ccaggaacacttaggactattgg

SEQ ID NO: 1345 - DNA, 23 bp, Homo sapiens
ggagactgcaagattacagttgg

SEQ ID NO: 1346 - DNA, 23 bp, Homo sapiens
cccacctgcaattcagttgtagg

SEQ ID NO: 1347 - DNA, 23 bp, Homo sapiens
aaggaatttttacaggaacctgg

SEQ ID NO: 1348 - DNA, 23 bp, Homo sapiens
atgtatctttgaatagctggtgg

SEQ ID NO: 1349 - DNA, 23 bp, Homo sapiens
cagcctgacatggggttcactgg

SEQ ID NO: 1350 - DNA, 23 bp, Homo sapiens
agatagttttgtagacgagcagg

SEQ ID NO: 1351 - DNA, 23 bp, Homo sapiens
tttcagtgcaaaacaccctgtgg

SEQ ID NO: 1352 - DNA, 23 bp, Homo sapiens
tacgagaacacccagtaactggg

SEQ ID NO: 1353 - DNA, 23 bp, Homo sapiens
gaactggcagctattcaagatgg

SEQ ID NO: 1354 - DNA, 23 bp, Homo sapiens
tacttgcttttagagccagaggg

SEQ ID NO: 1355 - DNA, 23 bp, Homo sapiens
tcaagcaagcttgagttacttgg

SEQ ID NO: 1356 - DNA, 23 bp, Homo sapiens
tcttcagtaacgttggcagctgg

SEQ ID NO: 1357 - DNA, 23 bp, Homo sapiens
cgtggaagatgacatctgatagg

SEQ ID NO: 1358 - DNA, 23 bp, Homo sapiens
agcagaagcggttgatcatctgg

SEQ ID NO: 1359 - DNA, 23 bp, Homo sapiens
taagtagtctttcatgaccttgg

SEQ ID NO: 1360 - DNA, 23 bp, Homo sapiens
tggaagtagtcgaccatgtttgg

SEQ ID NO: 1361 - DNA, 23 bp, Homo sapiens
ccggctattctaaaagtaacagg

SEQ ID NO: 1362 - DNA, 23 bp, Homo sapiens
agaaactgtttcagatcctctgg

SEQ ID NO: 1363 - DNA, 23 bp, Homo sapiens
atgtcaacagattagggcttagg

SEQ ID NO: 1364 - DNA, 23 bp, Homo sapiens
tctcgattctaggattttcctgg

SEQ ID NO: 1365 - DNA, 23 bp, Homo sapiens
caaattgacttctcctgaggtgg

SEQ ID NO: 1366 - DNA, 23 bp, Homo sapiens
ccctgcaccaggtctcaggatgg

SEQ ID NO: 1367 - DNA, 23 bp, Homo sapiens
agagcttctgacagattcagagg

SEQ ID NO: 1368 - DNA, 23 bp, Homo sapiens
gcaagtaaaggctggacaccagg

SEQ ID NO: 1369 - DNA, 23 bp, Homo sapiens
ggtcaagttactttaatgccagg

SEQ ID NO: 1370 - DNA, 23 bp, Homo sapiens
cttcaccaactggttctgagggg

SEQ ID NO: 1371 - DNA, 23 bp, Homo sapiens
gacttctccagctggttaggggg

SEQ ID NO: 1372 - DNA, 23 bp, Homo sapiens
ttctgaacatagggtcagcatgg

SEQ ID NO: 1373 - DNA, 23 bp, Homo sapiens
gttacgtgcctgcaacttatagg

SEQ ID NO: 1374 - DNA, 23 bp, Homo sapiens
gaggaatcctggcattgatcggg

SEQ ID NO: 1375 - DNA, 23 bp, Homo sapiens
tctcagacagcatttctgttcgg

SEQ ID NO: 1376 - DNA, 23 bp, Homo sapiens
gtggtcacatgcagtccatgtgg

SEQ ID NO: 1377 - DNA, 23 bp, Homo sapiens
ctgcagttagatgcagtccatgg

SEQ ID NO: 1378 - DNA, 23 bp, Homo sapiens
attaaaggagaggtggctcctgg

SEQ ID NO: 1379 - DNA, 23 bp, Homo sapiens
gcggaatgccaccggcgaggtgg

SEQ ID NO: 1380 - DNA, 23 bp, Homo sapiens
cactttcgaaagctgttttctgg

SEQ ID NO: 1381 - DNA, 23 bp, Homo sapiens
cccccatgggaaccctgaccagg

SEQ ID NO: 1382 - DNA, 23 bp, Homo sapiens
agcggcctgcggggctcagcagg

SEQ ID NO: 1383 - DNA, 23 bp, Homo sapiens
gtgactcgaggggtgtcagcagg

SEQ ID NO: 1384 - DNA, 23 bp, Homo sapiens
aggtctagagctgtgtgacaagg

SEQ ID NO: 1385 - DNA, 23 bp, Homo sapiens
gactttatttggggtgaagacgg

SEQ ID NO: 1386 - DNA, 23 bp, Homo sapiens
gcatgtccaggatgtcagggcgg

SEQ ID NO: 1387 - DNA, 23 bp, Homo sapiens
gaagattttgcttgctaggacgg

SEQ ID NO: 1388 - DNA, 23 bp, Homo sapiens
ataggatagaggagtgttaatgg

SEQ ID NO: 1389 - DNA, 23 bp, Homo sapiens
gtgggggcgctcagcagttgagg

SEQ ID NO: 1390 - DNA, 23 bp, Homo sapiens
actgcaggcacagcaggcctagg

SEQ ID NO: 1391 - DNA, 23 bp, Homo sapiens
tttatgatgccattttagccagg

SEQ ID NO: 1392 - DNA, 23 bp, Homo sapiens
acatgctgcctgggcttcagggg

SEQ ID NO: 1393 - DNA, 23 bp, Homo sapiens
ggggctggcagctgtgctactgg

SEQ ID NO: 1394 - DNA, 23 bp, Homo sapiens
gtcagctgtcaaagcttaggtgg

SEQ ID NO: 1395 - DNA, 23 bp, Homo sapiens
aggcatctgataaatgtggacgg

SEQ ID NO: 1396 - DNA, 23 bp, Homo sapiens
gtaccccgtgtttgtgaatgagg

SEQ ID NO: 1397 - DNA, 23 bp, Homo sapiens
aggaggcttctcagcagagatgg

SEQ ID NO: 1398 - DNA, 23 bp, Homo sapiens
acgccttcaggttagacaccagg

SEQ ID NO: 1399 - DNA, 23 bp, Homo sapiens
agctttagccgtttcttttctgg

SEQ ID NO: 1400 - DNA, 23 bp, Homo sapiens
agtccctgaatcaaggttactgg

SEQ ID NO: 1401 - DNA, 23 bp, Homo sapiens
attcatgctaaattgctggaagg

SEQ ID NO: 1402 - DNA, 23 bp, Homo sapiens
ttttcctgtggaagaacagcagg

SEQ ID NO: 1403 - DNA, 23 bp, Homo sapiens
aagggagcaccttccttcaaggg

SEQ ID NO: 1404 - DNA, 23 bp, Homo sapiens
gggaaatactctcatcgtcccgg

SEQ ID NO: 1405 - DNA, 23 bp, Homo sapiens
caaatggtgatggatacgcttgg

SEQ ID NO: 1406 - DNA, 23 bp, Homo sapiens
aaaacacaacgaaatgttgcagg

SEQ ID NO: 1407 - DNA, 23 bp, Homo sapiens
ttgcttctgcaattctgatatgg

SEQ ID NO: 1408 - DNA, 23 bp, Homo sapiens
aagaaaaggtggcttctcagtgg

SEQ ID NO: 1409 - DNA, 23 bp, Homo sapiens
tggcagctctcacctcttgctgg

SEQ ID NO: 1410 - DNA, 23 bp, Homo sapiens
atcttccagcggcttagggaagg

SEQ ID NO: 1411 - DNA, 23 bp, Homo sapiens
tcattgtacacgggtctatttgg

SEQ ID NO: 1412 - DNA, 23 bp, Homo sapiens
aaacttagaggaacatagtgagg

SEQ ID NO: 1413 - DNA, 23 bp, Homo sapiens
atccccttgaaatgatttctagg

SEQ ID NO: 1414 - DNA, 23 bp, Homo sapiens
gtgaggatgagttaggtcccagg

SEQ ID NO: 1415 - DNA, 23 bp, Homo sapiens
tatcccctacaacgactatgggg

SEQ ID NO: 1416 - DNA, 23 bp, Homo sapiens
tcagaggagttgtagatgattgg

SEQ ID NO: 1417 - DNA, 23 bp, Homo sapiens
aacacgtacggggagtccaaggg

SEQ ID NO: 1418 - DNA, 23 bp, Homo sapiens
acgtgattttggtgtccttgagg

SEQ ID NO: 1419 - DNA, 23 bp, Homo sapiens
agggcaataccctccctcaccgg

SEQ ID NO: 1420 - DNA, 23 bp, Homo sapiens
tattctgcagcataagaaagtgg

SEQ ID NO: 1421 - DNA, 23 bp, Homo sapiens
tgaggagaagatggtgtcaatgg

SEQ ID NO: 1422 - DNA, 23 bp, Homo sapiens
aatcagccttttcacgctcaagg

SEQ ID NO: 1423 - DNA, 23 bp, Homo sapiens
gctctgtgtattgtgccttgtgg

SEQ ID NO: 1424 - DNA, 23 bp, Homo sapiens
gcgtctcctgccttgtcgttcgg

SEQ ID NO: 1425 - DNA, 23 bp, Homo sapiens
tcagctcttatcgtacaaccagg

SEQ ID NO: 1426 - DNA, 23 bp, Homo sapiens
tttgcaagctaactttccagagg

SEQ ID NO: 1427 - DNA, 23 bp, Homo sapiens
tcttttcaattgcccgatgcagg

SEQ ID NO: 1428 - DNA, 23 bp, Homo sapiens
gataccatgacatcatcatctgg

SEQ ID NO: 1429 - DNA, 23 bp, Homo sapiens
tgacaaatcacaacttgtagagg

SEQ ID NO: 1430 - DNA, 23 bp, Homo sapiens
atctccctgtggactcaggatgg

SEQ ID NO: 1431 - DNA, 23 bp, Homo sapiens
ccctagccagtgcctacaacagg

SEQ ID NO: 1432 - DNA, 23 bp, Homo sapiens
ctccccatggactcaggatgagg

SEQ ID NO: 1433 - DNA, 23 bp, Homo sapiens
agattcctgcactattttgaagg

SEQ ID NO: 1434 - DNA, 23 bp, Homo sapiens
acgtcgtcgcaccaggtaatagg

SEQ ID NO: 1435 - DNA, 23 bp, Homo sapiens
agtatcgactctcctcagagcgg

SEQ ID NO: 1436 - DNA, 23 bp, Homo sapiens
tgacggggctgcggtcaccaagg

SEQ ID NO: 1437 - DNA, 23 bp, Homo sapiens
tgctctggtctcagaagatcagg

SEQ ID NO: 1438 - DNA, 23 bp, Homo sapiens
tctgaacagcagcatccgctcgg

SEQ ID NO: 1439 - DNA, 23 bp, Homo sapiens
ggaaaaccgagttgcagtcctgg

SEQ ID NO: 1440 - DNA, 23 bp, Homo sapiens
accgccatgcagaagaaatctgg

SEQ ID NO: 1441 - DNA, 23 bp, Homo sapiens
gcctgaatcacttacacaattgg

SEQ ID NO: 1442 - DNA, 23 bp, Homo sapiens
tcctcccagtcacagccctcagg

SEQ ID NO: 1443 - DNA, 23 bp, Homo sapiens
gctgttgactcatgcaaatgagg

SEQ ID NO: 1444 - DNA, 23 bp, Homo sapiens
aagaggtttctctcatcttctgg

SEQ ID NO: 1445 - DNA, 23 bp, Homo sapiens
tcctgactatcctcaactagggg

SEQ ID NO: 1446 - DNA, 23 bp, Homo sapiens
aggacccgtagctgctagaaggg

SEQ ID NO: 1447 - DNA, 23 bp, Homo sapiens
gggtgctattgtaatgactcagg

SEQ ID NO: 1448 - DNA, 23 bp, Homo sapiens
gcagaggtcagggatgattgagg

SEQ ID NO: 1449 - DNA, 23 bp, Homo sapiens
aactggtggtattcagacctagg

SEQ ID NO: 1450 - DNA, 23 bp, Homo sapiens
accccacagtcccagtctgcggg

SEQ ID NO: 1451 - DNA, 23 bp, Homo sapiens
agagaactacatgtatcttgggg

SEQ ID NO: 1452 - DNA, 23 bp, Homo sapiens
gctccaaggtttaactgctctgg

SEQ ID NO: 1453 - DNA, 23 bp, Homo sapiens
cgggttttgtctactaattcagg

SEQ ID NO: 1454 - DNA, 23 bp, Homo sapiens
ctgagataaagtacaggccatgg

SEQ ID NO: 1455 - DNA, 23 bp, Homo sapiens
ttatgccaaagcaacgtctcagg

SEQ ID NO: 1456 - DNA, 23 bp, Homo sapiens
agagatccagcgacgctcagagg

SEQ ID NO: 1457 - DNA, 23 bp, Homo sapiens
ccttccccagaccaagaagttgg

SEQ ID NO: 1458 - DNA, 23 bp, Homo sapiens
tactgcaagtctcaggcgtgggg

SEQ ID NO: 1459 - DNA, 23 bp, Homo sapiens
ctcaaggatacttttactgcagg

SEQ ID NO: 1460 - DNA, 23 bp, Homo sapiens
ttttggtccatgctcgttaacgg

SEQ ID NO: 1461 - DNA, 23 bp, Homo sapiens
ctgtgggcacagtactgacgggg

SEQ ID NO: 1462 - DNA, 23 bp, Homo sapiens
aaggttgtgctctggcagtaggg

SEQ ID NO: 1463 - DNA, 23 bp, Homo sapiens
gggcaccccaggctcagtcttgg

SEQ ID NO: 1464 - DNA, 23 bp, Homo sapiens
ggcgccacggggatgactgatgg

SEQ ID NO: 1465 - DNA, 23 bp, Homo sapiens
gcagaaggagggggagaacttgg

SEQ ID NO: 1466 - DNA, 23 bp, Homo sapiens
ttccctgtatgtaagattagtgg

SEQ ID NO: 1467 - DNA, 23 bp, Homo sapiens
actggaggagtttgatctggagg

SEQ ID NO: 1468 - DNA, 23 bp, Homo sapiens
cccgaccccaggattttcaaagg

SEQ ID NO: 1469 - DNA, 23 bp, Homo sapiens
ggacttggcagctctcacctagg

SEQ ID NO: 1470 - DNA, 23 bp, Homo sapiens
tgaagaagaccttttttcagagg

SEQ ID NO: 1471 - DNA, 23 bp, Homo sapiens
ggccaaacgccccagctctgagg

SEQ ID NO: 1472 - DNA, 23 bp, Homo sapiens
gatggacagttgcacacactagg

SEQ ID NO: 1473 - DNA, 23 bp, Homo sapiens
tcccacagccaacagattgaagg

SEQ ID NO: 1474 - DNA, 23 bp, Homo sapiens
gatgatgagaccatctgagatgg

SEQ ID NO: 1475 - DNA, 23 bp, Homo sapiens
gctggtcagaagcctatgattgg

SEQ ID NO: 1476 - DNA, 23 bp, Homo sapiens
gctaccccctcaggtgcacaagg

SEQ ID NO: 1477 - DNA, 23 bp, Homo sapiens
gtcgtctcagtcagtgcaagagg

SEQ ID NO: 1478 - DNA, 23 bp, Homo sapiens
acagtgtgtggtaaaatcagtgg

SEQ ID NO: 1479 - DNA, 23 bp, Homo sapiens
tgttcagtagattccgactttgg

SEQ ID NO: 1480 - DNA, 23 bp, Homo sapiens
ctgtcagtctgtctttaatctgg

SEQ ID NO: 1481 - DNA, 23 bp, Homo sapiens
gctgtgctgatgaaagagcacgg

SEQ ID NO: 1482 - DNA, 23 bp, Homo sapiens
tgagcttttttatccatggatgg

SEQ ID NO: 1483 - DNA, 23 bp, Homo sapiens
gatgcaggaaatcagtagtttgg

SEQ ID NO: 1484 - DNA, 23 bp, Homo sapiens
tttcccaggatggaaagcttggg

SEQ ID NO: 1485 - DNA, 23 bp, Homo sapiens
ccaccgttagttttagaagttgg

SEQ ID NO: 1486 - DNA, 23 bp, Homo sapiens
cttgatcgcaggttctacagtgg

SEQ ID NO: 1487 - DNA, 23 bp, Homo sapiens
ccattacagtgactcggatgagg

SEQ ID NO: 1488 - DNA, 23 bp, Homo sapiens
gcggaggcgcgcgccctaggtgg

SEQ ID NO: 1489 - DNA, 23 bp, Homo sapiens
gggacgtgccaagaagcgcaagg

SEQ ID NO: 1490 - DNA, 23 bp, Homo sapiens
taccttggccttgagtagcaggg

SEQ ID NO: 1491 - DNA, 23 bp, Homo sapiens
ttataggagcatcttcaaggcgg

SEQ ID NO: 1492 - DNA, 23 bp, Homo sapiens
gatttctgcagctcctcatatgg

SEQ ID NO: 1493 - DNA, 23 bp, Homo sapiens
ctagctttctttacctttggagg

SEQ ID NO: 1494 - DNA, 23 bp, Homo sapiens
ccagcagcctgagtttctgatgg

SEQ ID NO: 1495 - DNA, 23 bp, Homo sapiens
gtgtgggaatgctcgtgtgatgg

SEQ ID NO: 1496 - DNA, 23 bp, Homo sapiens
ctgttggagaggagctataatgg

SEQ ID NO: 1497 - DNA, 23 bp, Homo sapiens
tggactcatctacttgttaaagg

SEQ ID NO: 1498 - DNA, 23 bp, Homo sapiens
ccagcaatcacagtttctcttgg

SEQ ID NO: 1499 - DNA, 23 bp, Homo sapiens
aaaagaagaggtctgactgaagg

SEQ ID NO: 1500 - DNA, 23 bp, Homo sapiens
tcctacaagcatactgacagtgg

SEQ ID NO: 1501 - DNA, 23 bp, Homo sapiens
ctcttcatcaggctctaccctgg

SEQ ID NO: 1502 - DNA, 23 bp, Homo sapiens
ctgaaagtgccttcctgagatgg

SEQ ID NO: 1503 - DNA, 23 bp, Homo sapiens
ccgtgggcctgcactacctcagg

SEQ ID NO: 1504 - DNA, 23 bp, Homo sapiens
ctacactgacagcagcactgagg

SEQ ID NO: 1505 - DNA, 23 bp, Homo sapiens
actgattcactgctatgttatgg

SEQ ID NO: 1506 - DNA, 23 bp, Homo sapiens
gcaatgaagaacaactctgaagg

SEQ ID NO: 1507 - DNA, 23 bp, Homo sapiens
cgacaattctgattacagcctgg

SEQ ID NO: 1508 - DNA, 23 bp, Homo sapiens
caggacggggggctaatagtagg

SEQ ID NO: 1509 - DNA, 23 bp, Homo sapiens
atcctgcggcggtatcctggtgg

SEQ ID NO: 1510 - DNA, 23 bp, Homo sapiens
gtggggctgaggtcagtagtagg

SEQ ID NO: 1511 - DNA, 23 bp, Homo sapiens
ctcatccgtcagcacccggatgg

SEQ ID NO: 1512 - DNA, 23 bp, Homo sapiens
agtgagaaagaccgttttcaggg

SEQ ID NO: 1513 - DNA, 23 bp, Homo sapiens
ctccgcatcaacaaaacctgagg

SEQ ID NO: 1514 - DNA, 23 bp, Homo sapiens
ggatgatcgtgacaagtttttgg

SEQ ID NO: 1515 - DNA, 23 bp, Homo sapiens
caatgatcgttttgtgggcaggg

SEQ ID NO: 1516 - DNA, 23 bp, Homo sapiens
gtcccgaactcctgggctcaagg

SEQ ID NO: 1517 - DNA, 23 bp, Homo sapiens
gagactttgaaaaccgtgatcgg

SEQ ID NO: 1518 - DNA, 23 bp, Homo sapiens
cacttccttctttcatcttctgg

SEQ ID NO: 1519 - DNA, 23 bp, Homo sapiens
gttgctcggaactacctagaggg

SEQ ID NO: 1520 - DNA, 23 bp, Homo sapiens
cataatgcccctggtgatctggg

SEQ ID NO: 1521 - DNA, 23 bp, Homo sapiens
gtttgtggcccgcaactacctgg

SEQ ID NO: 1522 - DNA, 23 bp, Homo sapiens
cggtgtgtacctcagactgatgg

SEQ ID NO: 1523 - DNA, 23 bp, Homo sapiens
ctgttcccagcgctcacttctgg

SEQ ID NO: 1524 - DNA, 23 bp, Homo sapiens
gaccccagaccacaccgggttgg

SEQ ID NO: 1525 - DNA, 23 bp, Homo sapiens
gctcagagagggaggaagcaggg

SEQ ID NO: 1526 - DNA, 23 bp, Homo sapiens
aggaagcccactacatagtttgg

SEQ ID NO: 1527 - DNA, 23 bp, Homo sapiens
ctactgcttctactactgtgggg

SEQ ID NO: 1528 - DNA, 23 bp, Homo sapiens
gccttcctcctgctgcagccggg

SEQ ID NO: 1529 - DNA, 23 bp, Homo sapiens
tcagctaaagcgacgtctccagg

SEQ ID NO: 1530 - DNA, 23 bp, Homo sapiens
ctgagacaagttcttgttagagg

SEQ ID NO: 1531 - DNA, 23 bp, Homo sapiens
tacggaacgctttcaccacccgg

SEQ ID NO: 1532 - DNA, 23 bp, Homo sapiens
gctgtttcatctcctcctatggg

SEQ ID NO: 1533 - DNA, 23 bp, Homo sapiens
tctgtagagagctgtccgactgg

SEQ ID NO: 1534 - DNA, 23 bp, Homo sapiens
atgtcgaactaacatgcttctgg

SEQ ID NO: 1535 - DNA, 23 bp, Homo sapiens
cagctcacatcttctgtcagtgg

SEQ ID NO: 1536 - DNA, 23 bp, Homo sapiens
ggagaggagtggacagcagctgg

SEQ ID NO: 1537 - DNA, 23 bp, Homo sapiens
tgcaccctgaagatgtgtagtgg

SEQ ID NO: 1538 - DNA, 23 bp, Homo sapiens
ccaggaactctactattagaggg

SEQ ID NO: 1539 - DNA, 23 bp, Homo sapiens
cgacccgtatgaagggaaagtgg

SEQ ID NO: 1540 - DNA, 23 bp, Homo sapiens
ttgggcactatcagggctgatgg

SEQ ID NO: 1541 - DNA, 23 bp, Homo sapiens
tgaagagcattcatcgtgagggg

SEQ ID NO: 1542 - DNA, 23 bp, Homo sapiens
actcttttgtgatgacagcttgg

SEQ ID NO: 1543 - DNA, 23 bp, Homo sapiens
ggtgaaggccctggagtaggcgg

SEQ ID NO: 1544 - DNA, 23 bp, Homo sapiens
cctggtgaaggccctggagtagg

SEQ ID NO: 1545 - DNA, 23 bp, Homo sapiens
gcaaatgctgagaagacttctgg

SEQ ID NO: 1546 - DNA, 23 bp, Homo sapiens
cctaaagctgctggcaaagaagg

SEQ ID NO: 1547 - DNA, 23 bp, Homo sapiens
ctcatcctcttcgccatgtgagg

SEQ ID NO: 1548 - DNA, 23 bp, Homo sapiens
gtggagacggctccttcacatgg

SEQ ID NO: 1549 - DNA, 23 bp, Homo sapiens
tagggatagaaatgattacctgg

SEQ ID NO: 1550 - DNA, 23 bp, Homo sapiens
tatgggtctcttttgtttgatgg

SEQ ID NO: 1551 - DNA, 23 bp, Homo sapiens
aaattctcaattggttggtgagg

SEQ ID NO: 1552 - DNA, 23 bp, Homo sapiens
gaaacggattgccagagaattgg

SEQ ID NO: 1553 - DNA, 23 bp, Homo sapiens
ttactttatttcttcaggcctgg

SEQ ID NO: 1554 - DNA, 23 bp, Homo sapiens
ctccgcaaataccactgaagagg

SEQ ID NO: 1555 - DNA, 23 bp, Homo sapiens
ataggcaagcggggcatcattgg

SEQ ID NO: 1556 - DNA, 23 bp, Homo sapiens
acaggcaagcgtggcatcattgg

SEQ ID NO: 1557 - DNA, 23 bp, Homo sapiens
gaagctgggcagggctatgcggg

SEQ ID NO: 1558 - DNA, 23 bp, Homo sapiens
agcattggatttgatcacatggg

SEQ ID NO: 1559 - DNA, 23 bp, Homo sapiens
gagcattggatttgatcacatgg

SEQ ID NO: 1560 - DNA, 23 bp, Homo sapiens
taagacagcactgccttctctgg

SEQ ID NO: 1561 - DNA, 23 bp, Homo sapiens
tggcacagggtcacacaatctgg

SEQ ID NO: 1562 - DNA, 23 bp, Homo sapiens
gtttatagcattcagccccctgg

SEQ ID NO: 1563 - DNA, 23 bp, Homo sapiens
gacaaaccagaagattcgaatgg

SEQ ID NO: 1564 - DNA, 23 bp, Homo sapiens
ccttcgagcatattcgggaaggg

SEQ ID NO: 1565 - DNA, 23 bp, Homo sapiens
gttcaataacgacgacagtgtgg

SEQ ID NO: 1566 - DNA, 23 bp, Homo sapiens
ggatggcacagccgaggagtagg

SEQ ID NO: 1567 - DNA, 23 bp, Homo sapiens
caaaaatagagagcccctgtagg

SEQ ID NO: 1568 - DNA, 23 bp, Homo sapiens
cagacctccagagtgaagatggg

SEQ ID NO: 1569 - DNA, 23 bp, Homo sapiens
ctcggagagggtctactttgtgg

SEQ ID NO: 1570 - DNA, 23 bp, Homo sapiens
gggccaggacgctagaagatagg

SEQ ID NO: 1571 - DNA, 23 bp, Homo sapiens
tagcagaatgtatttcacagagg

SEQ ID NO: 1572 - DNA, 23 bp, Homo sapiens
ctgaagtatcattggccttgagg

SEQ ID NO: 1573 - DNA, 23 bp, Homo sapiens
ggactcagcccatcctgaggagg

SEQ ID NO: 1574 - DNA, 23 bp, Homo sapiens
gggggcctctattgggttatagg

SEQ ID NO: 1575 - DNA, 23 bp, Homo sapiens
ttcaaggcttctaatcttcaagg

SEQ ID NO: 1576 - DNA, 23 bp, Homo sapiens
cggggctagagcgcagtgtcagg

SEQ ID NO: 1577 - DNA, 23 bp, Homo sapiens
taatgctttgcagagtctcgagg

SEQ ID NO: 1578 - DNA, 23 bp, Homo sapiens
caagattgattgcaacttgctgg

SEQ ID NO: 1579 - DNA, 23 bp, Homo sapiens
tggttattgagttgcagtcccgg

SEQ ID NO: 1580 - DNA, 23 bp, Homo sapiens
tctggctgaagagaaggacgagg

SEQ ID NO: 1581 - DNA, 23 bp, Homo sapiens
aaatgccaacaggaagtttttgg

SEQ ID NO: 1582 - DNA, 23 bp, Homo sapiens
gttggtgttagcaccaaacaagg

SEQ ID NO: 1583 - DNA, 23 bp, Homo sapiens
ctgccgaagacctgcgctagggg

SEQ ID NO: 1584 - DNA, 23 bp, Homo sapiens
cggtagttttcatggatttctgg

SEQ ID NO: 1585 - DNA, 23 bp, Homo sapiens
aactaccggatttctgcctaggg

SEQ ID NO: 1586 - DNA, 23 bp, Homo sapiens
tgtgatgtacatttagttggtgg

SEQ ID NO: 1587 - DNA, 23 bp, Homo sapiens
gccagaggcaggcttagcttcgg

SEQ ID NO: 1588 - DNA, 23 bp, Homo sapiens
actcctggtgggagacttcaggg

SEQ ID NO: 1589 - DNA, 23 bp, Homo sapiens
gctcctgaatggcagggatgagg

SEQ ID NO: 1590 - DNA, 23 bp, Homo sapiens
aggcccgacgaatggtgatgggg

SEQ ID NO: 1591 - DNA, 23 bp, Homo sapiens
acaccaccaaaaagaaatccagg

SEQ ID NO: 1592 - DNA, 23 bp, Homo sapiens
ggtaagggatcagctgtccccgg

SEQ ID NO: 1593 - DNA, 23 bp, Homo sapiens
acaagcccctcaagggctgaagg

SEQ ID NO: 1594 - DNA, 23 bp, Homo sapiens
gtttacagtacaggaagaagagg

SEQ ID NO: 1595 - DNA, 23 bp, Homo sapiens
aggtgtcactgtgactcttttgg

SEQ ID NO: 1596 - DNA, 23 bp, Homo sapiens
acagtttcactgttttatcctgg

SEQ ID NO: 1597 - DNA, 23 bp, Homo sapiens
ctactcaaagctcacatcatagg

SEQ ID NO: 1598 - DNA, 23 bp, Homo sapiens
ctgcaagctggcctcctaagggg

SEQ ID NO: 1599 - DNA, 23 bp, Homo sapiens
gaattggagcaaagcggacttgg

SEQ ID NO: 1600 - DNA, 23 bp, Homo sapiens
cacaagctcctgaaggagtgagg

SEQ ID NO: 1601 - DNA, 23 bp, Homo sapiens
cttgcaaagctaaggcgtgctgg

SEQ ID NO: 1602 - DNA, 23 bp, Homo sapiens
agcacagagtagagaacaactgg

SEQ ID NO: 1603 - DNA, 23 bp, Homo sapiens
tatgccagatgtatcttggttgg

SEQ ID NO: 1604 - DNA, 23 bp, Homo sapiens
ttcatgaagtcttggcttttcgg

SEQ ID NO: 1605 - DNA, 23 bp, Homo sapiens
cccgaggtggagtgtggctgagg

SEQ ID NO: 1606 - DNA, 23 bp, Homo sapiens
aagtcacgaagaactgtaccagg

SEQ ID NO: 1607 - DNA, 23 bp, Homo sapiens
cacctggcccatcaaaattcagg

SEQ ID NO: 1608 - DNA, 23 bp, Homo sapiens
ctggccccagcatcagatgcagg

SEQ ID NO: 1609 - DNA, 23 bp, Homo sapiens
aaacacctttcaacacgtcaagg

SEQ ID NO: 1610 - DNA, 23 bp, Homo sapiens
tggttatacaagcagcatacagg

SEQ ID NO: 1611 - DNA, 23 bp, Homo sapiens
aaaatccaggaccttcccaaggg

SEQ ID NO: 1612 - DNA, 23 bp, Homo sapiens
ggtctaatgtaggcaagtagagg

SEQ ID NO: 1613 - DNA, 23 bp, Homo sapiens
gggtgtctctagtagatttcagg

SEQ ID NO: 1614 - DNA, 23 bp, Homo sapiens
agaggttcattttcccgcattgg

SEQ ID NO: 1615 - DNA, 23 bp, Homo sapiens
caccaccaacagcagttgtaagg

SEQ ID NO: 1616 - DNA, 23 bp, Homo sapiens
cggctaagtcaggagacagtcgg

SEQ ID NO: 1617 - DNA, 23 bp, Homo sapiens
caggacaatcttcagttccccgg

SEQ ID NO: 1618 - DNA, 23 bp, Homo sapiens
ctcatggaggtctcaggtcgcgg

SEQ ID NO: 1619 - DNA, 23 bp, Homo sapiens
ggttctgggtggggagtgagggg

SEQ ID NO: 1620 - DNA, 23 bp, Homo sapiens
agagttcacatccatgtgaaagg

SEQ ID NO: 1621 - DNA, 23 bp, Homo sapiens
tctgacagtttctaaagacatgg

SEQ ID NO: 1622 - DNA, 23 bp, Homo sapiens
ttcatcatgtttggccaggctgg

SEQ ID NO: 1623 - DNA, 23 bp, Homo sapiens
ttctaaaatggtgtcgacagcgg

SEQ ID NO: 1624 - DNA, 23 bp, Homo sapiens
ggttgggaaaacagactcaaagg

SEQ ID NO: 1625 - DNA, 23 bp, Homo sapiens
agctgtcagggacgtgcctttgg

SEQ ID NO: 1626 - DNA, 23 bp, Homo sapiens
caaacagaacgggcaggataagg

SEQ ID NO: 1627 - DNA, 23 bp, Homo sapiens
ccaagccatagagaagcatcagg

SEQ ID NO: 1628 - DNA, 23 bp, Homo sapiens
gtaaagtgctctcaaagcagagg

SEQ ID NO: 1629 - DNA, 23 bp, Homo sapiens
cctctgttccctgaaggaaaggg

SEQ ID NO: 1630 - DNA, 23 bp, Homo sapiens
ggcaggcactttctcgttaatgg

SEQ ID NO: 1631 - DNA, 23 bp, Homo sapiens
tatgatgacatcaactgacttgg

SEQ ID NO: 1632 - DNA, 23 bp, Homo sapiens
ccctctgttgagattggaattgg

SEQ ID NO: 1633 - DNA, 23 bp, Homo sapiens
aaaaggccccctcgctataaagg

SEQ ID NO: 1634 - DNA, 23 bp, Homo sapiens
aggcagaaacatctgcggtgagg

SEQ ID NO: 1635 - DNA, 23 bp, Homo sapiens
ctctttacccaggactctgaagg

SEQ ID NO: 1636 - DNA, 23 bp, Homo sapiens
tttgagctcagtcagcctcctgg

SEQ ID NO: 1637 - DNA, 23 bp, Homo sapiens
atcagctagcaaacagtcttagg

SEQ ID NO: 1638 - DNA, 23 bp, Homo sapiens
gccagactcatttgccccgcagg

SEQ ID NO: 1639 - DNA, 23 bp, Homo sapiens
aatctgctcttagggctcaaggg

SEQ ID NO: 1640 - DNA, 23 bp, Homo sapiens
cccttcaatctgtcgcctgatgg

SEQ ID NO: 1641 - DNA, 23 bp, Homo sapiens
gctgcctccctgtgctcagatgg

SEQ ID NO: 1642 - DNA, 23 bp, Homo sapiens
tctctcgtcaaattgcttaaagg

SEQ ID NO: 1643 - DNA, 23 bp, Homo sapiens
tgctcctgttctcggcttatcgg

SEQ ID NO: 1644 - DNA, 23 bp, Homo sapiens
ggaagagctggaagactggttgg

SEQ ID NO: 1645 - DNA, 23 bp, Homo sapiens
gccccttttctttcttcatttgg

SEQ ID NO: 1646 - DNA, 23 bp, Homo sapiens
cttgctcaaggcttctcatctgg

SEQ ID NO: 1647 - DNA, 23 bp, Homo sapiens
gggcgagcgcggggctcagtagg

SEQ ID NO: 1648 - DNA, 23 bp, Homo sapiens
ccctggatcagtgtctgatctgg

SEQ ID NO: 1649 - DNA, 23 bp, Homo sapiens
tgcaaggctcaagttgaaacagg

SEQ ID NO: 1650 - DNA, 23 bp, Homo sapiens
cgctgagaccatcatcttttagg

SEQ ID NO: 1651 - DNA, 23 bp, Homo sapiens
gccaaggacacttcatcgtgagg

SEQ ID NO: 1652 - DNA, 23 bp, Homo sapiens
ggtgggtgtagccgtggctaggg

SEQ ID NO: 1653 - DNA, 23 bp, Homo sapiens
catgcagtaccttcattcacagg

SEQ ID NO: 1654 - DNA, 23 bp, Homo sapiens
gtcaaattatctccagctcctgg

SEQ ID NO: 1655 - DNA, 23 bp, Homo sapiens
tcctcaaaatctccaaagaaagg

SEQ ID NO: 1656 - DNA, 23 bp, Homo sapiens
agtggagaaggtggactgatagg

SEQ ID NO: 1657 - DNA, 23 bp, Homo sapiens
ggattctgggcaaagtggagcgg

SEQ ID NO: 1658 - DNA, 23 bp, Homo sapiens
gcagccccagggcaggaggatgg

SEQ ID NO: 1659 - DNA, 23 bp, Homo sapiens
tccaacccttgcttcctagctgg

SEQ ID NO: 1660 - DNA, 23 bp, Homo sapiens
gagtgcagtggcgcaatcatggg

SEQ ID NO: 1661 - DNA, 23 bp, Homo sapiens
acttctattcttatgcgaagagg

SEQ ID NO: 1662 - DNA, 23 bp, Homo sapiens
ccttccaccactgcattacttgg

SEQ ID NO: 1663 - DNA, 23 bp, Homo sapiens
aatgcctgtttaagcttcagcgg

SEQ ID NO: 1664 - DNA, 23 bp, Homo sapiens
ttttccgctgaagcttaaacagg

SEQ ID NO: 1665 - DNA, 23 bp, Homo sapiens
ccagcgagcatcatgtgagtggg

SEQ ID NO: 1666 - DNA, 23 bp, Homo sapiens
ggactctagagacatgtagcagg

SEQ ID NO: 1667 - DNA, 23 bp, Homo sapiens
ggaccggggccagcctagggggg

SEQ ID NO: 1668 - DNA, 23 bp, Homo sapiens
acagcccaagatagttaagtggg

SEQ ID NO: 1669 - DNA, 23 bp, Homo sapiens
ctttttggcaggtcatgctaagg

SEQ ID NO: 1670 - DNA, 23 bp, Homo sapiens
ggtgtggagggagttgcaggtgg

SEQ ID NO: 1671 - DNA, 23 bp, Homo sapiens
cgatgtcaagcaagataacaggg

SEQ ID NO: 1672 - DNA, 23 bp, Homo sapiens
cagaagaaatgcacagaatctgg

SEQ ID NO: 1673 - DNA, 23 bp, Homo sapiens
cagcaaaagaaaaggcaggcagg

SEQ ID NO: 1674 - DNA, 23 bp, Homo sapiens
gcactctcagctctgaagccagg

SEQ ID NO: 1675 - DNA, 23 bp, Homo sapiens
agattgtccgcctgtctgagggg

SEQ ID NO: 1676 - DNA, 23 bp, Homo sapiens
gccgggccgcggcggctcagggg

SEQ ID NO: 1677 - DNA, 23 bp, Homo sapiens
tgaggctcagatctccaccgagg

SEQ ID NO: 1678 - DNA, 23 bp, Homo sapiens
cctggacacagtgaaaattgagg

SEQ ID NO: 1679 - DNA, 23 bp, Homo sapiens
acccagcaattgaggtgtgatgg

SEQ ID NO: 1680 - DNA, 23 bp, Homo sapiens
cacgggctgccaactgcactcgg

SEQ ID NO: 1681 - DNA, 23 bp, Homo sapiens
gacacagaaaggttttcgagagg

SEQ ID NO: 1682 - DNA, 23 bp, Homo sapiens
cttcaggacatttgatatcgagg

SEQ ID NO: 1683 - DNA, 23 bp, Homo sapiens
gatctgtgtctgattgccgcagg

SEQ ID NO: 1684 - DNA, 23 bp, Homo sapiens
ccccataccccagcgctgaaggg

SEQ ID NO: 1685 - DNA, 23 bp, Homo sapiens
tagataaacgcagccctacaagg

SEQ ID NO: 1686 - DNA, 23 bp, Homo sapiens
cggggacaccgggtctcctgagg

SEQ ID NO: 1687 - DNA, 23 bp, Homo sapiens
ccggctggggtcagagcacctgg

SEQ ID NO: 1688 - DNA, 23 bp, Homo sapiens
tccccaatgagagtcagcactgg

SEQ ID NO: 1689 - DNA, 23 bp, Homo sapiens
tggggagctaggagtcccattgg

SEQ ID NO: 1690 - DNA, 23 bp, Homo sapiens
acttccttcacttcagctgacgg

SEQ ID NO: 1691 - DNA, 23 bp, Homo sapiens
aatccccagcgggccatcactgg

SEQ ID NO: 1692 - DNA, 23 bp, Homo sapiens
cccaggaagagacttgtctaagg

SEQ ID NO: 1693 - DNA, 23 bp, Homo sapiens
tatgccctcacacctttatgcgg

SEQ ID NO: 1694 - DNA, 23 bp, Homo sapiens
ccagatgaagacgctgtagccgg

SEQ ID NO: 1695 - DNA, 23 bp, Homo sapiens
tctcgcacgggggcgtcttgagg

SEQ ID NO: 1696 - DNA, 23 bp, Homo sapiens
cgtgtaccaaaacgctagctcgg

SEQ ID NO: 1697 - DNA, 23 bp, Homo sapiens
gtccattagtgtcagccccgagg

SEQ ID NO: 1698 - DNA, 23 bp, Homo sapiens
ggaggagtcagtgtgaacctcgg

SEQ ID NO: 1699 - DNA, 23 bp, Homo sapiens
atcacagtggatttctggtttgg

SEQ ID NO: 1700 - DNA, 23 bp, Homo sapiens
tcaggtgaacgagtactgagagg

SEQ ID NO: 1701 - DNA, 23 bp, Homo sapiens
tcttcgattggagctaactctgg

SEQ ID NO: 1702 - DNA, 23 bp, Homo sapiens
tggtgcacattcagctgagctgg

SEQ ID NO: 1703 - DNA, 23 bp, Homo sapiens
agggaagggctcagcagcgtcgg

SEQ ID NO: 1704 - DNA, 23 bp, Homo sapiens
aaagatttttcacagggcacagg

SEQ ID NO: 1705 - DNA, 23 bp, Homo sapiens
aatactaagtcaccctcttctgg

SEQ ID NO: 1706 - DNA, 23 bp, Homo sapiens
acagaagggcagcatcagccagg

SEQ ID NO: 1707 - DNA, 23 bp, Homo sapiens
cagcgttctcatctgtaaaatgg

SEQ ID NO: 1708 - DNA, 23 bp, Homo sapiens
ggtggctcagggtgaaggccggg

SEQ ID NO: 1709 - DNA, 23 bp, Homo sapiens
tctttgacagacagccctgaagg

SEQ ID NO: 1710 - DNA, 23 bp, Homo sapiens
gctacggcgtggagtgctgaggg

SEQ ID NO: 1711 - DNA, 23 bp, Homo sapiens
ttcgacttctgtccatctgttgg

SEQ ID NO: 1712 - DNA, 23 bp, Homo sapiens
ctagtcttcttagagttgactgg

SEQ ID NO: 1713 - DNA, 23 bp, Homo sapiens
tacagggatggttcagacagtgg

SEQ ID NO: 1714 - DNA, 23 bp, Homo sapiens
gcctggatgtcaggcagagctgg

SEQ ID NO: 1715 - DNA, 23 bp, Homo sapiens
cctccttggagggcctcagaggg

SEQ ID NO: 1716 - DNA, 23 bp, Homo sapiens
atttgccaatggaaagctctagg

SEQ ID NO: 1717 - DNA, 23 bp, Homo sapiens
taggaaacaccagtcttgagagg

SEQ ID NO: 1718 - DNA, 23 bp, Homo sapiens
atctccctgctgaagtgaggagg

SEQ ID NO: 1719 - DNA, 23 bp, Homo sapiens
cctctctggtcagacatcgctgg

SEQ ID NO: 1720 - DNA, 23 bp, Homo sapiens
ttccgggcctttctcaacagagg

SEQ ID NO: 1721 - DNA, 23 bp, Homo sapiens
aacagtgtcgtcagagtggtggg

SEQ ID NO: 1722 - DNA, 23 bp, Homo sapiens
tcactaggtataatctttcctgg

SEQ ID NO: 1723 - DNA, 23 bp, Homo sapiens
ggatgtggagcgaaggtcactgg

SEQ ID NO: 1724 - DNA, 23 bp, Homo sapiens
tttttctgctacacctcactcgg

SEQ ID NO: 1725 - DNA, 23 bp, Homo sapiens
agcattttgttgcagagttttgg

SEQ ID NO: 1726 - DNA, 23 bp, Homo sapiens
ggcagaggctacggtgctgctgg

SEQ ID NO: 1727 - DNA, 23 bp, Homo sapiens
ttgtaagattcaggccatactgg

SEQ ID NO: 1728 - DNA, 23 bp, Homo sapiens
cgacctgaaatctgatgaatggg

SEQ ID NO: 1729 - DNA, 23 bp, Homo sapiens
gagctaaggatcatcagcaaagg

SEQ ID NO: 1730 - DNA, 23 bp, Homo sapiens
acttacatctttcaggagcttgg

SEQ ID NO: 1731 - DNA, 23 bp, Homo sapiens
tcactccaaaaaactggcatggg

SEQ ID NO: 1732 - DNA, 23 bp, Homo sapiens
ttgcatttccagccattggttgg

SEQ ID NO: 1733 - DNA, 23 bp, Homo sapiens
tggcatgatgtttccagcagagg

SEQ ID NO: 1734 - DNA, 23 bp, Homo sapiens
tgcggtgggcggctcagcatagg

SEQ ID NO: 1735 - DNA, 23 bp, Homo sapiens
catgggcatgaggaggctactgg

SEQ ID NO: 1736 - DNA, 23 bp, Homo sapiens
acgctggtgtccacagtgtgagg

SEQ ID NO: 1737 - DNA, 23 bp, Homo sapiens
ctgcccccctcctcagctgatgg

SEQ ID NO: 1738 - DNA, 23 bp, Homo sapiens
gggaagttcatcttccagccagg

SEQ ID NO: 1739 - DNA, 23 bp, Homo sapiens
tagtcaggcggctcagaatctgg

SEQ ID NO: 1740 - DNA, 23 bp, Homo sapiens
ggcacccatcattcgatgagagg

SEQ ID NO: 1741 - DNA, 23 bp, Homo sapiens
gcacccctcatccgctgaggcgg

SEQ ID NO: 1742 - DNA, 23 bp, Homo sapiens
ctggcagctgatggactcagggg

SEQ ID NO: 1743 - DNA, 23 bp, Homo sapiens
agaatcttcgtaccacaaactgg

SEQ ID NO: 1744 - DNA, 23 bp, Homo sapiens
ggaagctggaattcgtatgacgg

SEQ ID NO: 1745 - DNA, 23 bp, Homo sapiens
tcccagagagcatcacaagaagg

SEQ ID NO: 1746 - DNA, 23 bp, Homo sapiens
gcaatgaggtttgtgtctacagg

SEQ ID NO: 1747 - DNA, 23 bp, Homo sapiens
ccccaagttgaaaaggaatttgg

SEQ ID NO: 1748 - DNA, 23 bp, Homo sapiens
ggccatccagattcagtgagcgg

SEQ ID NO: 1749 - DNA, 23 bp, Homo sapiens
tcagggccagcagtcctcactgg

SEQ ID NO: 1750 - DNA, 23 bp, Homo sapiens
gtcaagaggaagcaactcaaagg

SEQ ID NO: 1751 - DNA, 23 bp, Homo sapiens
agccgacgggcgcctcaccgagg

SEQ ID NO: 1752 - DNA, 23 bp, Homo sapiens
cttcgctgcaatgttttcaccgg

SEQ ID NO: 1753 - DNA, 23 bp, Homo sapiens
acaggagccgcgaggactgaggg

SEQ ID NO: 1754 - DNA, 23 bp, Homo sapiens
ttactttagcttaatggtggggg

SEQ ID NO: 1755 - DNA, 23 bp, Homo sapiens
gtaaccgtgaaagagtgacaagg

SEQ ID NO: 1756 - DNA, 23 bp, Homo sapiens
ccgcatcggaagctcagggctgg

SEQ ID NO: 1757 - DNA, 23 bp, Homo sapiens
ggccagctggtcagccacgcagg

SEQ ID NO: 1758 - DNA, 23 bp, Homo sapiens
gctcaagtccacttctaacctgg

SEQ ID NO: 1759 - DNA, 23 bp, Homo sapiens
aggagtgtccccggcttcatcgg

SEQ ID NO: 1760 - DNA, 23 bp, Homo sapiens
ggggattgatcagacacgtaagg

SEQ ID NO: 1761 - DNA, 23 bp, Homo sapiens
atctggaagaagatgggctgagg

SEQ ID NO: 1762 - DNA, 23 bp, Homo sapiens
tggaggaaaaacacagtccaagg

SEQ ID NO: 1763 - DNA, 23 bp, Homo sapiens
attcgtgactttttcgcagccgg

SEQ ID NO: 1764 - DNA, 23 bp, Homo sapiens
cgaagacagaagaagtagagagg

SEQ ID NO: 1765 - DNA, 23 bp, Homo sapiens
ggaaaacaggccaatctgtgagg

SEQ ID NO: 1766 - DNA, 23 bp, Homo sapiens
gcagagctggccacaatatgagg

SEQ ID NO: 1767 - DNA, 23 bp, Homo sapiens
tgggagtccagtatgctacatgg

SEQ ID NO: 1768 - DNA, 23 bp, Homo sapiens
ggcgggtgcaggcacctaattgg

SEQ ID NO: 1769 - DNA, 23 bp, Homo sapiens
agtgctcagttatcattcagtgg

SEQ ID NO: 1770 - DNA, 23 bp, Homo sapiens
cgggaagttcttccaaagcaagg

SEQ ID NO: 1771 - DNA, 23 bp, Homo sapiens
cataatcagtgcttctcagaagg

SEQ ID NO: 1772 - DNA, 23 bp, Homo sapiens
ttaaggcagagggtggagaatgg

SEQ ID NO: 1773 - DNA, 23 bp, Homo sapiens
acagcagctcaggtctcaggcgg

SEQ ID NO: 1774 - DNA, 23 bp, Homo sapiens
tcttgattgtgaactttctgagg

SEQ ID NO: 1775 - DNA, 23 bp, Homo sapiens
acacacacagataaattcacagg

SEQ ID NO: 1776 - DNA, 23 bp, Homo sapiens
agtggggacagcttcttcctagg

SEQ ID NO: 1777 - DNA, 23 bp, Homo sapiens
gttggacttgattccaccgcagg

SEQ ID NO: 1778 - DNA, 23 bp, Homo sapiens
attcaccctacagggactttggg

SEQ ID NO: 1779 - DNA, 23 bp, Homo sapiens
accccttctattggaaattctgg

SEQ ID NO: 1780 - DNA, 23 bp, Homo sapiens
ttgaaagactctatggttagtgg

SEQ ID NO: 1781 - DNA, 23 bp, Homo sapiens
gagggacccaaaagctaagcggg

SEQ ID NO: 1782 - DNA, 23 bp, Homo sapiens
ttcacccctccaaggagtctcgg

SEQ ID NO: 1783 - DNA, 23 bp, Homo sapiens
acaatgaaagggcgcttcactgg

SEQ ID NO: 1784 - DNA, 23 bp, Homo sapiens
ttggactcactagcatccctcgg

SEQ ID NO: 1785 - DNA, 23 bp, Homo sapiens
ggagaagggggctccgtgagtgg

SEQ ID NO: 1786 - DNA, 23 bp, Homo sapiens
aggggtggcagcgggggcttcgg

SEQ ID NO: 1787 - DNA, 23 bp, Homo sapiens
ccccatgccaggtccctaggggg

SEQ ID NO: 1788 - DNA, 23 bp, Homo sapiens
tttcttccccctgcagctctggg

SEQ ID NO: 1789 - DNA, 23 bp, Homo sapiens
gaaagaacactctgaacttcagg

SEQ ID NO: 1790 - DNA, 23 bp, Homo sapiens
tcagaaaaatgcactatgaccgg

SEQ ID NO: 1791 - DNA, 23 bp, Homo sapiens
tggacaagaaggaagagtaaggg

SEQ ID NO: 1792 - DNA, 23 bp, Homo sapiens
ctggggtcaccaccctcaggcgg

SEQ ID NO: 1793 - DNA, 23 bp, Homo sapiens
ggaacctcctcctgtaaagcagg

SEQ ID NO: 1794 - DNA, 23 bp, Homo sapiens
accgtgctgatttgtttacttgg

SEQ ID NO: 1795 - DNA, 23 bp, Homo sapiens
tgtcttttcagaagtcttgccgg

SEQ ID NO: 1796 - DNA, 23 bp, Homo sapiens
aaagcatgcgttcgggatggagg

SEQ ID NO: 1797 - DNA, 23 bp, Homo sapiens
agcaggttgctggtacctacggg

SEQ ID NO: 1798 - DNA, 23 bp, Homo sapiens
gaagaccacaaagctcacaaagg

SEQ ID NO: 1799 - DNA, 23 bp, Homo sapiens
gctgcccacactgtataggacgg

SEQ ID NO: 1800 - DNA, 23 bp, Homo sapiens
gacaattgtgctatcctgaatgg

SEQ ID NO: 1801 - DNA, 23 bp, Homo sapiens
cacagcctgcagcttcacaccgg

SEQ ID NO: 1802 - DNA, 23 bp, Homo sapiens
cagggaaccttcatgactgttgg

SEQ ID NO: 1803 - DNA, 23 bp, Homo sapiens
cgacaagatgaacgaaatcatgg

SEQ ID NO: 1804 - DNA, 23 bp, Homo sapiens
ttccgatacagcacaatggttgg

SEQ ID NO: 1805 - DNA, 23 bp, Homo sapiens
agtttccagaagcagtgagatgg

SEQ ID NO: 1806 - DNA, 23 bp, Homo sapiens
agcaagaaagaaagttgtgtggg

SEQ ID NO: 1807 - DNA, 23 bp, Homo sapiens
cacttatcgaagtgatccagtgg

SEQ ID NO: 1808 - DNA, 23 bp, Homo sapiens
cattctacatcccagacaaatgg

SEQ ID NO: 1809 - DNA, 23 bp, Homo sapiens
aaaggctgtggggtcagatccgg

SEQ ID NO: 1810 - DNA, 23 bp, Homo sapiens
ggcagggtctcacccgtgcatgg

SEQ ID NO: 1811 - DNA, 23 bp, Homo sapiens
tgaaacagtacgtgatcttaagg

SEQ ID NO: 1812 - DNA, 23 bp, Homo sapiens
gatgtgtggcagttttcggatgg

SEQ ID NO: 1813 - DNA, 23 bp, Homo sapiens
ttttagcgtgtacagtaccctgg

SEQ ID NO: 1814 - DNA, 23 bp, Homo sapiens
cccgcgcgcttagctcctctcgg

SEQ ID NO: 1815 - DNA, 23 bp, Homo sapiens
aggcatgttgacttcacttgtgg

SEQ ID NO: 1816 - DNA, 23 bp, Homo sapiens
ggtgatgtgagtctgggctgagg

SEQ ID NO: 1817 - DNA, 23 bp, Homo sapiens
agtcagtggcccacaagaagagg

SEQ ID NO: 1818 - DNA, 23 bp, Homo sapiens
ctggtcaacagtattgcttcagg

SEQ ID NO: 1819 - DNA, 23 bp, Homo sapiens
gctggtgcccggagattggacgg

SEQ ID NO: 1820 - DNA, 23 bp, Homo sapiens
tgctgggctcactcttcagtcgg

SEQ ID NO: 1821 - DNA, 23 bp, Homo sapiens
caacagccttcatttatctctgg

SEQ ID NO: 1822 - DNA, 23 bp, Homo sapiens
gtcatttagttggtcacagttgg

SEQ ID NO: 1823 - DNA, 23 bp, Homo sapiens
ggtgtggagaatgcattgacagg

SEQ ID NO: 1824 - DNA, 23 bp, Homo sapiens
aaccactatctcagtgcaatggg

SEQ ID NO: 1825 - DNA, 23 bp, Homo sapiens
aagttcagtggccactcaagtgg

SEQ ID NO: 1826 - DNA, 23 bp, Homo sapiens
caaccactatctcagtgcaatgg

SEQ ID NO: 1827 - DNA, 23 bp, Homo sapiens
cagagggaaatgtgctcatgtgg

SEQ ID NO: 1828 - DNA, 23 bp, Homo sapiens
ggtatcatgagaaatccttgtgg

SEQ ID NO: 1829 - DNA, 23 bp, Homo sapiens
tgctacagtggttcttaatcagg

SEQ ID NO: 1830 - DNA, 23 bp, Homo sapiens
ttaacgcttactatgcaaggagg

SEQ ID NO: 1831 - DNA, 23 bp, Homo sapiens
ggtggccctgctggaggaggagg

SEQ ID NO: 1832 - DNA, 23 bp, Homo sapiens
tgagaaagagctcagtccaatgg

SEQ ID NO: 1833 - DNA, 23 bp, Homo sapiens
ggctctgagaaagaaataggagg

SEQ ID NO: 1834 - DNA, 23 bp, Homo sapiens
gatccagcagcacggtggatggg

SEQ ID NO: 1835 - DNA, 23 bp, Homo sapiens
tcattctttagctcaaatgcagg

SEQ ID NO: 1836 - DNA, 23 bp, Homo sapiens
catccagggccagggaggttggg

SEQ ID NO: 1837 - DNA, 23 bp, Homo sapiens
gggggccctggtaactgtagggg

SEQ ID NO: 1838 - DNA, 23 bp, Homo sapiens
gctccaggaggcagctgaggggg

SEQ ID NO: 1839 - DNA, 23 bp, Homo sapiens
tcaacactccatgcttcagcagg

SEQ ID NO: 1840 - DNA, 23 bp, Homo sapiens
tgcactaccacattctcgggggg

SEQ ID NO: 1841 - DNA, 23 bp, Homo sapiens
aagcatcgtctacatctcttcgg

SEQ ID NO: 1842 - DNA, 23 bp, Homo sapiens
tagctttctgacgccgtctgcgg

SEQ ID NO: 1843 - DNA, 23 bp, Homo sapiens
caggcaggccggcttctcagggg

SEQ ID NO: 1844 - DNA, 23 bp, Homo sapiens
cagggtaaggggaggtgagtggg

SEQ ID NO: 1845 - DNA, 23 bp, Homo sapiens
agccaaggacctggcaacccagg

SEQ ID NO: 1846 - DNA, 23 bp, Homo sapiens
ccctggcagcgacttctagaagg

SEQ ID NO: 1847 - DNA, 23 bp, Homo sapiens
ggacagacgcaaggaagaaaagg

SEQ ID NO: 1848 - DNA, 23 bp, Homo sapiens
gaatatacagatgttgccacagg

SEQ ID NO: 1849 - DNA, 23 bp, Homo sapiens
acggggctcctctgacctgatgg

SEQ ID NO: 1850 - DNA, 23 bp, Homo sapiens
taccttcatacccatctgatggg

SEQ ID NO: 1851 - DNA, 23 bp, Homo sapiens
atctggcctcagacaactactgg

SEQ ID NO: 1852 - DNA, 23 bp, Homo sapiens
cagtcttgcaacagttgaccggg

SEQ ID NO: 1853 - DNA, 23 bp, Homo sapiens
tgttctccaccgaagtctaaagg

SEQ ID NO: 1854 - DNA, 23 bp, Homo sapiens
gagtctctgaggaggtgatcagg

SEQ ID NO: 1855 - DNA, 23 bp, Homo sapiens
gccacagcgagactcttcagcgg

SEQ ID NO: 1856 - DNA, 23 bp, Homo sapiens
ctgtcatcattgatggaggctgg

SEQ ID NO: 1857 - DNA, 23 bp, Homo sapiens
aaatcttccaacttttctggcgg

SEQ ID NO: 1858 - DNA, 23 bp, Homo sapiens
acaaactgcaggactgggcaggg

SEQ ID NO: 1859 - DNA, 23 bp, Homo sapiens
ccattaaaaggggaagatagtgg

SEQ ID NO: 1860 - DNA, 23 bp, Homo sapiens
aaagcgggcccctcaaggggagg

SEQ ID NO: 1861 - DNA, 23 bp, Homo sapiens
catggcactgggggccctagagg

SEQ ID NO: 1862 - DNA, 23 bp, Homo sapiens
gcccagagaggattgtgtgaggg

SEQ ID NO: 1863 - DNA, 23 bp, Homo sapiens
gtctctgacagacaaatctaagg

SEQ ID NO: 1864 - DNA, 23 bp, Homo sapiens
tcttaagtggggtcttgcttggg

SEQ ID NO: 1865 - DNA, 23 bp, Homo sapiens
gtctcatctgggttgcctcaagg

SEQ ID NO: 1866 - DNA, 23 bp, Homo sapiens
cgcaggcgctcagttgagcaagg

SEQ ID NO: 1867 - DNA, 23 bp, Homo sapiens
actctatgtgtaacaaacctcgg

SEQ ID NO: 1868 - DNA, 23 bp, Homo sapiens
cactgacccaagcacctgaacgg

SEQ ID NO: 1869 - DNA, 23 bp, Homo sapiens
caaagaaagtggagaagtgaagg

SEQ ID NO: 1870 - DNA, 23 bp, Homo sapiens
aggatggatctggggattagtgg

SEQ ID NO: 1871 - DNA, 23 bp, Homo sapiens
actcatgcggccttgggaaaagg

SEQ ID NO: 1872 - DNA, 23 bp, Homo sapiens
acagatgtacttgttgactttgg

SEQ ID NO: 1873 - DNA, 23 bp, Homo sapiens
acttcattctgattcatagctgg

SEQ ID NO: 1874 - DNA, 23 bp, Homo sapiens
cagccgacttcgacagtctttgg

SEQ ID NO: 1875 - DNA, 23 bp, Homo sapiens
gacagtgatgaaagactggacgg

SEQ ID NO: 1876 - DNA, 23 bp, Homo sapiens
gagagaggcaagagatgtgaagg

SEQ ID NO: 1877 - DNA, 23 bp, Homo sapiens
cttattgggccttggaaaacagg

SEQ ID NO: 1878 - DNA, 23 bp, Homo sapiens
ggaccaggtgaaggaagatgagg

SEQ ID NO: 1879 - DNA, 23 bp, Homo sapiens
tggcgaggaggaggagaatctgg

SEQ ID NO: 1880 - DNA, 23 bp, Homo sapiens
agaacttggtggcactcatttgg

SEQ ID NO: 1881 - DNA, 23 bp, Homo sapiens
agagtgatcctggtggttaaagg

SEQ ID NO: 1882 - DNA, 23 bp, Homo sapiens
ctctgcatctcaaaacttgaagg

SEQ ID NO: 1883 - DNA, 23 bp, Homo sapiens
gacgaggccctggagccctgagg

SEQ ID NO: 1884 - DNA, 23 bp, Homo sapiens
tatagcacagcagctttgtttgg

SEQ ID NO: 1885 - DNA, 23 bp, Homo sapiens
tcccactaagtttccttacatgg

SEQ ID NO: 1886 - DNA, 23 bp, Homo sapiens
acctccgtttctggggaatgtgg

SEQ ID NO: 1887 - DNA, 23 bp, Homo sapiens
ccatcaggattcagggcataagg

SEQ ID NO: 1888 - DNA, 23 bp, Homo sapiens
atggcaggagtcaaggcataagg

SEQ ID NO: 1889 - DNA, 23 bp, Homo sapiens
tcataatggttgtcaggttcagg

SEQ ID NO: 1890 - DNA, 23 bp, Homo sapiens
acctcaagattcaaggcataagg

SEQ ID NO: 1891 - DNA, 23 bp, Homo sapiens
ggaaacccaggtgttgtgactgg

SEQ ID NO: 1892 - DNA, 23 bp, Homo sapiens
aagtcagacaagaagaaatcagg

SEQ ID NO: 1893 - DNA, 23 bp, Homo sapiens
ctgctggacagggaggagagcgg

SEQ ID NO: 1894 - DNA, 23 bp, Homo sapiens
agcagagcgacaccctagaccgg

SEQ ID NO: 1895 - DNA, 23 bp, Homo sapiens
ttggcaactacaaaaagtagagg

SEQ ID NO: 1896 - DNA, 23 bp, Homo sapiens
ctgggcgctaggtgccctctcgg

SEQ ID NO: 1897 - DNA, 23 bp, Homo sapiens
ggagcgcggatggcccatcccgg

SEQ ID NO: 1898 - DNA, 23 bp, Homo sapiens
tacactcatggccattttcaggg

SEQ ID NO: 1899 - DNA, 23 bp, Homo sapiens
cagcctctgcaaacagtgcacgg

SEQ ID NO: 1900 - DNA, 23 bp, Homo sapiens
gtgacagtgtttgcaaagcgcgg

SEQ ID NO: 1901 - DNA, 23 bp, Homo sapiens
cccctagagagtttagtctttgg

SEQ ID NO: 1902 - DNA, 23 bp, Homo sapiens
attcagggagcttcctttcctgg

SEQ ID NO: 1903 - DNA, 23 bp, Homo sapiens
cccccgcacctccagtgagaggg

SEQ ID NO: 1904 - DNA, 23 bp, Homo sapiens
tttcagctgctgctcagttgtgg

SEQ ID NO: 1905 - DNA, 23 bp, Homo sapiens
ctgtcaaagccagacttctaagg

SEQ ID NO: 1906 - DNA, 23 bp, Homo sapiens
caagagggtgctgctaccagcgg

SEQ ID NO: 1907 - DNA, 23 bp, Homo sapiens
cacagtgctcacaactagccggg

SEQ ID NO: 1908 - DNA, 23 bp, Homo sapiens
ccacaggagatgaagactagggg

SEQ ID NO: 1909 - DNA, 23 bp, Homo sapiens
acagcatttactgtgattagggg

SEQ ID NO: 1910 - DNA, 23 bp, Homo sapiens
ggtgtggctggcttggtcttcgg

SEQ ID NO: 1911 - DNA, 23 bp, Homo sapiens
aacgactcttctcattcttcagg

SEQ ID NO: 1912 - DNA, 23 bp, Homo sapiens
acctcttccgaaggacctgacgg

SEQ ID NO: 1913 - DNA, 23 bp, Homo sapiens
ggaggcggcccggtgttatctgg

SEQ ID NO: 1914 - DNA, 23 bp, Homo sapiens
actgctgctattaacactctagg

SEQ ID NO: 1915 - DNA, 23 bp, Homo sapiens
tctggctaagctcctcacgtagg

SEQ ID NO: 1916 - DNA, 23 bp, Homo sapiens
ctgcacctgctgctcaagtgagg

SEQ ID NO: 1917 - DNA, 23 bp, Homo sapiens
tgcctgggccccgccgtcatggg

SEQ ID NO: 1918 - DNA, 23 bp, Homo sapiens
gtagtttctcttcagagttgtgg

SEQ ID NO: 1919 - DNA, 23 bp, Homo sapiens
agtgacggggattcagtcatcgg

SEQ ID NO: 1920 - DNA, 23 bp, Homo sapiens
atttgcaggggtataatcaaggg

SEQ ID NO: 1921 - DNA, 23 bp, Homo sapiens
catactactagatgaccacaagg

SEQ ID NO: 1922 - DNA, 23 bp, Homo sapiens
gggccccttagcaatgtcttagg

SEQ ID NO: 1923 - DNA, 23 bp, Homo sapiens
cagctggctgccatggattgagg

SEQ ID NO: 1924 - DNA, 23 bp, Homo sapiens
acatcaatgcagctcataactgg

SEQ ID NO: 1925 - DNA, 23 bp, Homo sapiens
cgtgcgcaccttcctgtcctagg

SEQ ID NO: 1926 - DNA, 23 bp, Homo sapiens
cagatgtcccatgtgcagcgcgg

SEQ ID NO: 1927 - DNA, 23 bp, Homo sapiens
agggttacagtgattacgatggg

SEQ ID NO: 1928 - DNA, 23 bp, Homo sapiens
ccggcgttgtgggcacctaacgg

SEQ ID NO: 1929 - DNA, 23 bp, Homo sapiens
tcctaactcactccttttacagg

SEQ ID NO: 1930 - DNA, 23 bp, Homo sapiens
gtacgagctgcagccctagccgg

SEQ ID NO: 1931 - DNA, 23 bp, Homo sapiens
aacggtctatttataggcttcgg

SEQ ID NO: 1932 - DNA, 23 bp, Homo sapiens
atgggaccccatgggagctttgg

SEQ ID NO: 1933 - DNA, 23 bp, Homo sapiens
tttaactgcatacttcagtctgg

SEQ ID NO: 1934 - DNA, 23 bp, Homo sapiens
ggagggaacaggggctaggaagg

SEQ ID NO: 1935 - DNA, 23 bp, Homo sapiens
cttctccagcttcttgtacttgg

SEQ ID NO: 1936 - DNA, 23 bp, Homo sapiens
tagaatcatggctaggcccgcgg

SEQ ID NO: 1937 - DNA, 23 bp, Homo sapiens
gtgaaaggcctcagctctgacgg

SEQ ID NO: 1938 - DNA, 23 bp, Homo sapiens
acaatatgctgagatggagaagg

SEQ ID NO: 1939 - DNA, 23 bp, Homo sapiens
gtttctcactagctactaagtgg

SEQ ID NO: 1940 - DNA, 23 bp, Homo sapiens
taaacactatcatgccaagttgg

SEQ ID NO: 1941 - DNA, 23 bp, Homo sapiens
taactgccagaccagccaaaagg

SEQ ID NO: 1942 - DNA, 23 bp, Homo sapiens
ttgctgttcaaggaagtaagagg

SEQ ID NO: 1943 - DNA, 23 bp, Homo sapiens
agatggggacagagtgctactgg

SEQ ID NO: 1944 - DNA, 23 bp, Homo sapiens
aaagggcaatcagttctccccgg

SEQ ID NO: 1945 - DNA, 23 bp, Homo sapiens
tgagtactactctttacgtctgg

SEQ ID NO: 1946 - DNA, 23 bp, Homo sapiens
acggggcaggccctaggtgaggg

SEQ ID NO: 1947 - DNA, 23 bp, Homo sapiens
agtcctttttcatacctagtggg

SEQ ID NO: 1948 - DNA, 23 bp, Homo sapiens
gggtcatcagcaacttcttctgg

SEQ ID NO: 1949 - DNA, 23 bp, Homo sapiens
gcagtggtcacttcctgctgtgg

SEQ ID NO: 1950 - DNA, 23 bp, Homo sapiens
ggaggcctggcaggcctcactgg

SEQ ID NO: 1951 - DNA, 23 bp, Homo sapiens
cttctatctacagccacattcgg

SEQ ID NO: 1952 - DNA, 23 bp, Homo sapiens
tccttatgattgaggcaaatggg

SEQ ID NO: 1953 - DNA, 23 bp, Homo sapiens
acatggttgtggagggttgtggg

SEQ ID NO: 1954 - DNA, 23 bp, Homo sapiens
ggaaatggagcagcaccaaatgg

SEQ ID NO: 1955 - DNA, 23 bp, Homo sapiens
atcaagtaagggacacttgaagg

SEQ ID NO: 1956 - DNA, 23 bp, Homo sapiens
tcttgcgcttgcagataacctgg

SEQ ID NO: 1957 - DNA, 23 bp, Homo sapiens
caaggactgcctgatctcagcgg

SEQ ID NO: 1958 - DNA, 23 bp, Homo sapiens
aatatggtagtacgctcatgtgg

SEQ ID NO: 1959 - DNA, 23 bp, Homo sapiens
tccagaatgtccagtgttggagg

SEQ ID NO: 1960 - DNA, 23 bp, Homo sapiens
agcatctggtttcgagttagtgg

SEQ ID NO: 1961 - DNA, 23 bp, Homo sapiens
tgaattctcggaggagctagtgg

SEQ ID NO: 1962 - DNA, 23 bp, Homo sapiens
ggctgggcgggctgactcagtgg

SEQ ID NO: 1963 - DNA, 23 bp, Homo sapiens
ggccgggcgggtggactcagtgg

SEQ ID NO: 1964 - DNA, 23 bp, Homo sapiens
atcgaaacaaaggtcaccgctgg

SEQ ID NO: 1965 - DNA, 23 bp, Homo sapiens
atcttgggattcaaccatcttgg

SEQ ID NO: 1966 - DNA, 23 bp, Homo sapiens
ccaggacattaaactctgatagg

SEQ ID NO: 1967 - DNA, 23 bp, Homo sapiens
accatggtgtctaaagatatagg

SEQ ID NO: 1968 - DNA, 23 bp, Homo sapiens
gtccaaaggctcactgcaattgg

SEQ ID NO: 1969 - DNA, 23 bp, Homo sapiens
gggtcttctagctcatagaaagg

SEQ ID NO: 1970 - DNA, 23 bp, Homo sapiens
tgcttgtctttttcccgaagtgg

SEQ ID NO: 1971 - DNA, 23 bp, Homo sapiens
ttggtttgccatcttgttactgg

SEQ ID NO: 1972 - DNA, 23 bp, Homo sapiens
agactaatctactgaagtgaagg

SEQ ID NO: 1973 - DNA, 23 bp, Homo sapiens
tgcaggctgtctcgatgtcctgg

SEQ ID NO: 1974 - DNA, 23 bp, Homo sapiens
cctttgggatctcacaaaaatgg

SEQ ID NO: 1975 - DNA, 23 bp, Homo sapiens
cttgtccccatggaatacgttgg

SEQ ID NO: 1976 - DNA, 23 bp, Homo sapiens
gactccagttcttcatcaaaagg

SEQ ID NO: 1977 - DNA, 23 bp, Homo sapiens
ggcttttcctttccctcagtagg

SEQ ID NO: 1978 - DNA, 23 bp, Homo sapiens
gggatctccatggctcaggaggg

SEQ ID NO: 1979 - DNA, 23 bp, Homo sapiens
gtaacaagaggcagcatgaatgg

SEQ ID NO: 1980 - DNA, 23 bp, Homo sapiens
aacaccacctctcacaatttagg

SEQ ID NO: 1981 - DNA, 23 bp, Homo sapiens
attagctttcaaaaggtgtctgg

SEQ ID NO: 1982 - DNA, 23 bp, Homo sapiens
tatcgcttcgcttttttcacagg

SEQ ID NO: 1983 - DNA, 23 bp, Homo sapiens
tcttaggaagtgtcctgagacgg

SEQ ID NO: 1984 - DNA, 23 bp, Homo sapiens
aggtgggcagctcatctctctgg

SEQ ID NO: 1985 - DNA, 23 bp, Homo sapiens
ctccctctcttggggttcagggg

SEQ ID NO: 1986 - DNA, 23 bp, Homo sapiens
ggtcagggttttctgttcaaagg

SEQ ID NO: 1987 - DNA, 23 bp, Homo sapiens
cacgtgagcgacagaaatgaggg

SEQ ID NO: 1988 - DNA, 23 bp, Homo sapiens
ctcagtgccctgactacaattgg

SEQ ID NO: 1989 - DNA, 23 bp, Homo sapiens
atgtcagtgaagttcatccaagg

SEQ ID NO: 1990 - DNA, 23 bp, Homo sapiens
gccagggcgtggtcagcgtttgg

SEQ ID NO: 1991 - DNA, 23 bp, Homo sapiens
attggctcaggctgcatcacagg

SEQ ID NO: 1992 - DNA, 23 bp, Homo sapiens
cacaacgggcagcttctagctgg

SEQ ID NO: 1993 - DNA, 23 bp, Homo sapiens
ggcagaacagctaggtgaagagg

SEQ ID NO: 1994 - DNA, 23 bp, Homo sapiens
tatggactgctgcattgaaaagg

SEQ ID NO: 1995 - DNA, 23 bp, Homo sapiens
tgaagcccgaccgcgagctcagg

SEQ ID NO: 1996 - DNA, 23 bp, Homo sapiens
gaggccctgtgcaagtgaccagg

SEQ ID NO: 1997 - DNA, 23 bp, Homo sapiens
tgaacagtcatcggatctacagg

SEQ ID NO: 1998 - DNA, 23 bp, Homo sapiens
tctcttccaggatcaggctgagg

SEQ ID NO: 1999 - DNA, 23 bp, Homo sapiens
gcggtcccaggagctacctgtgg

SEQ ID NO: 2000 - DNA, 23 bp, Homo sapiens
gcggaggggggcgtcactgttgg

SEQ ID NO: 2001 - DNA, 23 bp, Homo sapiens
ctactttcttaatggctgcttgg

SEQ ID NO: 2002 - DNA, 23 bp, Homo sapiens
ggagtgtgcattctcattgtagg

SEQ ID NO: 2003 - DNA, 23 bp, Homo sapiens
caacgtctgcaccgaacagcagg

SEQ ID NO: 2004 - DNA, 23 bp, Homo sapiens
cggactacagtttgtcatcaagg

SEQ ID NO: 2005 - DNA, 23 bp, Homo sapiens
ctgcaaaccctcatctgaagagg

SEQ ID NO: 2006 - DNA, 23 bp, Homo sapiens
tctgatcagcagaagtcagctgg

SEQ ID NO: 2007 - DNA, 23 bp, Homo sapiens
gctgccatccaagtcttcactgg

SEQ ID NO: 2008 - DNA, 23 bp, Homo sapiens
ggactcttctaccagagctgagg

SEQ ID NO: 2009 - DNA, 23 bp, Homo sapiens
gtgctgaccgtggcatcctgagg

SEQ ID NO: 2010 - DNA, 23 bp, Homo sapiens
ctcatgcgctcagcaccaaaagg

SEQ ID NO: 2011 - DNA, 23 bp, Homo sapiens
ctgatgctggacttgaagctggg

SEQ ID NO: 2012 - DNA, 23 bp, Homo sapiens
aattgcaaaccggcaatcaaggg

SEQ ID NO: 2013 - DNA, 23 bp, Homo sapiens
gtagtcataattcctcagtgtgg

SEQ ID NO: 2014 - DNA, 23 bp, Homo sapiens
tgaaaggcttcaaagctagcagg

SEQ ID NO: 2015 - DNA, 23 bp, Homo sapiens
gcacaattacttctgtgatctgg

SEQ ID NO: 2016 - DNA, 23 bp, Homo sapiens
ctctcactcatttgtttcagtgg

SEQ ID NO: 2017 - DNA, 23 bp, Homo sapiens
aggaagggccgcagcaagagggg

SEQ ID NO: 2018 - DNA, 23 bp, Homo sapiens
tggttctgctcagtagcagtcgg

SEQ ID NO: 2019 - DNA, 23 bp, Homo sapiens
gatgcctggacagaggacaatgg

SEQ ID NO: 2020 - DNA, 23 bp, Homo sapiens
tggctggctgcagtcagtagtgg

SEQ ID NO: 2021 - DNA, 23 bp, Homo sapiens
tttctcacattcttccgtactgg

SEQ ID NO: 2022 - DNA, 23 bp, Homo sapiens
gcaaaaccaacagcatttgcagg

SEQ ID NO: 2023 - DNA, 23 bp, Homo sapiens
acctcagtgacattgactgacgg

SEQ ID NO: 2024 - DNA, 23 bp, Homo sapiens
tgattcagactcaggctaagggg

SEQ ID NO: 2025 - DNA, 23 bp, Homo sapiens
agcagtgactcagaatgaactgg

SEQ ID NO: 2026 - DNA, 23 bp, Homo sapiens
gagtgtgctcgttgctgtgttgg

SEQ ID NO: 2027 - DNA, 23 bp, Homo sapiens
actctggaaattcatgtcaatgg

SEQ ID NO: 2028 - DNA, 23 bp, Homo sapiens
tccgtgtccaatgattaggcagg

SEQ ID NO: 2029 - DNA, 23 bp, Homo sapiens
tgtggacctggtggaagttgagg

SEQ ID NO: 2030 - DNA, 23 bp, Homo sapiens
ggaaaacctgttttctaacctgg

SEQ ID NO: 2031 - DNA, 23 bp, Homo sapiens
tatctgcttcaatggcacagcgg

SEQ ID NO: 2032 - DNA, 23 bp, Homo sapiens
ggtggtctagagttaggtcttgg

SEQ ID NO: 2033 - DNA, 23 bp, Homo sapiens
actttgaagggtcatatcaatgg

SEQ ID NO: 2034 - DNA, 23 bp, Homo sapiens
gttttggtctgtaggatgagggg

SEQ ID NO: 2035 - DNA, 23 bp, Homo sapiens
tgtgatggcgatgaggacgacgg

SEQ ID NO: 2036 - DNA, 23 bp, Homo sapiens
gtgtccctaaccctccctgatgg

SEQ ID NO: 2037 - DNA, 23 bp, Homo sapiens
aatcaggtacagactctcaaagg

SEQ ID NO: 2038 - DNA, 23 bp, Homo sapiens
tggagccaccttcgcttaaaggg

SEQ ID NO: 2039 - DNA, 23 bp, Homo sapiens
accgctccaaggacaagtgaagg

SEQ ID NO: 2040 - DNA, 23 bp, Homo sapiens
gccaggtcgggggctcagtctgg

SEQ ID NO: 2041 - DNA, 23 bp, Homo sapiens
acagccaaactctgctaacccgg

SEQ ID NO: 2042 - DNA, 23 bp, Homo sapiens
cggcaaactctgtagctaatggg

SEQ ID NO: 2043 - DNA, 23 bp, Homo sapiens
tgccaaattgccaaacacaatgg

SEQ ID NO: 2044 - DNA, 23 bp, Homo sapiens
tggataaatgaactggaactggg

SEQ ID NO: 2045 - DNA, 23 bp, Homo sapiens
tgaaacagaggatggacagtggg

SEQ ID NO: 2046 - DNA, 23 bp, Homo sapiens
aatagagtacattgaagctcggg

SEQ ID NO: 2047 - DNA, 23 bp, Homo sapiens
gcctggtcaggtcagctccacgg

SEQ ID NO: 2048 - DNA, 23 bp, Homo sapiens
cctcagaagagaaaatcggatgg

SEQ ID NO: 2049 - DNA, 23 bp, Homo sapiens
tacatttcacagctacagaaagg

SEQ ID NO: 2050 - DNA, 23 bp, Homo sapiens
tcaaacctcaaaaggacactggg

SEQ ID NO: 2051 - DNA, 23 bp, Homo sapiens
acaggtttcacttcttcttctgg

SEQ ID NO: 2052 - DNA, 23 bp, Homo sapiens
gcagtatcaatcactatcgctgg

SEQ ID NO: 2053 - DNA, 23 bp, Homo sapiens
aggcccagccctgcccttacagg

SEQ ID NO: 2054 - DNA, 23 bp, Homo sapiens
gtgtagtgtgaagcaggcagagg

SEQ ID NO: 2055 - DNA, 23 bp, Homo sapiens
gccccgtggggtcagggcagagg

SEQ ID NO: 2056 - DNA, 23 bp, Homo sapiens
agtgtgtctaaggctgctcgcgg

SEQ ID NO: 2057 - DNA, 23 bp, Homo sapiens
aggtgacatgttaacttttcggg

SEQ ID NO: 2058 - DNA, 23 bp, Homo sapiens
tcagaggctactctcgtagctgg

SEQ ID NO: 2059 - DNA, 23 bp, Homo sapiens
ggctttccctcaaggtcataagg

SEQ ID NO: 2060 - DNA, 23 bp, Homo sapiens
tctttgctacgtacagcaaaagg

SEQ ID NO: 2061 - DNA, 23 bp, Homo sapiens
ttttaagggggttcagatcctgg

SEQ ID NO: 2062 - DNA, 23 bp, Homo sapiens
gggttagccatctcatgggatgg

SEQ ID NO: 2063 - DNA, 23 bp, Homo sapiens
agctcctcttctccgctcagggg

SEQ ID NO: 2064 - DNA, 23 bp, Homo sapiens
ttttcttcaggaactagagcagg

SEQ ID NO: 2065 - DNA, 23 bp, Homo sapiens
agtgggaggactgggagtgaggg

SEQ ID NO: 2066 - DNA, 23 bp, Homo sapiens
ctgctcctgtctgaggtgacagg

SEQ ID NO: 2067 - DNA, 23 bp, Homo sapiens
cgccagaggaactcttcctgagg

SEQ ID NO: 2068 - DNA, 23 bp, Homo sapiens
tgggcatggtcaccagaatgagg

SEQ ID NO: 2069 - DNA, 23 bp, Homo sapiens
gagcacaaacatctcagccttgg

SEQ ID NO: 2070 - DNA, 23 bp, Homo sapiens
tcggtccttgttaaaattcttgg

SEQ ID NO: 2071 - DNA, 23 bp, Homo sapiens
aggacatacggatcgatgagagg

SEQ ID NO: 2072 - DNA, 23 bp, Homo sapiens
ttcctgtggccagaggtcagcgg

SEQ ID NO: 2073 - DNA, 23 bp, Homo sapiens
ttccaggactcaactgtaactgg

SEQ ID NO: 2074 - DNA, 23 bp, Homo sapiens
ctcactgcagcagagcgctgagg

SEQ ID NO: 2075 - DNA, 23 bp, Homo sapiens
acgagggggagctgggctcaggg

SEQ ID NO: 2076 - DNA, 23 bp, Homo sapiens
gtatgattcagagtacagcctgg

SEQ ID NO: 2077 - DNA, 23 bp, Homo sapiens
aatggcacttcaatagaagatgg

SEQ ID NO: 2078 - DNA, 23 bp, Homo sapiens
acattgggcaggatctctatggg

SEQ ID NO: 2079 - DNA, 23 bp, Homo sapiens
gaagatcagcatcacagcattgg

SEQ ID NO: 2080 - DNA, 23 bp, Homo sapiens
gcactaggcgtttcataccacgg

SEQ ID NO: 2081 - DNA, 23 bp, Homo sapiens
tctggaaactgtcaagatgctgg

SEQ ID NO: 2082 - DNA, 23 bp, Homo sapiens
tcccagaccccgaggctacttgg

SEQ ID NO: 2083 - DNA, 23 bp, Homo sapiens
ttcctcagagtcagaaacagagg

SEQ ID NO: 2084 - DNA, 23 bp, Homo sapiens
cccggcgttggatcatttgaagg

SEQ ID NO: 2085 - DNA, 23 bp, Homo sapiens
cgaggtcatcttctacacctagg

SEQ ID NO: 2086 - DNA, 23 bp, Homo sapiens
atggcactggggtacagggaggg

SEQ ID NO: 2087 - DNA, 23 bp, Homo sapiens
gagctcattttctatgcctgagg

SEQ ID NO: 2088 - DNA, 23 bp, Homo sapiens
gacttggaggttgctctcagagg

SEQ ID NO: 2089 - DNA, 23 bp, Homo sapiens
gtttgaaagctctgctgcacagg

SEQ ID NO: 2090 - DNA, 23 bp, Homo sapiens
agacaacttttctgaatctcagg

SEQ ID NO: 2091 - DNA, 23 bp, Homo sapiens
aggcccgctgcctcctttattgg

SEQ ID NO: 2092 - DNA, 23 bp, Homo sapiens
agaagaagaaatggaaactctgg

SEQ ID NO: 2093 - DNA, 23 bp, Homo sapiens
agttaacatgtcacagcttctgg

SEQ ID NO: 2094 - DNA, 23 bp, Homo sapiens
gcgcttgtatgagagggactagg

SEQ ID NO: 2095 - DNA, 23 bp, Homo sapiens
tgatgaggcttccaagaatgagg

SEQ ID NO: 2096 - DNA, 23 bp, Homo sapiens
aaaaccagaagacattgatgagg

SEQ ID NO: 2097 - DNA, 23 bp, Homo sapiens
tgtaaggaggaacttctcttggg

SEQ ID NO: 2098 - DNA, 23 bp, Homo sapiens
cgggggcggaagggcctagctgg

SEQ ID NO: 2099 - DNA, 23 bp, Homo sapiens
tagtgaggtgctaacatgtgagg

SEQ ID NO: 2100 - DNA, 23 bp, Homo sapiens
caggcctgctatgcaccggctgg

SEQ ID NO: 2101 - DNA, 23 bp, Homo sapiens
ataccatcatgtacagttgctgg

SEQ ID NO: 2102 - DNA, 23 bp, Homo sapiens
aatatgcatccatatgtgtgagg

SEQ ID NO: 2103 - DNA, 23 bp, Homo sapiens
cccagccaaggggcaccttaagg

SEQ ID NO: 2104 - DNA, 23 bp, Homo sapiens
agaagaacattcttacatgctgg

SEQ ID NO: 2105 - DNA, 23 bp, Homo sapiens
ggaattgattctataggctctgg

SEQ ID NO: 2106 - DNA, 23 bp, Homo sapiens
tctctcagtttgagaagaattgg

SEQ ID NO: 2107 - DNA, 23 bp, Homo sapiens
atgtcaacctgactggattaagg

SEQ ID NO: 2108 - DNA, 23 bp, Homo sapiens
gagaagtctcagaaagctgaagg

SEQ ID NO: 2109 - DNA, 23 bp, Homo sapiens
agagggtggagaaagctgaaggg

SEQ ID NO: 2110 - DNA, 23 bp, Homo sapiens
ctctcttcttcttttcacgctgg

SEQ ID NO: 2111 - DNA, 23 bp, Homo sapiens
gtgaggaaatgcttcagatgagg

SEQ ID NO: 2112 - DNA, 23 bp, Homo sapiens
agagcatcaggctgacttattgg

SEQ ID NO: 2113 - DNA, 23 bp, Homo sapiens
caatcagaaccataagctacagg

SEQ ID NO: 2114 - DNA, 23 bp, Homo sapiens
gtgaggacagaactgaatagagg

SEQ ID NO: 2115 - DNA, 23 bp, Homo sapiens
ctcttttcagctcctcttcctgg

SEQ ID NO: 2116 - DNA, 23 bp, Homo sapiens
gtcttctctgtctcatccccagg

SEQ ID NO: 2117 - DNA, 23 bp, Homo sapiens
agatcagaaacgcagagcttcgg

SEQ ID NO: 2118 - DNA, 23 bp, Homo sapiens
cctccccaggggtgaaatgtagg

SEQ ID NO: 2119 - DNA, 23 bp, Homo sapiens
cccgccctggactggtggtgagg

SEQ ID NO: 2120 - DNA, 23 bp, Homo sapiens
ctatgcattcagtgttgttgtgg

SEQ ID NO: 2121 - DNA, 23 bp, Homo sapiens
atgtaggtgtatgttcgagaagg

SEQ ID NO: 2122 - DNA, 23 bp, Homo sapiens
agattagggccctacgtaatagg

SEQ ID NO: 2123 - DNA, 23 bp, Homo sapiens
cactgaaagagcaaagccccagg

SEQ ID NO: 2124 - DNA, 23 bp, Homo sapiens
actttcacaggatgattaggtgg

SEQ ID NO: 2125 - DNA, 23 bp, Homo sapiens
ttgtttctgcatctgtcacttgg

SEQ ID NO: 2126 - DNA, 23 bp, Homo sapiens
tgcctacaaatggagtgttgagg

SEQ ID NO: 2127 - DNA, 23 bp, Homo sapiens
accgcgtggtgacttagaagcgg

SEQ ID NO: 2128 - DNA, 23 bp, Homo sapiens
tgtcgtggctgctctggctgagg

SEQ ID NO: 2129 - DNA, 23 bp, Homo sapiens
tctctgatcaaggcagctgatgg

SEQ ID NO: 2130 - DNA, 23 bp, Homo sapiens
gttcccatcaccgtggagtgagg

SEQ ID NO: 2131 - DNA, 23 bp, Homo sapiens
tctgaatctgaagctgaagaagg

SEQ ID NO: 2132 - DNA, 23 bp, Homo sapiens
agaatccgaatcggaaggtgagg

SEQ ID NO: 2133 - DNA, 23 bp, Homo sapiens
tggggaggggtcagagttcatgg

SEQ ID NO: 2134 - DNA, 23 bp, Homo sapiens
gacctctcctcacaacgcgaggg

SEQ ID NO: 2135 - DNA, 23 bp, Homo sapiens
tttctcaatctcctcactgttgg

SEQ ID NO: 2136 - DNA, 23 bp, Homo sapiens
ggagagccgagaagggcctgagg

SEQ ID NO: 2137 - DNA, 23 bp, Homo sapiens
tgaacttttcttttatgccctgg

SEQ ID NO: 2138 - DNA, 23 bp, Homo sapiens
gcctggaagaagagagtatctgg

SEQ ID NO: 2139 - DNA, 23 bp, Homo sapiens
agttgaacaagcaccgtttttgg

SEQ ID NO: 2140 - DNA, 23 bp, Homo sapiens
aaaagagaagtcattcctcgagg

SEQ ID NO: 2141 - DNA, 23 bp, Homo sapiens
agcacgcctgggggcctcagtgg

SEQ ID NO: 2142 - DNA, 23 bp, Homo sapiens
agtcattcctcgaggttaatagg

SEQ ID NO: 2143 - DNA, 23 bp, Homo sapiens
catcatggagggcctatttaagg

SEQ ID NO: 2144 - DNA, 23 bp, Homo sapiens
tgcacaggtgattgagctgtagg

SEQ ID NO: 2145 - DNA, 23 bp, Homo sapiens
ttggtgaatttgcacagatctgg

SEQ ID NO: 2146 - DNA, 23 bp, Homo sapiens
ggtgctgggatgcgctgctgtgg

SEQ ID NO: 2147 - DNA, 23 bp, Homo sapiens
gctggtcagatgactgagcacgg

SEQ ID NO: 2148 - DNA, 23 bp, Homo sapiens
tacacattggtgcgtaagagtgg

SEQ ID NO: 2149 - DNA, 23 bp, Homo sapiens
tctgtcctgtcgatttcagtagg

SEQ ID NO: 2150 - DNA, 23 bp, Homo sapiens
ggaggggctgctcagggagctgg

SEQ ID NO: 2151 - DNA, 23 bp, Homo sapiens
cagatctagtgtctgcgattagg

SEQ ID NO: 2152 - DNA, 23 bp, Homo sapiens
ctcaatgtttggtttcacagtgg

SEQ ID NO: 2153 - DNA, 23 bp, Homo sapiens
gatgccatagctgttatcaaagg

SEQ ID NO: 2154 - DNA, 23 bp, Homo sapiens
aactcaagaaatgccttctgtgg

SEQ ID NO: 2155 - DNA, 23 bp, Homo sapiens
gagttctccactatctcctgagg

SEQ ID NO: 2156 - DNA, 23 bp, Homo sapiens
tcctccgcaaagtatgcagaagg

SEQ ID NO: 2157 - DNA, 23 bp, Homo sapiens
tggtttcagatgtgccttcttgg

SEQ ID NO: 2158 - DNA, 23 bp, Homo sapiens
tctggagaaagactttcaaatgg

SEQ ID NO: 2159 - DNA, 23 bp, Homo sapiens
aggcattttttggaagaaagagg

SEQ ID NO: 2160 - DNA, 23 bp, Homo sapiens
ccagctccttcaaaggaatgcgg

SEQ ID NO: 2161 - DNA, 23 bp, Homo sapiens
gcggccttcgaagcctgaagcgg

SEQ ID NO: 2162 - DNA, 23 bp, Homo sapiens
ggccgccccaggaagagcaaggg

SEQ ID NO: 2163 - DNA, 23 bp, Homo sapiens
ctttgggagtgctacacctgtgg

SEQ ID NO: 2164 - DNA, 23 bp, Homo sapiens
ttttctgtgcatttgtatcgggg

SEQ ID NO: 2165 - DNA, 23 bp, Homo sapiens
cctcagggctcttagtctaacgg

SEQ ID NO: 2166 - DNA, 23 bp, Homo sapiens
aaagggtccctgtctcaggaagg

SEQ ID NO: 2167 - DNA, 23 bp, Homo sapiens
gcggactcagaaatgtgaggggg

SEQ ID NO: 2168 - DNA, 23 bp, Homo sapiens
ggatcgtgttctacttcatgtgg

SEQ ID NO: 2169 - DNA, 23 bp, Homo sapiens
gtcgtcactgtcgaactctgagg

SEQ ID NO: 2170 - DNA, 23 bp, Homo sapiens
ggcaccattgctctccagcctgg

SEQ ID NO: 2171 - DNA, 23 bp, Homo sapiens
gcaaggagacagggctagttagg

SEQ ID NO: 2172 - DNA, 23 bp, Homo sapiens
acagacgagtcggagacttgagg

SEQ ID NO: 2173 - DNA, 23 bp, Homo sapiens
caatggatgaagagctggaacgg

SEQ ID NO: 2174 - DNA, 23 bp, Homo sapiens
cggtgggagcccagagagtgagg

SEQ ID NO: 2175 - DNA, 23 bp, Homo sapiens
tcctcccaagcgctcacaccagg

SEQ ID NO: 2176 - DNA, 23 bp, Homo sapiens
atgccgcagagcttattgagggg

SEQ ID NO: 2177 - DNA, 23 bp, Homo sapiens
ccaaaagagacgcattcaattgg

SEQ ID NO: 2178 - DNA, 23 bp, Homo sapiens
agctcagaggatgactaaatggg

SEQ ID NO: 2179 - DNA, 23 bp, Homo sapiens
gtttgggagttatgaaccactgg

SEQ ID NO: 2180 - DNA, 23 bp, Homo sapiens
atgttgtctatacgatgtgaagg

SEQ ID NO: 2181 - DNA, 23 bp, Homo sapiens
ctaagtttactggctccaaaagg

SEQ ID NO: 2182 - DNA, 23 bp, Homo sapiens
aattgctacaagcaactcttcgg

SEQ ID NO: 2183 - DNA, 23 bp, Homo sapiens
tcatttcagacttaccattgggg

SEQ ID NO: 2184 - DNA, 23 bp, Homo sapiens
ttaacgcctgattctacttatgg

SEQ ID NO: 2185 - DNA, 23 bp, Homo sapiens
acaacgtggaactgacctagagg

SEQ ID NO: 2186 - DNA, 23 bp, Homo sapiens
tctggacaatggatcatattagg

SEQ ID NO: 2187 - DNA, 23 bp, Homo sapiens
ttataccactgttatggtgtggg

SEQ ID NO: 2188 - DNA, 23 bp, Homo sapiens
cagcgtttgattgcattaggagg

SEQ ID NO: 2189 - DNA, 23 bp, Homo sapiens
ctgcaacccctgatttaagatgg

SEQ ID NO: 2190 - DNA, 23 bp, Homo sapiens
tgcctctgtgaatcagtcacagg

SEQ ID NO: 2191 - DNA, 23 bp, Homo sapiens
cccagccctgggccctgagccgg

SEQ ID NO: 2192 - DNA, 23 bp, Homo sapiens
gggaagccggaaaaagggaatgg

SEQ ID NO: 2193 - DNA, 23 bp, Homo sapiens
tggtgcccagtgtgggctacggg

SEQ ID NO: 2194 - DNA, 23 bp, Homo sapiens
cgagggccttttgcaaacggtgg

SEQ ID NO: 2195 - DNA, 23 bp, Homo sapiens
ggtatcagagtcagataaagagg

SEQ ID NO: 2196 - DNA, 23 bp, Homo sapiens
aagtcggcctctctctcctgagg

SEQ ID NO: 2197 - DNA, 23 bp, Homo sapiens
ttatgagggccttgggtcatagg

SEQ ID NO: 2198 - DNA, 23 bp, Homo sapiens
gcgctgtgtgtcgggcgtagcgg

SEQ ID NO: 2199 - DNA, 23 bp, Homo sapiens
ttttgcattgcgatggctgaagg

SEQ ID NO: 2200 - DNA, 23 bp, Homo sapiens
aagtactactccaggcacggagg

SEQ ID NO: 2201 - DNA, 23 bp, Homo sapiens
aggtttagctctcatcttcaagg

SEQ ID NO: 2202 - DNA, 23 bp, Homo sapiens
tagactaggagatttgtgggagg

SEQ ID NO: 2203 - DNA, 23 bp, Homo sapiens
aggcagagtcacatttgttcagg

SEQ ID NO: 2204 - DNA, 23 bp, Homo sapiens
atctataagggtttagtgcttgg

SEQ ID NO: 2205 - DNA, 23 bp, Homo sapiens
ggcagataccactggagggcagg

SEQ ID NO: 2206 - DNA, 23 bp, Homo sapiens
tctaagcagtcatgggactttgg

SEQ ID NO: 2207 - DNA, 23 bp, Homo sapiens
tgtaagtgagcattcaccaccgg

SEQ ID NO: 2208 - DNA, 23 bp, Homo sapiens
catggctgggttcagtttgcagg

SEQ ID NO: 2209 - DNA, 23 bp, Homo sapiens
cccaattctgaaggtggaaaagg

SEQ ID NO: 2210 - DNA, 23 bp, Homo sapiens
cgagctcttccccgcttgacggg

SEQ ID NO: 2211 - DNA, 23 bp, Homo sapiens
cacagggaggtactgcttattgg

SEQ ID NO: 2212 - DNA, 23 bp, Homo sapiens
tacttgctcccatttcttcttgg

SEQ ID NO: 2213 - DNA, 23 bp, Homo sapiens
tgattgtagagttagggtccagg

SEQ ID NO: 2214 - DNA, 23 bp, Homo sapiens
ttgaatggtaggttgagtgatgg

SEQ ID NO: 2215 - DNA, 23 bp, Homo sapiens
agggagggccaactctcaggagg

SEQ ID NO: 2216 - DNA, 23 bp, Homo sapiens
aagaaagccagtgacaagtaggg

SEQ ID NO: 2217 - DNA, 23 bp, Homo sapiens
actgtgggagtcaagtaaaaagg

SEQ ID NO: 2218 - DNA, 23 bp, Homo sapiens
gcaaatcacctgctaacctttgg

SEQ ID NO: 2219 - DNA, 23 bp, Homo sapiens
ttcttctgactcatttcctctgg

SEQ ID NO: 2220 - DNA, 23 bp, Homo sapiens
cctcaagaaacccttgaattagg

SEQ ID NO: 2221 - DNA, 23 bp, Homo sapiens
acctcaagtttctcaacaggagg

SEQ ID NO: 2222 - DNA, 23 bp, Homo sapiens
gcttagagctgtgttacctgagg

SEQ ID NO: 2223 - DNA, 23 bp, Homo sapiens
gtcaacagatgtcatagcaccgg

SEQ ID NO: 2224 - DNA, 23 bp, Homo sapiens
gttaacttgtctttcgtaggtgg

SEQ ID NO: 2225 - DNA, 23 bp, Homo sapiens
tactcattgaagaacttgtctgg

SEQ ID NO: 2226 - DNA, 23 bp, Homo sapiens
caagatggagattcctgttcggg

SEQ ID NO: 2227 - DNA, 23 bp, Homo sapiens
ctcgcaactagtgatgactgtgg

SEQ ID NO: 2228 - DNA, 23 bp, Homo sapiens
agaaagactttgggagcggacgg

SEQ ID NO: 2229 - DNA, 23 bp, Homo sapiens
tacagctggtaaggactgatagg

SEQ ID NO: 2230 - DNA, 23 bp, Homo sapiens
cagggtgtgccgtcctcagaagg

SEQ ID NO: 2231 - DNA, 23 bp, Homo sapiens
aggccgaggcgggcagggacagg

SEQ ID NO: 2232 - DNA, 23 bp, Homo sapiens
gaccacagactgggaaaagttgg

SEQ ID NO: 2233 - DNA, 23 bp, Homo sapiens
agatttaagcagctgttcaaagg

SEQ ID NO: 2234 - DNA, 23 bp, Homo sapiens
actttacattcattaccccatgg

SEQ ID NO: 2235 - DNA, 23 bp, Homo sapiens
cggcctcctgcggctctgacggg

SEQ ID NO: 2236 - DNA, 23 bp, Homo sapiens
tgagccctggccctgctgcttgg

SEQ ID NO: 2237 - DNA, 23 bp, Homo sapiens
aaatctggttagtgatgaccagg

SEQ ID NO: 2238 - DNA, 23 bp, Homo sapiens
gtttctcctcttgtcatcattgg

SEQ ID NO: 2239 - DNA, 23 bp, Homo sapiens
aaattcatcttcagagctgtcgg

SEQ ID NO: 2240 - DNA, 23 bp, Homo sapiens
tttgccactggtgtttgaagtgg

SEQ ID NO: 2241 - DNA, 23 bp, Homo sapiens
tgaccctgtccaaatgaaaatgg

SEQ ID NO: 2242 - DNA, 23 bp, Homo sapiens
tcaatgaatgagttcaagtcagg

SEQ ID NO: 2243 - DNA, 23 bp, Homo sapiens
gcattcagctcaagcaaatctgg

SEQ ID NO: 2244 - DNA, 23 bp, Homo sapiens
ggtttgctcattaccagtcctgg

SEQ ID NO: 2245 - DNA, 23 bp, Homo sapiens
gcactggcaaccagtgctacagg

SEQ ID NO: 2246 - DNA, 23 bp, Homo sapiens
acctgttatcccagcactctggg

SEQ ID NO: 2247 - DNA, 23 bp, Homo sapiens
agaaaatgacaaggagtatcagg

SEQ ID NO: 2248 - DNA, 23 bp, Homo sapiens
tacaactccagaagagatcttgg

SEQ ID NO: 2249 - DNA, 23 bp, Homo sapiens
tacgccactgcactccagcttgg

SEQ ID NO: 2250 - DNA, 23 bp, Homo sapiens
tgcattcaacaagtagtccaagg

SEQ ID NO: 2251 - DNA, 23 bp, Homo sapiens
gcgaggaaacattttctaccagg

SEQ ID NO: 2252 - DNA, 23 bp, Homo sapiens
taccaatagatgactaagcctgg

SEQ ID NO: 2253 - DNA, 23 bp, Homo sapiens
ttcagggtcaagctatgctgtgg

SEQ ID NO: 2254 - DNA, 23 bp, Homo sapiens
agaggcgagggctcgtcatttgg

SEQ ID NO: 2255 - DNA, 23 bp, Homo sapiens
tgtgttcagcatcttcctgccgg

SEQ ID NO: 2256 - DNA, 23 bp, Homo sapiens
cttgacatcaaggcctagtttgg

SEQ ID NO: 2257 - DNA, 23 bp, Homo sapiens
cggcgctcagctgattctccagg

SEQ ID NO: 2258 - DNA, 23 bp, Homo sapiens
aagccagggggaaaaactagggg

SEQ ID NO: 2259 - DNA, 23 bp, Homo sapiens
tgacgcacactttcaatacatgg

SEQ ID NO: 2260 - DNA, 23 bp, Homo sapiens
agcgagcccagcttctaaatggg

SEQ ID NO: 2261 - DNA, 23 bp, Homo sapiens
tcaagagttctggttctgtcagg

SEQ ID NO: 2262 - DNA, 23 bp, Homo sapiens
cacatacagagaagtcacacagg

SEQ ID NO: 2263 - DNA, 23 bp, Homo sapiens
agagacggcaagacaggtcttgg

SEQ ID NO: 2264 - DNA, 23 bp, Homo sapiens
gttctaccgcaaccgctcagagg

SEQ ID NO: 2265 - DNA, 23 bp, Homo sapiens
ttagcagccattcagttaagtgg

SEQ ID NO: 2266 - DNA, 23 bp, Homo sapiens
aatttagacattcatcagcctgg

SEQ ID NO: 2267 - DNA, 23 bp, Homo sapiens
ggggattcagaaccccacactgg

SEQ ID NO: 2268 - DNA, 23 bp, Homo sapiens
gcttctgtctcccgaaaagaagg

SEQ ID NO: 2269 - DNA, 23 bp, Homo sapiens
tcagactccctctgcaaacaagg

SEQ ID NO: 2270 - DNA, 23 bp, Homo sapiens
atgggtggtggtgtccctagggg

SEQ ID NO: 2271 - DNA, 23 bp, Homo sapiens
ggcagctatagttgctccagagg

SEQ ID NO: 2272 - DNA, 23 bp, Homo sapiens
agatcattctgttgcgtttatgg

SEQ ID NO: 2273 - DNA, 23 bp, Homo sapiens
atcgacccagaagcctgaggagg

SEQ ID NO: 2274 - DNA, 23 bp, Homo sapiens
tggcgagaggagctatttagagg

SEQ ID NO: 2275 - DNA, 23 bp, Homo sapiens
agttgggattacaggtgcccagg

SEQ ID NO: 2276 - DNA, 23 bp, Homo sapiens
cgggacagtcacttgtactgagg

SEQ ID NO: 2277 - DNA, 23 bp, Homo sapiens
tctagtcacagctactcaggagg

SEQ ID NO: 2278 - DNA, 23 bp, Homo sapiens
tttcgtgttttcagtcgccttgg

SEQ ID NO: 2279 - DNA, 23 bp, Homo sapiens
ccaccaagcagccgctgagacgg

SEQ ID NO: 2280 - DNA, 23 bp, Homo sapiens
acacctataatcccacactttgg

SEQ ID NO: 2281 - DNA, 23 bp, Homo sapiens
ggggccctggagaggccataggg

SEQ ID NO: 2282 - DNA, 23 bp, Homo sapiens
tacagagcgagaacttgacgggg

SEQ ID NO: 2283 - DNA, 23 bp, Homo sapiens
cggctctttaggcccctttctgg

SEQ ID NO: 2284 - DNA, 23 bp, Homo sapiens
ttgtttactctccaagtacatgg

SEQ ID NO: 2285 - DNA, 23 bp, Homo sapiens
aacttcaaaccccaaaacactgg

SEQ ID NO: 2286 - DNA, 23 bp, Homo sapiens
tggcctggaggagggtcaggagg

SEQ ID NO: 2287 - DNA, 23 bp, Homo sapiens
cacgggttggcgggctcctcggg

SEQ ID NO: 2288 - DNA, 23 bp, Homo sapiens
attactggagcttggcattctgg

SEQ ID NO: 2289 - DNA, 23 bp, Homo sapiens
tttgggaagcagcatctcatcgg

SEQ ID NO: 2290 - DNA, 23 bp, Homo sapiens
atggaactaactttctagagggg

SEQ ID NO: 2291 - DNA, 23 bp, Homo sapiens
tcagatgcttcaataaagcttgg

SEQ ID NO: 2292 - DNA, 23 bp, Homo sapiens
tcttctctcccaaaatgaatagg

SEQ ID NO: 2293 - DNA, 23 bp, Homo sapiens
caggacacggggtgagttagggg

SEQ ID NO: 2294 - DNA, 23 bp, Homo sapiens
acaagacgacactgagcaaaagg

SEQ ID NO: 2295 - DNA, 23 bp, Homo sapiens
tctacagagctgggtcgtttagg

SEQ ID NO: 2296 - DNA, 23 bp, Homo sapiens
tcagaggtggaaggctcagcagg

SEQ ID NO: 2297 - DNA, 23 bp, Homo sapiens
taagaaactcaacttcgaccagg

SEQ ID NO: 2298 - DNA, 23 bp, Homo sapiens
gggcgctcaggagttcccagcgg

SEQ ID NO: 2299 - DNA, 23 bp, Homo sapiens
tgcggaggcatttgctcaacagg

SEQ ID NO: 2300 - DNA, 23 bp, Homo sapiens
gctcactcaggagtccatccagg

SEQ ID NO: 2301 - DNA, 23 bp, Homo sapiens
gttggggcagtctcaactactgg

SEQ ID NO: 2302 - DNA, 23 bp, Homo sapiens
aaaagggaagggcagattcaagg

SEQ ID NO: 2303 - DNA, 23 bp, Homo sapiens
tgggaaacaatgacatgaatggg

SEQ ID NO: 2304 - DNA, 23 bp, Homo sapiens
gcttccccaagggcagtgagggg

SEQ ID NO: 2305 - DNA, 23 bp, Homo sapiens
tcttcttacggttcagtctctgg

SEQ ID NO: 2306 - DNA, 23 bp, Homo sapiens
caggattcatcctgtgtaagggg

SEQ ID NO: 2307 - DNA, 23 bp, Homo sapiens
aaggacagctatcacatttttgg

SEQ ID NO: 2308 - DNA, 23 bp, Homo sapiens
agagtgactcatgatcccagtgg

SEQ ID NO: 2309 - DNA, 23 bp, Homo sapiens
cttttcagaagtatgtctggtgg

SEQ ID NO: 2310 - DNA, 23 bp, Homo sapiens
ggcttggattcagctgtcccagg

SEQ ID NO: 2311 - DNA, 23 bp, Homo sapiens
ttgccgctctaaaacatgtttgg

SEQ ID NO: 2312 - DNA, 23 bp, Homo sapiens
acttcgtcctgtgttgtagctgg

SEQ ID NO: 2313 - DNA, 23 bp, Homo sapiens
ggggctgcggacacactgagcgg

SEQ ID NO: 2314 - DNA, 23 bp, Homo sapiens
tgacttagctcctactctgctgg

SEQ ID NO: 2315 - DNA, 23 bp, Homo sapiens
aaaagatgctgttagaacagagg

SEQ ID NO: 2316 - DNA, 23 bp, Homo sapiens
tctggacggttcattctacatgg

SEQ ID NO: 2317 - DNA, 23 bp, Homo sapiens
gggagggaaatagagcaccaagg

SEQ ID NO: 2318 - DNA, 23 bp, Homo sapiens
tgttttgctggtgttctttgagg

SEQ ID NO: 2319 - DNA, 23 bp, Homo sapiens
ttcttatcttctctgaagggtgg

SEQ ID NO: 2320 - DNA, 23 bp, Homo sapiens
ttaccttggatgaggatagcagg

SEQ ID NO: 2321 - DNA, 23 bp, Homo sapiens
atttctgttggtccttttgttgg

SEQ ID NO: 2322 - DNA, 23 bp, Homo sapiens
cggtcaccgaaaatgtgaagagg

SEQ ID NO: 2323 - DNA, 23 bp, Homo sapiens
gcttcttagaagaactggattgg

SEQ ID NO: 2324 - DNA, 23 bp, Homo sapiens
actaacgacctgcactgatttgg

SEQ ID NO: 2325 - DNA, 23 bp, Homo sapiens
ttggagaccaagctctaatgagg

SEQ ID NO: 2326 - DNA, 23 bp, Homo sapiens
cgagatccagtatgatgactagg

SEQ ID NO: 2327 - DNA, 23 bp, Homo sapiens
tccagtgtcttcactcagcaagg

SEQ ID NO: 2328 - DNA, 23 bp, Homo sapiens
tgggggagcggaggtctacgcgg

SEQ ID NO: 2329 - DNA, 23 bp, Homo sapiens
tgcgtcacataatggaaaaatgg

SEQ ID NO: 2330 - DNA, 23 bp, Homo sapiens
aggagacggtgtttgagtcccgg

SEQ ID NO: 2331 - DNA, 23 bp, Homo sapiens
ggccccgagaggtcagcctgagg

SEQ ID NO: 2332 - DNA, 23 bp, Homo sapiens
cagctccagcgattcggacacgg

SEQ ID NO: 2333 - DNA, 23 bp, Homo sapiens
ccctgtccagggcccttcagtgg

SEQ ID NO: 2334 - DNA, 23 bp, Homo sapiens
cccccagtcctcagcctcactgg

SEQ ID NO: 2335 - DNA, 23 bp, Homo sapiens
tgccctggaggaggtgaacaagg

SEQ ID NO: 2336 - DNA, 23 bp, Homo sapiens
ccgcccacaggtgggctagaagg

SEQ ID NO: 2337 - DNA, 23 bp, Homo sapiens
tcctgaatgcagctcaaaccagg

SEQ ID NO: 2338 - DNA, 23 bp, Homo sapiens
tggggccagcgtcctcaggaagg

SEQ ID NO: 2339 - DNA, 23 bp, Homo sapiens
gagaccgcagccgcagctaatgg

SEQ ID NO: 2340 - DNA, 23 bp, Homo sapiens
gggccacaaggcacactgggcgg

SEQ ID NO: 2341 - DNA, 23 bp, Homo sapiens
tgtgctagtcatgtgacctcagg

SEQ ID NO: 2342 - DNA, 23 bp, Homo sapiens
cccaccctggagggagttgtagg

SEQ ID NO: 2343 - DNA, 23 bp, Homo sapiens
acctggcaggggtcactccctgg

SEQ ID NO: 2344 - DNA, 23 bp, Homo sapiens
ctgcggggtgggcagcgcagggg

SEQ ID NO: 2345 - DNA, 23 bp, Homo sapiens
gcccctgctgactcgctacttgg

SEQ ID NO: 2346 - DNA, 23 bp, Homo sapiens
tcctggtagcatgcctttatcgg

SEQ ID NO: 2347 - DNA, 23 bp, Homo sapiens
gcttccaagagactagtccgagg

SEQ ID NO: 2348 - DNA, 23 bp, Homo sapiens
gggggcggagccgaacgaggagg

SEQ ID NO: 2349 - DNA, 23 bp, Homo sapiens
ggactgggagacagagtactagg

SEQ ID NO: 2350 - DNA, 23 bp, Homo sapiens
ttttcgattttggttcccagagg

SEQ ID NO: 2351 - DNA, 23 bp, Homo sapiens
agtatacgttcaggtaaggtagg

SEQ ID NO: 2352 - DNA, 23 bp, Homo sapiens
cagtcattgtcagaaccatttgg

SEQ ID NO: 2353 - DNA, 23 bp, Homo sapiens
gttggttcagaaaatgactgagg

SEQ ID NO: 2354 - DNA, 23 bp, Homo sapiens
agctctggcagtgaattaagcgg

SEQ ID NO: 2355 - DNA, 23 bp, Homo sapiens
tcttcacaacagtagagctctgg

SEQ ID NO: 2356 - DNA, 23 bp, Homo sapiens
caagacaacgaggcagtgagcgg

SEQ ID NO: 2357 - DNA, 23 bp, Homo sapiens
gtggggcgcagagttacacctgg

SEQ ID NO: 2358 - DNA, 23 bp, Homo sapiens
tccttcttcctggaagagtaagg

SEQ ID NO: 2359 - DNA, 23 bp, Homo sapiens
agaatgtcagtcttcaactgtgg

SEQ ID NO: 2360 - DNA, 23 bp, Homo sapiens
ggaggcgctccaagaaaggatgg

SEQ ID NO: 2361 - DNA, 23 bp, Homo sapiens
actgctggacatggtttgcatgg

SEQ ID NO: 2362 - DNA, 23 bp, Homo sapiens
tctccaggctcttttcaaggagg

SEQ ID NO: 2363 - DNA, 23 bp, Homo sapiens
ggtatccttcgtgcgctaatggg

SEQ ID NO: 2364 - DNA, 23 bp, Homo sapiens
gaagaagctgggactgttgaagg

SEQ ID NO: 2365 - DNA, 23 bp, Homo sapiens
gctagcagagctgccactccagg

SEQ ID NO: 2366 - DNA, 23 bp, Homo sapiens
tttaatcaaggctctactgaagg

SEQ ID NO: 2367 - DNA, 23 bp, Homo sapiens
gggatcagcacttcacaaactgg

SEQ ID NO: 2368 - DNA, 23 bp, Homo sapiens
ctccatggaggctcagcgtgagg

SEQ ID NO: 2369 - DNA, 23 bp, Homo sapiens
agtacttcatttggccactctgg

SEQ ID NO: 2370 - DNA, 23 bp, Homo sapiens
tcctgtggagggtagcagaaggg

SEQ ID NO: 2371 - DNA, 23 bp, Homo sapiens
actaaataatgtaacgccactgg

SEQ ID NO: 2372 - DNA, 23 bp, Homo sapiens
gattctgttggtctcttagaagg

SEQ ID NO: 2373 - DNA, 23 bp, Homo sapiens
ttctgaagtgttttccaaacagg

SEQ ID NO: 2374 - DNA, 23 bp, Homo sapiens
ggtggcagctctcagaagtgtgg

SEQ ID NO: 2375 - DNA, 23 bp, Homo sapiens
cgtatcagcaatgtctgacctgg

SEQ ID NO: 2376 - DNA, 23 bp, Homo sapiens
tggggtcaaagtctgcagaatgg

SEQ ID NO: 2377 - DNA, 23 bp, Homo sapiens
gaacaagtcacagctgcagctgg

SEQ ID NO: 2378 - DNA, 23 bp, Homo sapiens
acgatgatgcagaaatgtagggg

SEQ ID NO: 2379 - DNA, 23 bp, Homo sapiens
agtaccctcttctaatgaaatgg

SEQ ID NO: 2380 - DNA, 23 bp, Homo sapiens
gccagcggaatatgatcaagtgg

SEQ ID NO: 2381 - DNA, 23 bp, Homo sapiens
cagcaggaactaaatcagatggg

SEQ ID NO: 2382 - DNA, 23 bp, Homo sapiens
agggatctgtcaacactaggtgg

SEQ ID NO: 2383 - DNA, 23 bp, Homo sapiens
agcttccaatcataaaaccaagg

SEQ ID NO: 2384 - DNA, 23 bp, Homo sapiens
agtactcttcaaagttctcaagg

SEQ ID NO: 2385 - DNA, 23 bp, Homo sapiens
gaagacgggatttgattttctgg

SEQ ID NO: 2386 - DNA, 23 bp, Homo sapiens
ggattactgttcggaagaagagg

SEQ ID NO: 2387 - DNA, 23 bp, Homo sapiens
gcaggccatcacagtcatagagg

SEQ ID NO: 2388 - DNA, 23 bp, Homo sapiens
ggccccaggaccaggcctaaggg

SEQ ID NO: 2389 - DNA, 23 bp, Homo sapiens
agagcagaggctctattcaaagg

SEQ ID NO: 2390 - DNA, 23 bp, Homo sapiens
cgaggaggatgtagaatcaaagg

SEQ ID NO: 2391 - DNA, 23 bp, Homo sapiens
gttcacagtcgctcccgctccgg

SEQ ID NO: 2392 - DNA, 23 bp, Homo sapiens
acagttgcagtccttgctgcggg

SEQ ID NO: 2393 - DNA, 23 bp, Homo sapiens
acagaggctctgaggcctgatgg

SEQ ID NO: 2394 - DNA, 23 bp, Homo sapiens
aacagcccgctatgggacagggg

SEQ ID NO: 2395 - DNA, 23 bp, Homo sapiens
cattggagagtactctgtgacgg

SEQ ID NO: 2396 - DNA, 23 bp, Homo sapiens
tcccctccaaactcacgcagtgg

SEQ ID NO: 2397 - DNA, 23 bp, Homo sapiens
actctcagtgagtcagtccctgg

SEQ ID NO: 2398 - DNA, 23 bp, Homo sapiens
ttcttctttgctggttctcctgg

SEQ ID NO: 2399 - DNA, 23 bp, Homo sapiens
ttgcaaagaggtgaatgttgtgg

SEQ ID NO: 2400 - DNA, 23 bp, Homo sapiens
ggagtctggcaagaggaaattgg

SEQ ID NO: 2401 - DNA, 23 bp, Homo sapiens
ggggatgtatttcatgtagaagg

SEQ ID NO: 2402 - DNA, 23 bp, Homo sapiens
tagacagaaaccagaggtaatgg

SEQ ID NO: 2403 - DNA, 23 bp, Homo sapiens
agcctcatctttcagtcaactgg

SEQ ID NO: 2404 - DNA, 23 bp, Homo sapiens
caactgggaaggcttatcagagg

SEQ ID NO: 2405 - DNA, 23 bp, Homo sapiens
tcccagttgactgaaagatgagg

SEQ ID NO: 2406 - DNA, 23 bp, Homo sapiens
agcagcagcagtcatcctcatgg

SEQ ID NO: 2407 - DNA, 23 bp, Homo sapiens
gggaggagagttaaagtcagagg

SEQ ID NO: 2408 - DNA, 23 bp, Homo sapiens
gccagcactgcggtacttaaagg

SEQ ID NO: 2409 - DNA, 23 bp, Homo sapiens
tatttttcttccagtgggaatgg

SEQ ID NO: 2410 - DNA, 23 bp, Homo sapiens
ccttccctggctcaggcagatgg

SEQ ID NO: 2411 - DNA, 23 bp, Homo sapiens
cctgctctttccagatatggagg

SEQ ID NO: 2412 - DNA, 23 bp, Homo sapiens
tcagcatctgtctgctctactgg

SEQ ID NO: 2413 - DNA, 23 bp, Homo sapiens
ctgctcttccccgactagggcgg

SEQ ID NO: 2414 - DNA, 23 bp, Homo sapiens
ggagacgtggggagctcagtcgg

SEQ ID NO: 2415 - DNA, 23 bp, Homo sapiens
ttcttctgtacccggattagggg

SEQ ID NO: 2416 - DNA, 23 bp, Homo sapiens
ggcctcaagcggcagcatgaagg

SEQ ID NO: 2417 - DNA, 23 bp, Homo sapiens
atcatctaccccgactgagccgg

SEQ ID NO: 2418 - DNA, 23 bp, Homo sapiens
gcacgccaccgagccctagctgg

SEQ ID NO: 2419 - DNA, 23 bp, Homo sapiens
ggctgctcctgggcacgtgaggg

SEQ ID NO: 2420 - DNA, 23 bp, Homo sapiens
gtggcatgtctatacctcgttgg

SEQ ID NO: 2421 - DNA, 23 bp, Homo sapiens
aaagagcaggaatcctgcaaagg

SEQ ID NO: 2422 - DNA, 23 bp, Homo sapiens
cggggctcacagtagctccgagg

SEQ ID NO: 2423 - DNA, 23 bp, Homo sapiens
agtgggcactaagcaaagactgg

SEQ ID NO: 2424 - DNA, 23 bp, Homo sapiens
gccggcttcagggtcagggctgg

SEQ ID NO: 2425 - DNA, 23 bp, Homo sapiens
tcaaggccgaggacgactgaggg

SEQ ID NO: 2426 - DNA, 23 bp, Homo sapiens
gtcaacgtataagagaaacccgg

SEQ ID NO: 2427 - DNA, 23 bp, Homo sapiens
gccggccgccgagctgtagccgg

SEQ ID NO: 2428 - DNA, 23 bp, Homo sapiens
tttaaactctcctctgtcacggg

SEQ ID NO: 2429 - DNA, 23 bp, Homo sapiens
tataaactctcctctgtcactgg

SEQ ID NO: 2430 - DNA, 23 bp, Homo sapiens
caagaaagagatggaggaggagg

SEQ ID NO: 2431 - DNA, 23 bp, Homo sapiens
ccaagaacacattcacactctgg

SEQ ID NO: 2432 - DNA, 23 bp, Homo sapiens
tggatcaagggagtgatgaatgg

SEQ ID NO: 2433 - DNA, 23 bp, Homo sapiens
tggtatcttcaagccttaagtgg

SEQ ID NO: 2434 - DNA, 23 bp, Homo sapiens
tgtatctggattagtcctcacgg

SEQ ID NO: 2435 - DNA, 23 bp, Homo sapiens
agattatactcatgccatgtagg

SEQ ID NO: 2436 - DNA, 23 bp, Homo sapiens
ggctcagtggccatggctagagg

SEQ ID NO: 2437 - DNA, 23 bp, Homo sapiens
gggaggggctctcaggcccaagg

SEQ ID NO: 2438 - DNA, 23 bp, Homo sapiens
gggccaagcgtttaaagctgcgg

SEQ ID NO: 2439 - DNA, 23 bp, Homo sapiens
aagatggtctggttccctagtgg

SEQ ID NO: 2440 - DNA, 23 bp, Homo sapiens
tctttgagctgaagccctagagg

SEQ ID NO: 2441 - DNA, 23 bp, Homo sapiens
ggatccacatcagaagaataagg

SEQ ID NO: 2442 - DNA, 23 bp, Homo sapiens
cactgcccggcaccagttacagg

SEQ ID NO: 2443 - DNA, 23 bp, Homo sapiens
gagaaaacgaagaaacacacagg

SEQ ID NO: 2444 - DNA, 23 bp, Homo sapiens
ttatggactaaggtgtcccacgg

SEQ ID NO: 2445 - DNA, 23 bp, Homo sapiens
tgtcatctccgtccagttaaggg

SEQ ID NO: 2446 - DNA, 23 bp, Homo sapiens
agtttctctccaattcatcacgg

SEQ ID NO: 2447 - DNA, 23 bp, Homo sapiens
gcctccagggactcctagcgcgg

SEQ ID NO: 2448 - DNA, 23 bp, Homo sapiens
ctgccatccattatgactgatgg

SEQ ID NO: 2449 - DNA, 23 bp, Homo sapiens
ctgtacaccatcagtcataatgg

SEQ ID NO: 2450 - DNA, 23 bp, Homo sapiens
ggcatcagtgttttctgcaaggg

SEQ ID NO: 2451 - DNA, 23 bp, Homo sapiens
gactggcacggctttgactgagg

SEQ ID NO: 2452 - DNA, 23 bp, Homo sapiens
accaaagctctcaaaaatgatgg

SEQ ID NO: 2453 - DNA, 23 bp, Homo sapiens
gattcagtgcacgccctgcttgg

SEQ ID NO: 2454 - DNA, 23 bp, Homo sapiens
agagccactacccttctagatgg

SEQ ID NO: 2455 - DNA, 23 bp, Homo sapiens
agatgggaaaactactatcttgg

SEQ ID NO: 2456 - DNA, 23 bp, Homo sapiens
gttcaggtcctgcggtcactcgg

SEQ ID NO: 2457 - DNA, 23 bp, Homo sapiens
aggaaggtgctggaactcactgg

SEQ ID NO: 2458 - DNA, 23 bp, Homo sapiens
agtcacagaagaaagggccatgg

SEQ ID NO: 2459 - DNA, 23 bp, Homo sapiens
tgcgtgggtgaacatcagtgagg

SEQ ID NO: 2460 - DNA, 23 bp, Homo sapiens
tctgtgactcacactcagggtgg

SEQ ID NO: 2461 - DNA, 23 bp, Homo sapiens
gcccccagcctgtggacgcctgg

SEQ ID NO: 2462 - DNA, 23 bp, Homo sapiens
agtacttacttgctgaatcttgg

SEQ ID NO: 2463 - DNA, 23 bp, Homo sapiens
taaggcacacaggctatgtgtgg

SEQ ID NO: 2464 - DNA, 23 bp, Homo sapiens
tcagctggtgaacttcatcttgg

SEQ ID NO: 2465 - DNA, 23 bp, Homo sapiens
tccatgcggatgggatcatacgg

SEQ ID NO: 2466 - DNA, 23 bp, Homo sapiens
acaacatagcttttgttgcttgg

SEQ ID NO: 2467 - DNA, 23 bp, Homo sapiens
gcatccacattacagcagagagg

SEQ ID NO: 2468 - DNA, 23 bp, Homo sapiens
taggtcagttgtttatgggtagg

SEQ ID NO: 2469 - DNA, 23 bp, Homo sapiens
tgcaatccatccccttaatcagg

SEQ ID NO: 2470 - DNA, 23 bp, Homo sapiens
gtctctggagacagattaagtgg

SEQ ID NO: 2471 - DNA, 23 bp, Homo sapiens
ggaggctggctgtcaggactcgg

SEQ ID NO: 2472 - DNA, 23 bp, Homo sapiens
gtcaagacctggagcgaagaagg

SEQ ID NO: 2473 - DNA, 23 bp, Homo sapiens
aggagcctgtactcaagaaatgg

SEQ ID NO: 2474 - DNA, 23 bp, Homo sapiens
tcactgtgccctccccacaaagg

SEQ ID NO: 2475 - DNA, 23 bp, Homo sapiens
tcccaagtagctgagattacagg

SEQ ID NO: 2476 - DNA, 23 bp, Homo sapiens
tctccctctgccacaggagaagg

SEQ ID NO: 2477 - DNA, 23 bp, Homo sapiens
gctacttggaacactaaagccgg

SEQ ID NO: 2478 - DNA, 23 bp, Homo sapiens
tttcacttgctacttgtctccgg

SEQ ID NO: 2479 - DNA, 23 bp, Homo sapiens
cccgtggagccctgcacgtaggg

SEQ ID NO: 2480 - DNA, 23 bp, Homo sapiens
aaccccagcccccagctctgagg

SEQ ID NO: 2481 - DNA, 23 bp, Homo sapiens
caagtcagctccttaatcacagg

SEQ ID NO: 2482 - DNA, 23 bp, Homo sapiens
tcaggctgcgtcagtctttctgg

SEQ ID NO: 2483 - DNA, 23 bp, Homo sapiens
gcgccctcctgctgctctgaggg

SEQ ID NO: 2484 - DNA, 23 bp, Homo sapiens
ctgctccccttcctgtagagcgg

SEQ ID NO: 2485 - DNA, 23 bp, Homo sapiens
aagccaggggctcaggctacagg

SEQ ID NO: 2486 - DNA, 23 bp, Homo sapiens
gaaggcgaagttacaacctgagg

SEQ ID NO: 2487 - DNA, 23 bp, Homo sapiens
agtcgtcgaatggtttcatcagg

SEQ ID NO: 2488 - DNA, 23 bp, Homo sapiens
atattttcaagctcctcttcagg

SEQ ID NO: 2489 - DNA, 23 bp, Homo sapiens
ttagctgaaagggagaacacagg

SEQ ID NO: 2490 - DNA, 23 bp, Homo sapiens
tggactagaaatgacagatgtgg

SEQ ID NO: 2491 - DNA, 23 bp, Homo sapiens
aggcctgaagctactcgatgagg

SEQ ID NO: 2492 - DNA, 23 bp, Homo sapiens
catcctgggcagcacgttagggg

SEQ ID NO: 2493 - DNA, 23 bp, Homo sapiens
gtagtcatcgtagttgacgctgg

SEQ ID NO: 2494 - DNA, 23 bp, Homo sapiens
gggaaagtaatagtggtcagagg

SEQ ID NO: 2495 - DNA, 23 bp, Homo sapiens
gcagcagatctgctgtctatggg

SEQ ID NO: 2496 - DNA, 23 bp, Homo sapiens
tgaagcccccacaagcaaaaagg

SEQ ID NO: 2497 - DNA, 23 bp, Homo sapiens
cagccctccttgctcctagatgg

SEQ ID NO: 2498 - DNA, 23 bp, Homo sapiens
ggaggcgaggagagctgagctgg

SEQ ID NO: 2499 - DNA, 23 bp, Homo sapiens
cagaagcagtaagttctgactgg

SEQ ID NO: 2500 - DNA, 23 bp, Homo sapiens
gccttcaacatggtcagtgttgg

SEQ ID NO: 2501 - DNA, 23 bp, Homo sapiens
ttccatagagaatcacttcaggg

SEQ ID NO: 2502 - DNA, 23 bp, Homo sapiens
agagggtctctccacaggagcgg

SEQ ID NO: 2503 - DNA, 23 bp, Homo sapiens
gcaagaggaggtgtcctgacagg

SEQ ID NO: 2504 - DNA, 23 bp, Homo sapiens
ccaccggagactcaagatgaagg

SEQ ID NO: 2505 - DNA, 23 bp, Homo sapiens
taggagatgctcttttcactagg

SEQ ID NO: 2506 - DNA, 23 bp, Homo sapiens
atactcgagaacataaagagagg

SEQ ID NO: 2507 - DNA, 23 bp, Homo sapiens
gccctcgagatgttttcaccagg

SEQ ID NO: 2508 - DNA, 23 bp, Homo sapiens
aaactgcactttccccaaagagg

SEQ ID NO: 2509 - DNA, 23 bp, Homo sapiens
ttgtgatgatttccattctgtgg

SEQ ID NO: 2510 - DNA, 23 bp, Homo sapiens
ttagctgtgctacggtcacctgg

SEQ ID NO: 2511 - DNA, 23 bp, Homo sapiens
gcccctttattcgcttcaggagg

SEQ ID NO: 2512 - DNA, 23 bp, Homo sapiens
gccattctagatggtttcagggg

SEQ ID NO: 2513 - DNA, 23 bp, Homo sapiens
ttagcgtaagatggatgaactgg

SEQ ID NO: 2514 - DNA, 23 bp, Homo sapiens
attgagagtgaggggccttgagg

SEQ ID NO: 2515 - DNA, 23 bp, Homo sapiens
aagcatggaaggaattcaggtgg

SEQ ID NO: 2516 - DNA, 23 bp, Homo sapiens
ggaatgggggtgtggtcagttgg

SEQ ID NO: 2517 - DNA, 23 bp, Homo sapiens
tgacattgtttgagggacagtgg

SEQ ID NO: 2518 - DNA, 23 bp, Homo sapiens
taaaagcagtctcaacagtttgg

SEQ ID NO: 2519 - DNA, 23 bp, Homo sapiens
tcgctgtgcctcattttgaatgg

SEQ ID NO: 2520 - DNA, 23 bp, Homo sapiens
caatgccatccatgcgtgagtgg

SEQ ID NO: 2521 - DNA, 23 bp, Homo sapiens
ccctgtcttgggctctaatgagg

SEQ ID NO: 2522 - DNA, 23 bp, Homo sapiens
gccaggatggcgctacttcttgg

SEQ ID NO: 2523 - DNA, 23 bp, Homo sapiens
cagagcccagtctctaggagagg

SEQ ID NO: 2524 - DNA, 23 bp, Homo sapiens
cctgaattttatgctgtgccagg

SEQ ID NO: 2525 - DNA, 23 bp, Homo sapiens
tttcgtagaaaagggtgaaacgg

SEQ ID NO: 2526 - DNA, 23 bp, Homo sapiens
tcaagaacctactatgtgaaagg

SEQ ID NO: 2527 - DNA, 23 bp, Homo sapiens
tctggggacatttctatcccagg

SEQ ID NO: 2528 - DNA, 23 bp, Homo sapiens
gcggggcaactaatttaaaacgg

SEQ ID NO: 2529 - DNA, 23 bp, Homo sapiens
ggaactggggaccaagtttgagg

SEQ ID NO: 2530 - DNA, 23 bp, Homo sapiens
gtctcgttctgtcgcttagctgg

SEQ ID NO: 2531 - DNA, 23 bp, Homo sapiens
tacctggttgtgagagtctgggg

SEQ ID NO: 2532 - DNA, 23 bp, Homo sapiens
gggctgattagcactcaaagagg

SEQ ID NO: 2533 - DNA, 23 bp, Homo sapiens
cacgcagttcttttgcagcctgg

SEQ ID NO: 2534 - DNA, 23 bp, Homo sapiens
gactgttctggacttggaagagg

SEQ ID NO: 2535 - DNA, 23 bp, Homo sapiens
gcagaatcaggtagacactcagg

SEQ ID NO: 2536 - DNA, 23 bp, Homo sapiens
aacagggaaatactatgagttgg

SEQ ID NO: 2537 - DNA, 23 bp, Homo sapiens
ctgataaggatggtatgttcagg

SEQ ID NO: 2538 - DNA, 23 bp, Homo sapiens
gaatctggacgctgctcagccgg

SEQ ID NO: 2539 - DNA, 23 bp, Homo sapiens
ctatcgtttcaatcacttccagg

SEQ ID NO: 2540 - DNA, 23 bp, Homo sapiens
gggcagatgttacaagtgactgg

SEQ ID NO: 2541 - DNA, 23 bp, Homo sapiens
tccccgagcgctcagataagagg

SEQ ID NO: 2542 - DNA, 23 bp, Homo sapiens
ctggtccagagcattaaacaagg

SEQ ID NO: 2543 - DNA, 23 bp, Homo sapiens
ctgggcagtagacatgtcaaagg

SEQ ID NO: 2544 - DNA, 23 bp, Homo sapiens
ggtaaacacactggctaagcagg

SEQ ID NO: 2545 - DNA, 23 bp, Homo sapiens
ctcaggggtgccaggtgtgaggg

SEQ ID NO: 2546 - DNA, 23 bp, Homo sapiens
cagcgcaagacaatccactttgg

SEQ ID NO: 2547 - DNA, 23 bp, Homo sapiens
gctgaagaaagctgagttgaagg

SEQ ID NO: 2548 - DNA, 23 bp, Homo sapiens
cagtctagaacttctacctccgg

SEQ ID NO: 2549 - DNA, 23 bp, Homo sapiens
atttggatgagactgattagggg

SEQ ID NO: 2550 - DNA, 23 bp, Homo sapiens
tggtacttaagtcttccttctgg

SEQ ID NO: 2551 - DNA, 23 bp, Homo sapiens
tttcatccttttcgatgtggtgg

SEQ ID NO: 2552 - DNA, 23 bp, Homo sapiens
cacatttctctattagccacagg

SEQ ID NO: 2553 - DNA, 23 bp, Homo sapiens
tggaagaggtcttctcaaaccgg

SEQ ID NO: 2554 - DNA, 23 bp, Homo sapiens
gctgccgaagctaccaaaaaagg

SEQ ID NO: 2555 - DNA, 23 bp, Homo sapiens
ttgaaacctgatgactgatttgg

SEQ ID NO: 2556 - DNA, 23 bp, Homo sapiens
cttgtcttccagttgctaatagg

SEQ ID NO: 2557 - DNA, 23 bp, Homo sapiens
tgctggccagcggggcactgagg

SEQ ID NO: 2558 - DNA, 23 bp, Homo sapiens
tcatcgccatttaactgagttgg

SEQ ID NO: 2559 - DNA, 23 bp, Homo sapiens
gatgaacatgttgtgtctctagg

SEQ ID NO: 2560 - DNA, 23 bp, Homo sapiens
taaaatgctgtcaagttggctgg

SEQ ID NO: 2561 - DNA, 23 bp, Homo sapiens
ccagaagacccaggcagtgtagg

SEQ ID NO: 2562 - DNA, 23 bp, Homo sapiens
tcggagatggaggtgtaggctgg

SEQ ID NO: 2563 - DNA, 23 bp, Homo sapiens
taacattctgatctaggcgatgg

SEQ ID NO: 2564 - DNA, 23 bp, Homo sapiens
gagactctgctgcatacacttgg

SEQ ID NO: 2565 - DNA, 23 bp, Homo sapiens
tcaattgtgtcaggcatcactgg

SEQ ID NO: 2566 - DNA, 23 bp, Homo sapiens
ttcctgcctcattcactcattgg

SEQ ID NO: 2567 - DNA, 23 bp, Homo sapiens
gaggggaccgtgtgtttgctagg

SEQ ID NO: 2568 - DNA, 23 bp, Homo sapiens
gaagacagtcaatatcgtgaagg

SEQ ID NO: 2569 - DNA, 23 bp, Homo sapiens
atggctcctcctgagccggcagg

SEQ ID NO: 2570 - DNA, 23 bp, Homo sapiens
cgtgcctggaccgcgcctaccgg

SEQ ID NO: 2571 - DNA, 23 bp, Homo sapiens
tgagccggcaggctcccggtagg

SEQ ID NO: 2572 - DNA, 23 bp, Homo sapiens
ttggttgcgaattgccaggaggg

SEQ ID NO: 2573 - DNA, 23 bp, Homo sapiens
caatgatatccaggtcttacagg

SEQ ID NO: 2574 - DNA, 23 bp, Homo sapiens
agttctcaggattcaggctctgg

SEQ ID NO: 2575 - DNA, 23 bp, Homo sapiens
gacacaggctgaaatgccaaagg

SEQ ID NO: 2576 - DNA, 23 bp, Homo sapiens
gccacggggatgcttcaggatgg

SEQ ID NO: 2577 - DNA, 23 bp, Homo sapiens
gacccctgaaagaacaagaatgg

SEQ ID NO: 2578 - DNA, 23 bp, Homo sapiens
tgggagactggagtttaaactgg

SEQ ID NO: 2579 - DNA, 23 bp, Homo sapiens
tcacagcttgattttgtttgagg

SEQ ID NO: 2580 - DNA, 23 bp, Homo sapiens
tgctaagttctcagtcttgatgg

SEQ ID NO: 2581 - DNA, 23 bp, Homo sapiens
gaacaattgggaatctcctgagg

SEQ ID NO: 2582 - DNA, 23 bp, Homo sapiens
caggactcttgaacattctcagg

SEQ ID NO: 2583 - DNA, 23 bp, Homo sapiens
cttgagcagcaaagtactggagg

SEQ ID NO: 2584 - DNA, 23 bp, Homo sapiens
tcacatagcaactcccaaaatgg

SEQ ID NO: 2585 - DNA, 23 bp, Homo sapiens
tgacagcagctagtggtgcgggg

SEQ ID NO: 2586 - DNA, 23 bp, Homo sapiens
gctgagctctatctcataagagg

SEQ ID NO: 2587 - DNA, 23 bp, Homo sapiens
actgcatcctggaaagtgtttgg

SEQ ID NO: 2588 - DNA, 23 bp, Homo sapiens
gggcgaaggcaaatacaggaagg

SEQ ID NO: 2589 - DNA, 23 bp, Homo sapiens
cccttcggccagtcttaaacggg

SEQ ID NO: 2590 - DNA, 23 bp, Homo sapiens
gggcctttggaaatttatcaagg

SEQ ID NO: 2591 - DNA, 23 bp, Homo sapiens
aagaggaggaatctgttctctgg

SEQ ID NO: 2592 - DNA, 23 bp, Homo sapiens
aagagaacccctggctcaggagg

SEQ ID NO: 2593 - DNA, 23 bp, Homo sapiens
caaggtcaaggatcagggcttgg

SEQ ID NO: 2594 - DNA, 23 bp, Homo sapiens
gtctccagggacttggctcgagg

SEQ ID NO: 2595 - DNA, 23 bp, Homo sapiens
ccaagccctaggttgcagtgggg

SEQ ID NO: 2596 - DNA, 23 bp, Homo sapiens
agaataaaatctgcatgtcctgg

SEQ ID NO: 2597 - DNA, 23 bp, Homo sapiens
tgattcacaaacaggaaacaagg

SEQ ID NO: 2598 - DNA, 23 bp, Homo sapiens
agagtttgtgaatttcaggtagg

SEQ ID NO: 2599 - DNA, 23 bp, Homo sapiens
acagagtggtgttacggcggtgg

SEQ ID NO: 2600 - DNA, 23 bp, Homo sapiens
gcaagacacagctttcaatctgg

SEQ ID NO: 2601 - DNA, 23 bp, Homo sapiens
ggggagcggcgtcttaattacgg

SEQ ID NO: 2602 - DNA, 23 bp, Homo sapiens
aggcacggctctgggcactgagg

SEQ ID NO: 2603 - DNA, 23 bp, Homo sapiens
caaaggacctggaacctcagggg

SEQ ID NO: 2604 - DNA, 23 bp, Homo sapiens
gaggtgctgtatttcctaattgg

SEQ ID NO: 2605 - DNA, 23 bp, Homo sapiens
agaggggagacccgggaaagggg

SEQ ID NO: 2606 - DNA, 23 bp, Homo sapiens
tcatggagagaagctttgtatgg

SEQ ID NO: 2607 - DNA, 23 bp, Homo sapiens
tgaagtgccccctaattttcagg

SEQ ID NO: 2608 - DNA, 23 bp, Homo sapiens
atgaacaccttgcttcacttcgg

SEQ ID NO: 2609 - DNA, 23 bp, Homo sapiens
tgcttttcagaatgtagtcctgg

SEQ ID NO: 2610 - DNA, 23 bp, Homo sapiens
tgctggtcagtactctactctgg

SEQ ID NO: 2611 - DNA, 23 bp, Homo sapiens
aaccgctttctcagaactgtagg

SEQ ID NO: 2612 - DNA, 23 bp, Homo sapiens
agtgtttaacaagtacttgctgg

SEQ ID NO: 2613 - DNA, 23 bp, Homo sapiens
cagggcctccaggagcctactgg

SEQ ID NO: 2614 - DNA, 23 bp, Homo sapiens
ctgtcagttgtgtagtcttttgg

SEQ ID NO: 2615 - DNA, 23 bp, Homo sapiens
ttcaggcccatccgctaggctgg

SEQ ID NO: 2616 - DNA, 23 bp, Homo sapiens
gggatgaagcaccaattctatgg

SEQ ID NO: 2617 - DNA, 23 bp, Homo sapiens
ttcttaactgctgtcagttctgg

SEQ ID NO: 2618 - DNA, 23 bp, Homo sapiens
gctggcacggtgctacttgacgg

SEQ ID NO: 2619 - DNA, 23 bp, Homo sapiens
cgggagatctttttcagctaggg

SEQ ID NO: 2620 - DNA, 23 bp, Homo sapiens
gtctgtctcttcagatttcaggg

SEQ ID NO: 2621 - DNA, 23 bp, Homo sapiens
gctgcagctgctctcctagtggg

SEQ ID NO: 2622 - DNA, 23 bp, Homo sapiens
atcactgtcacagccgtcaccgg

SEQ ID NO: 2623 - DNA, 23 bp, Homo sapiens
ggacagccgattaatgtcctagg

SEQ ID NO: 2624 - DNA, 23 bp, Homo sapiens
aggatttatttgagctctgctgg

SEQ ID NO: 2625 - DNA, 23 bp, Homo sapiens
gggtctggggttccccctagagg

SEQ ID NO: 2626 - DNA, 23 bp, Homo sapiens
gagagggaaggcaggaactaggg

SEQ ID NO: 2627 - DNA, 23 bp, Homo sapiens
aagtgaaaggtgcatatctacgg

SEQ ID NO: 2628 - DNA, 23 bp, Homo sapiens
tgctggtttcacaaatgaggagg

SEQ ID NO: 2629 - DNA, 23 bp, Homo sapiens
cttgggtttcacagaagcatcgg

SEQ ID NO: 2630 - DNA, 23 bp, Homo sapiens
cctgacagatcagctatggcagg

SEQ ID NO: 2631 - DNA, 23 bp, Homo sapiens
tacagacgcaggcttgctgaggg

SEQ ID NO: 2632 - DNA, 23 bp, Homo sapiens
cagtcaagtgtttctgaagcagg

SEQ ID NO: 2633 - DNA, 23 bp, Homo sapiens
tgcagaccagttccacgtcctgg

SEQ ID NO: 2634 - DNA, 23 bp, Homo sapiens
gtgttcagtgagagtagagaagg

SEQ ID NO: 2635 - DNA, 23 bp, Homo sapiens
acatgcctgatgaagagtttagg

SEQ ID NO: 2636 - DNA, 23 bp, Homo sapiens
gatgatgcaatggaattgctggg

SEQ ID NO: 2637 - DNA, 23 bp, Homo sapiens
tgtcctacgctggtctactctgg

SEQ ID NO: 2638 - DNA, 23 bp, Homo sapiens
catcagcttcgctgggtttgtgg

SEQ ID NO: 2639 - DNA, 23 bp, Homo sapiens
ttctgttctctaaccttggaagg

SEQ ID NO: 2640 - DNA, 23 bp, Homo sapiens
tgaagagggtcacctttagtcgg

SEQ ID NO: 2641 - DNA, 23 bp, Homo sapiens
tcattaacaatcaccagctctgg

SEQ ID NO: 2642 - DNA, 23 bp, Homo sapiens
agtccagggacctccctgaaagg

SEQ ID NO: 2643 - DNA, 23 bp, Homo sapiens
cgagcaaaaaacctttctgtagg

SEQ ID NO: 2644 - DNA, 23 bp, Homo sapiens
ttgctttcatgacgctgctgagg

SEQ ID NO: 2645 - DNA, 23 bp, Homo sapiens
agcgaaggcaaggaagtagaagg

SEQ ID NO: 2646 - DNA, 23 bp, Homo sapiens
agatacaaatcttggcttagtgg

SEQ ID NO: 2647 - DNA, 23 bp, Homo sapiens
gcggctcggtcgccctgagcggg

SEQ ID NO: 2648 - DNA, 23 bp, Homo sapiens
ggtttctaattcaggagttctgg

SEQ ID NO: 2649 - DNA, 23 bp, Homo sapiens
ttctggggcacaggtgattctgg

SEQ ID NO: 2650 - DNA, 23 bp, Homo sapiens
tcagagcccatcagtggcagtgg

SEQ ID NO: 2651 - DNA, 23 bp, Homo sapiens
ttctggtttttgcagtacaatgg

SEQ ID NO: 2652 - DNA, 23 bp, Homo sapiens
cactgtacgacatttttcagcgg

SEQ ID NO: 2653 - DNA, 23 bp, Homo sapiens
atttttcattggggaactctagg

SEQ ID NO: 2654 - DNA, 23 bp, Homo sapiens
ttctaggtcccaccgctcagcgg

SEQ ID NO: 2655 - DNA, 23 bp, Homo sapiens
gccatccatctgcgattgagggg

SEQ ID NO: 2656 - DNA, 23 bp, Homo sapiens
ctggagaaaagcatcgtgactgg

SEQ ID NO: 2657 - DNA, 23 bp, Homo sapiens
ccggttccctgggctcatccagg

SEQ ID NO: 2658 - DNA, 23 bp, Homo sapiens
tctctactgactagatttggtgg

SEQ ID NO: 2659 - DNA, 23 bp, Homo sapiens
aactctatcccttgactagtggg

SEQ ID NO: 2660 - DNA, 23 bp, Homo sapiens
agaatgtcaatgatcaaacctgg

SEQ ID NO: 2661 - DNA, 23 bp, Homo sapiens
ttcctagacatccaccggattgg

SEQ ID NO: 2662 - DNA, 23 bp, Homo sapiens
cacaaacccagggagtcaggagg

SEQ ID NO: 2663 - DNA, 23 bp, Homo sapiens
ggtcaaataggtctaattggtgg

SEQ ID NO: 2664 - DNA, 23 bp, Homo sapiens
gcccggaacctgggcttatatgg

SEQ ID NO: 2665 - DNA, 23 bp, Homo sapiens
tgaatctaagggatctggaatgg

SEQ ID NO: 2666 - DNA, 23 bp, Homo sapiens
tgggggctcttggagcctagggg

SEQ ID NO: 2667 - DNA, 23 bp, Homo sapiens
ccatagcttagtgcccaccccgg

SEQ ID NO: 2668 - DNA, 23 bp, Homo sapiens
cctcttgatagatgtcactcggg

SEQ ID NO: 2669 - DNA, 23 bp, Homo sapiens
ggtggccagcgccaacctgctgg

SEQ ID NO: 2670 - DNA, 23 bp, Homo sapiens
cctatcccgactatcgttgctgg

SEQ ID NO: 2671 - DNA, 23 bp, Homo sapiens
tatttattgctctgcccccttgg

SEQ ID NO: 2672 - DNA, 23 bp, Homo sapiens
ttcggatatgggtagtatgacgg

SEQ ID NO: 2673 - DNA, 23 bp, Homo sapiens
ataacatttcggccaccacctgg

SEQ ID NO: 2674 - DNA, 23 bp, Homo sapiens
ccacatgttggcggatgcagtgg

SEQ ID NO: 2675 - DNA, 23 bp, Homo sapiens
tgaaggggctgaggttgacatgg

SEQ ID NO: 2676 - DNA, 23 bp, Homo sapiens
ggcttctcactctgccccagagg

SEQ ID NO: 2677 - DNA, 23 bp, Homo sapiens
gttccatcagtcgttttccttgg

SEQ ID NO: 2678 - DNA, 23 bp, Homo sapiens
caacactgcagccagataagagg

SEQ ID NO: 2679 - DNA, 23 bp, Homo sapiens
aaagaagaggtccacattcaagg

SEQ ID NO: 2680 - DNA, 23 bp, Homo sapiens
cgccaccgccccaatggggttgg

SEQ ID NO: 2681 - DNA, 23 bp, Homo sapiens
atgcaacgtatgcgatgaaacgg

SEQ ID NO: 2682 - DNA, 23 bp, Homo sapiens
aatcaccccagggattcgtaagg

SEQ ID NO: 2683 - DNA, 23 bp, Homo sapiens
attggtgacagctgtcatgaagg

SEQ ID NO: 2684 - DNA, 23 bp, Homo sapiens
tcttgcacactagtgtagaaagg

SEQ ID NO: 2685 - DNA, 23 bp, Homo sapiens
caagcgtcctgctaacgagaagg

SEQ ID NO: 2686 - DNA, 23 bp, Homo sapiens
ctcggctgaggtttttttgaagg

SEQ ID NO: 2687 - DNA, 23 bp, Homo sapiens
attgatttagaagacacaggagg

SEQ ID NO: 2688 - DNA, 23 bp, Homo sapiens
acacaagcagctgacaaaatagg

SEQ ID NO: 2689 - DNA, 23 bp, Homo sapiens
ctcactgttctgcccttcagagg

SEQ ID NO: 2690 - DNA, 23 bp, Homo sapiens
aatgaatggctcctcaagtaggg

SEQ ID NO: 2691 - DNA, 23 bp, Homo sapiens
aaggggagtctcagcgaccatgg

SEQ ID NO: 2692 - DNA, 23 bp, Homo sapiens
gagactgaggcccacgcttgagg

SEQ ID NO: 2693 - DNA, 23 bp, Homo sapiens
ggaaagaggctctcactttgcgg

SEQ ID NO: 2694 - DNA, 23 bp, Homo sapiens
ctcagcacaagccacgactgagg

SEQ ID NO: 2695 - DNA, 23 bp, Homo sapiens
tatgggaccatcttatttgaagg

SEQ ID NO: 2696 - DNA, 23 bp, Homo sapiens
gtgagagcttccttcaaatgagg

SEQ ID NO: 2697 - DNA, 23 bp, Homo sapiens
tggccggcttcctgcgatgatgg

SEQ ID NO: 2698 - DNA, 23 bp, Homo sapiens
aggccactaatgagggcacaagg

SEQ ID NO: 2699 - DNA, 23 bp, Homo sapiens
gaatgttttagggggttgcttgg

SEQ ID NO: 2700 - DNA, 23 bp, Homo sapiens
acacgccaccccttggctctggg

SEQ ID NO: 2701 - DNA, 23 bp, Homo sapiens
ttaagaagagcattgaactgagg

SEQ ID NO: 2702 - DNA, 23 bp, Homo sapiens
gcagatgggcagctcaggcccgg

SEQ ID NO: 2703 - DNA, 23 bp, Homo sapiens
ctaatgactctgtcactaagagg

SEQ ID NO: 2704 - DNA, 23 bp, Homo sapiens
tggacgtaaagtggggatgccgg

SEQ ID NO: 2705 - DNA, 23 bp, Homo sapiens
tagccgagactggagcctagagg

SEQ ID NO: 2706 - DNA, 23 bp, Homo sapiens
atcaagttaaatacctaggctgg

SEQ ID NO: 2707 - DNA, 23 bp, Homo sapiens
gattaagcttcttgctgagctgg

SEQ ID NO: 2708 - DNA, 23 bp, Homo sapiens
ggggccggggagctcttcaaggg

SEQ ID NO: 2709 - DNA, 23 bp, Homo sapiens
aaaactgcaaatacaggaagagg

SEQ ID NO: 2710 - DNA, 23 bp, Homo sapiens
cgactacatggacatttgagggg

SEQ ID NO: 2711 - DNA, 23 bp, Homo sapiens
ggggccagtgctaggaactctgg

SEQ ID NO: 2712 - DNA, 23 bp, Homo sapiens
ggggcctctgctagaactgctgg

SEQ ID NO: 2713 - DNA, 23 bp, Homo sapiens
aggggccctcgcggcctcagcgg

SEQ ID NO: 2714 - DNA, 23 bp, Homo sapiens
agtttgtgcgaatgatgtctcgg

SEQ ID NO: 2715 - DNA, 23 bp, Homo sapiens
attccctcctggagcctcagtgg

SEQ ID NO: 2716 - DNA, 23 bp, Homo sapiens
aagatgatgtctcgctgaggagg

SEQ ID NO: 2717 - DNA, 23 bp, Homo sapiens
gccaaccaggtgctgcgcagtgg

SEQ ID NO: 2718 - DNA, 23 bp, Homo sapiens
agacacctccacaactgaaacgg

SEQ ID NO: 2719 - DNA, 23 bp, Homo sapiens
acgtttgtgagcagtagtcacgg

SEQ ID NO: 2720 - DNA, 23 bp, Homo sapiens
ggggaatcaacagctgaataagg

SEQ ID NO: 2721 - DNA, 23 bp, Homo sapiens
cctggagggggagctgtgaaggg

SEQ ID NO: 2722 - DNA, 23 bp, Homo sapiens
tggacagtccaggcctcacttgg

SEQ ID NO: 2723 - DNA, 23 bp, Homo sapiens
atcgacagtgtgtaccgtgacgg

SEQ ID NO: 2724 - DNA, 23 bp, Homo sapiens
gccgagagcacatggcgcaccgg

SEQ ID NO: 2725 - DNA, 23 bp, Homo sapiens
acagcgagagtgacgatgattgg

SEQ ID NO: 2726 - DNA, 23 bp, Homo sapiens
gtgagactgggaggtcagggagg

SEQ ID NO: 2727 - DNA, 23 bp, Homo sapiens
cacggtgcagctagcaccagtgg

SEQ ID NO: 2728 - DNA, 23 bp, Homo sapiens
catctggcagcgcccactacagg

SEQ ID NO: 2729 - DNA, 23 bp, Homo sapiens
gcccctcgctgggggctacaagg

SEQ ID NO: 2730 - DNA, 23 bp, Homo sapiens
aagaagatgacaaatgctagagg

SEQ ID NO: 2731 - DNA, 23 bp, Homo sapiens
ggggaggggtgggaattcagagg

SEQ ID NO: 2732 - DNA, 23 bp, Homo sapiens
gaaagtggggcaggactcagggg

SEQ ID NO: 2733 - DNA, 23 bp, Homo sapiens
gcagatgaccccgtgtagctcgg

SEQ ID NO: 2734 - DNA, 23 bp, Homo sapiens
ccagcaagaggaagagatgaggg

SEQ ID NO: 2735 - DNA, 23 bp, Homo sapiens
ctgtgtgggcatcacagccttgg

SEQ ID NO: 2736 - DNA, 23 bp, Homo sapiens
tctgcattgaaaatctcttcggg

SEQ ID NO: 2737 - DNA, 23 bp, Homo sapiens
ttttagaaggtcataacaggcgg

SEQ ID NO: 2738 - DNA, 23 bp, Homo sapiens
gggtggggcagggtgctcagagg

SEQ ID NO: 2739 - DNA, 23 bp, Homo sapiens
tgcttttgatgctcttctcaagg

SEQ ID NO: 2740 - DNA, 23 bp, Homo sapiens
aggctgggtggtgtcaccgcagg

SEQ ID NO: 2741 - DNA, 23 bp, Homo sapiens
aggcgtctacattcgctgagagg

SEQ ID NO: 2742 - DNA, 23 bp, Homo sapiens
gcaggaacatgccatgtagtggg

SEQ ID NO: 2743 - DNA, 23 bp, Homo sapiens
cacaaacgggcaaaactcattgg

SEQ ID NO: 2744 - DNA, 23 bp, Homo sapiens
aggctgtcagtagctatccttgg

SEQ ID NO: 2745 - DNA, 23 bp, Homo sapiens
attagactcaaagcctatgtcgg

SEQ ID NO: 2746 - DNA, 23 bp, Homo sapiens
gccgcaggagggttagtgctcgg

SEQ ID NO: 2747 - DNA, 23 bp, Homo sapiens
cgaggcccgcggtctttatacgg

SEQ ID NO: 2748 - DNA, 23 bp, Homo sapiens
aggtcagaggtcagttcagacgg

SEQ ID NO: 2749 - DNA, 23 bp, Homo sapiens
aaagggcaggcggctcacacagg

SEQ ID NO: 2750 - DNA, 23 bp, Homo sapiens
gggggcggccgaggctcagcagg

SEQ ID NO: 2751 - DNA, 23 bp, Homo sapiens
gtctcacgcgtggctctaggtgg

SEQ ID NO: 2752 - DNA, 23 bp, Homo sapiens
tccgaggggcgggcctcagcagg

SEQ ID NO: 2753 - DNA, 23 bp, Homo sapiens
ggaaaaccacgcctgtgtagggg

SEQ ID NO: 2754 - DNA, 23 bp, Homo sapiens
gctaccgctatcggcggtgacgg

SEQ ID NO: 2755 - DNA, 23 bp, Homo sapiens
cattcactatctgtaccccctgg

SEQ ID NO: 2756 - DNA, 23 bp, Homo sapiens
gaagcaagccaaaggagacacgg

SEQ ID NO: 2757 - DNA, 23 bp, Homo sapiens
accgtgctgggccgtttctaggg

SEQ ID NO: 2758 - DNA, 23 bp, Homo sapiens
gctataatcaatgcagaaggagg

SEQ ID NO: 2759 - DNA, 23 bp, Homo sapiens
ttttctcttcagcattgacttgg

SEQ ID NO: 2760 - DNA, 23 bp, Homo sapiens
gtcaggaggggacgacaagaagg

SEQ ID NO: 2761 - DNA, 23 bp, Homo sapiens
cgacggacacaagaggaaagagg

SEQ ID NO: 2762 - DNA, 23 bp, Homo sapiens
cagcatgaaggacagcgatgagg

SEQ ID NO: 2763 - DNA, 23 bp, Homo sapiens
gacagtgacgaagaagaagaagg

SEQ ID NO: 2764 - DNA, 23 bp, Homo sapiens
aggatacaggctgggcgcggtgg

SEQ ID NO: 2765 - DNA, 23 bp, Homo sapiens
tggttttctggctttttctctgg

SEQ ID NO: 2766 - DNA, 23 bp, Homo sapiens
tgctcttattctctgtgctgggg

SEQ ID NO: 2767 - DNA, 23 bp, Homo sapiens
agcgagccccccatgtaaagtgg

SEQ ID NO: 2768 - DNA, 23 bp, Homo sapiens
tctcgtacagatccttcaaaagg

SEQ ID NO: 2769 - DNA, 23 bp, Homo sapiens
aggaaagggaggagtttagttgg

SEQ ID NO: 2770 - DNA, 23 bp, Homo sapiens
attcagctgctcaggcttgaagg

SEQ ID NO: 2771 - DNA, 23 bp, Homo sapiens
attcatctgctcaggcttgaagg

SEQ ID NO: 2772 - DNA, 23 bp, Homo sapiens
gagggagtaagatcactcaaagg

SEQ ID NO: 2773 - DNA, 23 bp, Homo sapiens
gttgggatactcagagagagtgg

SEQ ID NO: 2774 - DNA, 23 bp, Homo sapiens
tctcagcactctcctcgccttgg

SEQ ID NO: 2775 - DNA, 23 bp, Homo sapiens
tgtcctagtgaacacttaaatgg

SEQ ID NO: 2776 - DNA, 23 bp, Homo sapiens
taaggtcacttcccccactaagg

SEQ ID NO: 2777 - DNA, 23 bp, Homo sapiens
acctacttcagcaaagtgtgagg

SEQ ID NO: 2778 - DNA, 23 bp, Homo sapiens
gccctgctcccctcctaaggagg

SEQ ID NO: 2779 - DNA, 23 bp, Homo sapiens
tcacaacacaccgacgtgtaggg

SEQ ID NO: 2780 - DNA, 23 bp, Homo sapiens
aatgaggaagacagatcaagagg

SEQ ID NO: 2781 - DNA, 23 bp, Homo sapiens
ggtggatgagctacatattgtgg

SEQ ID NO: 2782 - DNA, 23 bp, Homo sapiens
cttggctttgtagattcatctgg

SEQ ID NO: 2783 - DNA, 23 bp, Homo sapiens
gaagcagatattgatggagacgg

SEQ ID NO: 2784 - DNA, 23 bp, Homo sapiens
gaagcagatattgatggtgatgg

SEQ ID NO: 2785 - DNA, 23 bp, Homo sapiens
agatgatgactgcaaagtgaagg

SEQ ID NO: 2786 - DNA, 23 bp, Homo sapiens
tggtgggcgccggcctcacttgg

SEQ ID NO: 2787 - DNA, 23 bp, Homo sapiens
ttcctggacgggactattgaagg

SEQ ID NO: 2788 - DNA, 23 bp, Homo sapiens
aggatgctcgcccaggagtgagg

SEQ ID NO: 2789 - DNA, 23 bp, Homo sapiens
gctgcggcagctgcacctactgg

SEQ ID NO: 2790 - DNA, 23 bp, Homo sapiens
ccagatactccggagcggcatgg

SEQ ID NO: 2791 - DNA, 23 bp, Homo sapiens
gccaaggacgagctgtagagagg

SEQ ID NO: 2792 - DNA, 23 bp, Homo sapiens
tgctgtcgggaaaaattaacagg

SEQ ID NO: 2793 - DNA, 23 bp, Homo sapiens
gaactcatcatgccgtactaagg

SEQ ID NO: 2794 - DNA, 23 bp, Homo sapiens
cttgtcaacgatctcctccttgg

SEQ ID NO: 2795 - DNA, 23 bp, Homo sapiens
gggctggagacgtcactgcgcgg

SEQ ID NO: 2796 - DNA, 23 bp, Homo sapiens
acactgccccaccagctctaggg

SEQ ID NO: 2797 - DNA, 23 bp, Homo sapiens
ctcgtcttcagtgtcagctgagg

SEQ ID NO: 2798 - DNA, 23 bp, Homo sapiens
gcactctggaagcaagtgactgg

SEQ ID NO: 2799 - DNA, 23 bp, Homo sapiens
cactgccgggcagggcagactgg

SEQ ID NO: 2800 - DNA, 23 bp, Homo sapiens
cgtccacttccacagatctgggg

SEQ ID NO: 2801 - DNA, 23 bp, Homo sapiens
cttcactgcagcggggccacagg

SEQ ID NO: 2802 - DNA, 23 bp, Homo sapiens
accaaaaagctttctgctagggg

SEQ ID NO: 2803 - DNA, 23 bp, Homo sapiens
atgttcattttcatcgctcgggg

SEQ ID NO: 2804 - DNA, 23 bp, Homo sapiens
atttacttgatgggtactgttgg

SEQ ID NO: 2805 - DNA, 23 bp, Homo sapiens
tctttgtggcaaaacatctaagg

SEQ ID NO: 2806 - DNA, 23 bp, Homo sapiens
ctcactgcagcggtgcggcaggg

SEQ ID NO: 2807 - DNA, 23 bp, Homo sapiens
ttatttcttgccgggcgcggtgg

SEQ ID NO: 2808 - DNA, 23 bp, Homo sapiens
ctttgggggagttagacaccagg

SEQ ID NO: 2809 - DNA, 23 bp, Homo sapiens
cgcgcgcggccagggatgtttgg

SEQ ID NO: 2810 - DNA, 23 bp, Homo sapiens
aaggaagctgtttagtactctgg

SEQ ID NO: 2811 - DNA, 23 bp, Homo sapiens
ccaccagtacttacaccagtagg

SEQ ID NO: 2812 - DNA, 23 bp, Homo sapiens
ccccggcgtccaggaagacgagg

SEQ ID NO: 2813 - DNA, 23 bp, Homo sapiens
agacagggactcacattccctgg

SEQ ID NO: 2814 - DNA, 23 bp, Homo sapiens
gagcgatccaggcagctactcgg

SEQ ID NO: 2815 - DNA, 23 bp, Homo sapiens
ggaggaagtgctcttgtgagagg

SEQ ID NO: 2816 - DNA, 23 bp, Homo sapiens
tggctggacaggcgggtgtgagg

SEQ ID NO: 2817 - DNA, 23 bp, Homo sapiens
ttggtcaaaataagcagaagcgg

SEQ ID NO: 2818 - DNA, 23 bp, Homo sapiens
agggaggaggccagctgagtagg

SEQ ID NO: 2819 - DNA, 23 bp, Homo sapiens
gacttcgcccattttgctatagg

SEQ ID NO: 2820 - DNA, 23 bp, Homo sapiens
cacacactaggactctgtcctgg

SEQ ID NO: 2821 - DNA, 23 bp, Homo sapiens
accggggtcatttacgagtctgg

SEQ ID NO: 2822 - DNA, 23 bp, Homo sapiens
tcccaacttctatgccttagtgg

SEQ ID NO: 2823 - DNA, 23 bp, Homo sapiens
accgcccgggtggggctatttgg

SEQ ID NO: 2824 - DNA, 23 bp, Homo sapiens
aaagcaatgtcacattgctaagg

SEQ ID NO: 2825 - DNA, 23 bp, Homo sapiens
cacggtgttgagaacacagtagg

SEQ ID NO: 2826 - DNA, 23 bp, Homo sapiens
ctgtatgtcttcaagttccttgg

SEQ ID NO: 2827 - DNA, 23 bp, Homo sapiens
taccaaaagagaggcaccgctgg

SEQ ID NO: 2828 - DNA, 23 bp, Homo sapiens
ttccaatgtgtcagccctcatgg

SEQ ID NO: 2829 - DNA, 23 bp, Homo sapiens
cgcctcgtgcagtcttaacaggg

SEQ ID NO: 2830 - DNA, 23 bp, Homo sapiens
ccgggactggccacatgacctgg

SEQ ID NO: 2831 - DNA, 23 bp, Homo sapiens
cagttctaaccctgagctggcgg

SEQ ID NO: 2832 - DNA, 23 bp, Homo sapiens
agcccccagcacagactcaatgg

SEQ ID NO: 2833 - DNA, 23 bp, Homo sapiens
atcggaagcgtgaaatacgaagg

SEQ ID NO: 2834 - DNA, 23 bp, Homo sapiens
agattgtttcactctcttcgtgg

SEQ ID NO: 2835 - DNA, 23 bp, Homo sapiens
accacagtgacagaaattgctgg

SEQ ID NO: 2836 - DNA, 23 bp, Homo sapiens
cactgaacctgcagaaattatgg

SEQ ID NO: 2837 - DNA, 23 bp, Homo sapiens
ttttcaaggactggaaatgaggg

SEQ ID NO: 2838 - DNA, 23 bp, Homo sapiens
cagctgaccatgtttgcatgagg

SEQ ID NO: 2839 - DNA, 23 bp, Homo sapiens
gcagtgatgaaaacctaacaggg

SEQ ID NO: 2840 - DNA, 23 bp, Homo sapiens
agatgaccatgtggggatagagg

SEQ ID NO: 2841 - DNA, 23 bp, Homo sapiens
ggaggtggccaccttctcctagg

SEQ ID NO: 2842 - DNA, 23 bp, Homo sapiens
tgcttcagttgtacatgaccagg

SEQ ID NO: 2843 - DNA, 23 bp, Homo sapiens
atggcactgtactcctgagaagg

SEQ ID NO: 2844 - DNA, 23 bp, Homo sapiens
ggcatggtggtcacagcggtcgg

SEQ ID NO: 2845 - DNA, 23 bp, Homo sapiens
cagctggatcccgagaatactgg

SEQ ID NO: 2846 - DNA, 23 bp, Homo sapiens
cagcctggttcaggcatacatgg

SEQ ID NO: 2847 - DNA, 23 bp, Homo sapiens
gcaggtgtcagacagccatgagg

SEQ ID NO: 2848 - DNA, 23 bp, Homo sapiens
gagctcagtgagatcatcgctgg

SEQ ID NO: 2849 - DNA, 23 bp, Homo sapiens
agatcacacaacttcagtgatgg

SEQ ID NO: 2850 - DNA, 23 bp, Homo sapiens
tgctgcgtgttggtctgacccgg

SEQ ID NO: 2851 - DNA, 23 bp, Homo sapiens
ggctctcagtacaaagaacaagg

SEQ ID NO: 2852 - DNA, 23 bp, Homo sapiens
ctgactatgtattcctgaactgg

SEQ ID NO: 2853 - DNA, 23 bp, Homo sapiens
ttgaccatgtattcctgaagtgg

SEQ ID NO: 2854 - DNA, 23 bp, Homo sapiens
cacgaggtaatattttgtggtgg

SEQ ID NO: 2855 - DNA, 23 bp, Homo sapiens
acttgctgagtgttcatttgcgg

SEQ ID NO: 2856 - DNA, 23 bp, Homo sapiens
agggtggagtgattcttctcagg

SEQ ID NO: 2857 - DNA, 23 bp, Homo sapiens
gagcaatttatggaagtagctgg

SEQ ID NO: 2858 - DNA, 23 bp, Homo sapiens
cggagctgctcacagctgccagg

SEQ ID NO: 2859 - DNA, 23 bp, Homo sapiens
attaaagactaaatcccccatgg

SEQ ID NO: 2860 - DNA, 23 bp, Homo sapiens
ggcaatggcaaggttgattatgg

SEQ ID NO: 2861 - DNA, 23 bp, Homo sapiens
gtcatgtgcttaaagcttccagg

SEQ ID NO: 2862 - DNA, 23 bp, Homo sapiens
aagatactcagctacaagattgg

SEQ ID NO: 2863 - DNA, 23 bp, Homo sapiens
aagatccttagctacaagattgg

SEQ ID NO: 2864 - DNA, 23 bp, Homo sapiens
caagaagtgtgttgtgcaactgg

SEQ ID NO: 2865 - DNA, 23 bp, Homo sapiens
ttctcttcaaagcctccaccagg

SEQ ID NO: 2866 - DNA, 23 bp, Homo sapiens
caggtctcgatactggtcaaagg

SEQ ID NO: 2867 - DNA, 23 bp, Homo sapiens
agaagctctgaagaatgacctgg

SEQ ID NO: 2868 - DNA, 23 bp, Homo sapiens
cctggatcggcttaattatcagg

SEQ ID NO: 2869 - DNA, 23 bp, Homo sapiens
cccagcagcagtgaggcctgagg

SEQ ID NO: 2870 - DNA, 23 bp, Homo sapiens
gacgaggaccagctgtgaggcgg

SEQ ID NO: 2871 - DNA, 23 bp, Homo sapiens
agaacgctttacgtcagcccagg

SEQ ID NO: 2872 - DNA, 23 bp, Homo sapiens
gaaggggcacggtgcatcatcgg

SEQ ID NO: 2873 - DNA, 23 bp, Homo sapiens
gctcgaggcagctgctcacctgg

SEQ ID NO: 2874 - DNA, 23 bp, Homo sapiens
tgtgtactaagctaatttccagg

SEQ ID NO: 2875 - DNA, 23 bp, Homo sapiens
ttaggtaaagagttgcaaactgg

SEQ ID NO: 2876 - DNA, 23 bp, Homo sapiens
tcaaatagtacttccttcctagg

SEQ ID NO: 2877 - DNA, 23 bp, Homo sapiens
cctcaacttgcctcaaagatggg

SEQ ID NO: 2878 - DNA, 23 bp, Homo sapiens
gcccccctaggtcatctgccagg

SEQ ID NO: 2879 - DNA, 23 bp, Homo sapiens
gggtctgtcagagcccccctagg

SEQ ID NO: 2880 - DNA, 23 bp, Homo sapiens
aagcagggcagaagaggggaggg

SEQ ID NO: 2881 - DNA, 23 bp, Homo sapiens
tgtgtgacaaatgatacgtaagg

SEQ ID NO: 2882 - DNA, 23 bp, Homo sapiens
gctgtctaagataggacacgagg

SEQ ID NO: 2883 - DNA, 23 bp, Homo sapiens
gggctgatgcagctacaagctgg

SEQ ID NO: 2884 - DNA, 23 bp, Homo sapiens
tccccctcctgcgcgctgagcgg

SEQ ID NO: 2885 - DNA, 23 bp, Homo sapiens
agcgacaacaccgacactgaggg

SEQ ID NO: 2886 - DNA, 23 bp, Homo sapiens
cattggggccgtttgttaagcgg

SEQ ID NO: 2887 - DNA, 23 bp, Homo sapiens
caaagaaccagcattgtctatgg

SEQ ID NO: 2888 - DNA, 23 bp, Homo sapiens
tttaacttggctcacagaaatgg

SEQ ID NO: 2889 - DNA, 23 bp, Homo sapiens
cagagcgagagctaaaattgagg

SEQ ID NO: 2890 - DNA, 23 bp, Homo sapiens
tgcttttaatgctcttcagatgg

SEQ ID NO: 2891 - DNA, 23 bp, Homo sapiens
ccatgcactacgggagctagggg

SEQ ID NO: 2892 - DNA, 23 bp, Homo sapiens
ctctttttctgcttcttccccgg

SEQ ID NO: 2893 - DNA, 23 bp, Homo sapiens
gagaggagaggatcagggattgg

SEQ ID NO: 2894 - DNA, 23 bp, Homo sapiens
ggcagttgtcagtctgttcctgg

SEQ ID NO: 2895 - DNA, 23 bp, Homo sapiens
tggtccgtaagccacaataatgg

SEQ ID NO: 2896 - DNA, 23 bp, Homo sapiens
agtgctatttgaagtgagacagg

SEQ ID NO: 2897 - DNA, 23 bp, Homo sapiens
gaagagcttcttcagcttcttgg

SEQ ID NO: 2898 - DNA, 23 bp, Homo sapiens
aatggaagcttccagtgaggggg

SEQ ID NO: 2899 - DNA, 23 bp, Homo sapiens
catttgacaaatcaggcacttgg

SEQ ID NO: 2900 - DNA, 23 bp, Homo sapiens
gaccaaaaatcagcgggctgagg

SEQ ID NO: 2901 - DNA, 23 bp, Homo sapiens
ctcctgaagtgcttatgaagggg

SEQ ID NO: 2902 - DNA, 23 bp, Homo sapiens
ttaggagtagctgagcaatctgg

SEQ ID NO: 2903 - DNA, 23 bp, Homo sapiens
ttgcatttggttggagcaagtgg

SEQ ID NO: 2904 - DNA, 23 bp, Homo sapiens
gcgcagctagcgatttcgacagg

SEQ ID NO: 2905 - DNA, 23 bp, Homo sapiens
catcaagccccctccacctgagg

SEQ ID NO: 2906 - DNA, 23 bp, Homo sapiens
agcattcctttaggacttaaagg

SEQ ID NO: 2907 - DNA, 23 bp, Homo sapiens
ctcatctctcttgaaaaggttgg

SEQ ID NO: 2908 - DNA, 23 bp, Homo sapiens
ccctgtctcctgggtctattagg

SEQ ID NO: 2909 - DNA, 23 bp, Homo sapiens
aggcggcgttcactccagcatgg

SEQ ID NO: 2910 - DNA, 23 bp, Homo sapiens
ctggagggctcagtccagcatgg

SEQ ID NO: 2911 - DNA, 23 bp, Homo sapiens
agatgtttctacctcttcccagg

SEQ ID NO: 2912 - DNA, 23 bp, Homo sapiens
acctccctgaaggacagacaagg

SEQ ID NO: 2913 - DNA, 23 bp, Homo sapiens
ctcgaccccccatgcgcaggtgg

SEQ ID NO: 2914 - DNA, 23 bp, Homo sapiens
gctataatgaaagtgcatccagg

SEQ ID NO: 2915 - DNA, 23 bp, Homo sapiens
tgccaagctccaggagctacagg

SEQ ID NO: 2916 - DNA, 23 bp, Homo sapiens
tgtcatggatagtctttcaatgg

SEQ ID NO: 2917 - DNA, 23 bp, Homo sapiens
actgcagatacagccgtttccgg

SEQ ID NO: 2918 - DNA, 23 bp, Homo sapiens
cggtggcagcagtgaacagaagg

SEQ ID NO: 2919 - DNA, 23 bp, Homo sapiens
gatggggaggtgacatcatgtgg

SEQ ID NO: 2920 - DNA, 23 bp, Homo sapiens
atagagttcttttgtgagcatgg

SEQ ID NO: 2921 - DNA, 23 bp, Homo sapiens
agatatttctacctctttcctgg

SEQ ID NO: 2922 - DNA, 23 bp, Homo sapiens
agagatttctacctctttcctgg

SEQ ID NO: 2923 - DNA, 23 bp, Homo sapiens
agttagcattgaggcaaaacagg

SEQ ID NO: 2924 - DNA, 23 bp, Homo sapiens
ggcaactctgtcattcaccctgg

SEQ ID NO: 2925 - DNA, 23 bp, Homo sapiens
ttgactgaagtagagttccttgg

SEQ ID NO: 2926 - DNA, 23 bp, Homo sapiens
gcccaaacttcacagcattaggg

SEQ ID NO: 2927 - DNA, 23 bp, Homo sapiens
ttgtcttcccttctgattgatgg

SEQ ID NO: 2928 - DNA, 23 bp, Homo sapiens
tgcatatttagccgccaagttgg

SEQ ID NO: 2929 - DNA, 23 bp, Homo sapiens
ctggttgctttaatttcctccgg

SEQ ID NO: 2930 - DNA, 23 bp, Homo sapiens
ggagggcgagatcaacacagagg

SEQ ID NO: 2931 - DNA, 23 bp, Homo sapiens
tggattgaggatgtgctttctgg

SEQ ID NO: 2932 - DNA, 23 bp, Homo sapiens
agctttgtcatcagtggtggagg

SEQ ID NO: 2933 - DNA, 23 bp, Homo sapiens
ttcagagggacactgggatgagg

SEQ ID NO: 2934 - DNA, 23 bp, Homo sapiens
tctttagtcatcttttggcttgg

SEQ ID NO: 2935 - DNA, 23 bp, Homo sapiens
caggaaggcctggcttcctgagg

SEQ ID NO: 2936 - DNA, 23 bp, Homo sapiens
caagcagagaagcactagaaggg

SEQ ID NO: 2937 - DNA, 23 bp, Homo sapiens
atcgagggactcacttctcctgg

SEQ ID NO: 2938 - DNA, 23 bp, Homo sapiens
ctgcagcctcctcgccctagcgg

SEQ ID NO: 2939 - DNA, 23 bp, Homo sapiens
agggagaaggcaaatctgtgagg

SEQ ID NO: 2940 - DNA, 23 bp, Homo sapiens
cgctcgggggcggcctaagcggg

SEQ ID NO: 2941 - DNA, 23 bp, Homo sapiens
aggctggagaagaggacttcagg

SEQ ID NO: 2942 - DNA, 23 bp, Homo sapiens
agtgcaggcactgatgaacttgg

SEQ ID NO: 2943 - DNA, 23 bp, Homo sapiens
aaggtggatgagaagtagctggg

SEQ ID NO: 2944 - DNA, 23 bp, Homo sapiens
ggctgctcttgtgttttttaagg

SEQ ID NO: 2945 - DNA, 23 bp, Homo sapiens
cgtggaggacattccaaagatgg

SEQ ID NO: 2946 - DNA, 23 bp, Homo sapiens
accctgtggaccggcctcagtgg

SEQ ID NO: 2947 - DNA, 23 bp, Homo sapiens
ctcccactagaagaagtctgggg

SEQ ID NO: 2948 - DNA, 23 bp, Homo sapiens
tttctttgaggtttgtgaagtgg

SEQ ID NO: 2949 - DNA, 23 bp, Homo sapiens
ggtcatcaactgtctctccacgg

SEQ ID NO: 2950 - DNA, 23 bp, Homo sapiens
tcaagaagcgccggagcaagagg

SEQ ID NO: 2951 - DNA, 23 bp, Homo sapiens
tttctttctgcaagttgatgcgg

SEQ ID NO: 2952 - DNA, 23 bp, Homo sapiens
ggggtccaagtattcaatcctgg

SEQ ID NO: 2953 - DNA, 23 bp, Homo sapiens
ggaccccaggtctggagattggg

SEQ ID NO: 2954 - DNA, 23 bp, Homo sapiens
caaggtggtgctgcggaaggagg

SEQ ID NO: 2955 - DNA, 23 bp, Homo sapiens
ggagtcggacgccgtgctggtgg

SEQ ID NO: 2956 - DNA, 23 bp, Homo sapiens
acggtggctctaagctcaggagg

SEQ ID NO: 2957 - DNA, 23 bp, Homo sapiens
aaatggagagtgtagcctgaggg

SEQ ID NO: 2958 - DNA, 23 bp, Homo sapiens
ttaaagcactcatcgtaaagagg

SEQ ID NO: 2959 - DNA, 23 bp, Homo sapiens
gagggaagcagggagagactggg

SEQ ID NO: 2960 - DNA, 23 bp, Homo sapiens
gtccggggctcagagtccgttgg

SEQ ID NO: 2961 - DNA, 23 bp, Homo sapiens
ccaggggccagtggggtcagcgg

SEQ ID NO: 2962 - DNA, 23 bp, Homo sapiens
cctggttccaatttaggtggtgg

SEQ ID NO: 2963 - DNA, 23 bp, Homo sapiens
tcacagctgctggcagtaactgg

SEQ ID NO: 2964 - DNA, 23 bp, Homo sapiens
tggtgtgctaggtagctacatgg

SEQ ID NO: 2965 - DNA, 23 bp, Homo sapiens
ggctgctatagatttagacgtgg

SEQ ID NO: 2966 - DNA, 23 bp, Homo sapiens
aggaccctgccccggcctgaagg

SEQ ID NO: 2967 - DNA, 23 bp, Homo sapiens
ggtctatatcttgtctgatctgg

SEQ ID NO: 2968 - DNA, 23 bp, Homo sapiens
cctggtgtttcctctctgactgg

SEQ ID NO: 2969 - DNA, 23 bp, Homo sapiens
agggggctctgtgtttatagagg

SEQ ID NO: 2970 - DNA, 23 bp, Homo sapiens
agccaccgccctcgttcaccagg

SEQ ID NO: 2971 - DNA, 23 bp, Homo sapiens
ctttctggtgttccccctatagg

SEQ ID NO: 2972 - DNA, 23 bp, Homo sapiens
agagttgaacagtggtgagctgg

SEQ ID NO: 2973 - DNA, 23 bp, Homo sapiens
atgacaaagttgtgcaaaactgg

SEQ ID NO: 2974 - DNA, 23 bp, Homo sapiens
catgttctggtagtggatggggg

SEQ ID NO: 2975 - DNA, 23 bp, Homo sapiens
agcgctccggacttcacttctgg

SEQ ID NO: 2976 - DNA, 23 bp, Homo sapiens
tgacagaaacagaaaagcagtgg

SEQ ID NO: 2977 - DNA, 23 bp, Homo sapiens
ctctgctgttcagtgaagtgagg

SEQ ID NO: 2978 - DNA, 23 bp, Homo sapiens
tcattctcttctgcctttagtgg

SEQ ID NO: 2979 - DNA, 23 bp, Homo sapiens
ttttttgtcatcatcctccgagg

SEQ ID NO: 2980 - DNA, 23 bp, Homo sapiens
acaggaagcatgcgtacagtagg

SEQ ID NO: 2981 - DNA, 23 bp, Homo sapiens
cggggcttcagtaatgcctcagg

SEQ ID NO: 2982 - DNA, 23 bp, Homo sapiens
agacttggtgctggcgaaagagg

SEQ ID NO: 2983 - DNA, 23 bp, Homo sapiens
ggagtacgtgacggtgtagccgg

SEQ ID NO: 2984 - DNA, 23 bp, Homo sapiens
aagaaacagcaaagagctaaagg

SEQ ID NO: 2985 - DNA, 23 bp, Homo sapiens
attggggcgagcaagtgaggggg

SEQ ID NO: 2986 - DNA, 23 bp, Homo sapiens
tgattcagaacttcccactgcgg

SEQ ID NO: 2987 - DNA, 23 bp, Homo sapiens
aaggaaagtaacacggaccaagg

SEQ ID NO: 2988 - DNA, 23 bp, Homo sapiens
ggggtcttcattttctcttccgg

SEQ ID NO: 2989 - DNA, 23 bp, Homo sapiens
catgatccagccgtgcgctctgg

SEQ ID NO: 2990 - DNA, 23 bp, Homo sapiens
ctgcagcggctccgcaggtgagg

SEQ ID NO: 2991 - DNA, 23 bp, Homo sapiens
gagcccaggggcttgtgaggtgg

SEQ ID NO: 2992 - DNA, 23 bp, Homo sapiens
tggctggttctggagcccagggg

SEQ ID NO: 2993 - DNA, 23 bp, Homo sapiens
tgacagtccggagaggcccacgg

SEQ ID NO: 2994 - DNA, 23 bp, Homo sapiens
cagacgtgagtcaccgtgcctgg

SEQ ID NO: 2995 - DNA, 23 bp, Homo sapiens
ttgcctctcttatacgcaacagg

SEQ ID NO: 2996 - DNA, 23 bp, Homo sapiens
attatctgtgtgggtctatttgg

SEQ ID NO: 2997 - DNA, 23 bp, Homo sapiens
tactgggaaagaatgttacctgg

SEQ ID NO: 2998 - DNA, 23 bp, Homo sapiens
tacactggcaccattctccttgg

SEQ ID NO: 2999 - DNA, 23 bp, Homo sapiens
agccggcacctagcaactgacgg

SEQ ID NO: 3000 - DNA, 23 bp, Homo sapiens
acggtgttgggatgtgctatggg

SEQ ID NO: 3001 - DNA, 23 bp, Homo sapiens
acaggaagctctaggccacctgg

SEQ ID NO: 3002 - DNA, 23 bp, Homo sapiens
aactcaggcacttgcaaaactgg

SEQ ID NO: 3003 - DNA, 23 bp, Homo sapiens
agatttcagtggccacatcctgg

SEQ ID NO: 3004 - DNA, 23 bp, Homo sapiens
atagaagtcagcagacgtctcgg

SEQ ID NO: 3005 - DNA, 23 bp, Homo sapiens
ctgtaccaggttgactgatgcgg

SEQ ID NO: 3006 - DNA, 23 bp, Homo sapiens
ggggacgctggggtcactagggg

SEQ ID NO: 3007 - DNA, 23 bp, Homo sapiens
ccatcacctaccgcttcaagcgg

SEQ ID NO: 3008 - DNA, 23 bp, Homo sapiens
agctggaccccctttttgagcgg

SEQ ID NO: 3009 - DNA, 23 bp, Homo sapiens
gaaggagggacgacagctgaagg

SEQ ID NO: 3010 - DNA, 23 bp, Homo sapiens
tgctatcttgcagcagctcgtgg

SEQ ID NO: 3011 - DNA, 23 bp, Homo sapiens
cagaactctcaagcatcattagg

SEQ ID NO: 3012 - DNA, 23 bp, Homo sapiens
gctattccaacctggagacaagg

SEQ ID NO: 3013 - DNA, 23 bp, Homo sapiens
cctctggctacttcccagcaagg

SEQ ID NO: 3014 - DNA, 23 bp, Homo sapiens
cgtgcccctcgtgttagccccgg

SEQ ID NO: 3015 - DNA, 23 bp, Homo sapiens
cgcgcatgtcaggcagccccagg

SEQ ID NO: 3016 - DNA, 23 bp, Homo sapiens
gatgaggacaaggatgaggatgg

SEQ ID NO: 3017 - DNA, 23 bp, Homo sapiens
gtgacagtggctgctaggagtgg

SEQ ID NO: 3018 - DNA, 23 bp, Homo sapiens
tactagcacagaagaagagatgg

SEQ ID NO: 3019 - DNA, 23 bp, Homo sapiens
ggggcagggcatgcctcagtcgg

SEQ ID NO: 3020 - DNA, 23 bp, Homo sapiens
cacccagaccccggggacactgg

SEQ ID NO: 3021 - DNA, 23 bp, Homo sapiens
tggggggtgcttttactgatggg

SEQ ID NO: 3022 - DNA, 23 bp, Homo sapiens
ttccccaaggcaccaaatcaagg

SEQ ID NO: 3023 - DNA, 23 bp, Homo sapiens
caaatagacgacagtggcaatgg

SEQ ID NO: 3024 - DNA, 23 bp, Homo sapiens
ccccaagttctgggctcacttgg

SEQ ID NO: 3025 - DNA, 23 bp, Homo sapiens
agcatcttaaggacctcttgagg

SEQ ID NO: 3026 - DNA, 23 bp, Homo sapiens
tgatacttgatggcaaagaatgg

SEQ ID NO: 3027 - DNA, 23 bp, Homo sapiens
caatggtactagtgggaatttgg

SEQ ID NO: 3028 - DNA, 23 bp, Homo sapiens
gtggctctatctcaaatactggg

SEQ ID NO: 3029 - DNA, 23 bp, Homo sapiens
aaattgtcctgttggagaaaagg

SEQ ID NO: 3030 - DNA, 23 bp, Homo sapiens
tttctgaagacacaagactctgg

SEQ ID NO: 3031 - DNA, 23 bp, Homo sapiens
gcagaagacaggcaagcaatagg

SEQ ID NO: 3032 - DNA, 23 bp, Homo sapiens
cgctcactcactctccgagtcgg

SEQ ID NO: 3033 - DNA, 23 bp, Homo sapiens
tccagggctataactcagactgg

SEQ ID NO: 3034 - DNA, 23 bp, Homo sapiens
ggctttgctctggtgctggtggg

SEQ ID NO: 3035 - DNA, 23 bp, Homo sapiens
agccagagccgcagctgtgatgg

SEQ ID NO: 3036 - DNA, 23 bp, Homo sapiens
aagagttgctacaggcttccagg

SEQ ID NO: 3037 - DNA, 23 bp, Homo sapiens
acttagatggtgagagaaagagg

SEQ ID NO: 3038 - DNA, 23 bp, Homo sapiens
tagtttgctccagatgacggtgg

SEQ ID NO: 3039 - DNA, 23 bp, Homo sapiens
tccagtgcaagcccttagactgg

SEQ ID NO: 3040 - DNA, 23 bp, Homo sapiens
gtctttaaggactggtcttctgg

SEQ ID NO: 3041 - DNA, 23 bp, Homo sapiens
caaaattggggaagaggcggagg

SEQ ID NO: 3042 - DNA, 23 bp, Homo sapiens
aacaccacagttattgtgtgagg

SEQ ID NO: 3043 - DNA, 23 bp, Homo sapiens
aatggatcacaccttctgcaggg

SEQ ID NO: 3044 - DNA, 23 bp, Homo sapiens
ggaaccagtcctgaatcctaagg

SEQ ID NO: 3045 - DNA, 23 bp, Homo sapiens
tcctagaggagaagctatatagg

SEQ ID NO: 3046 - DNA, 23 bp, Homo sapiens
ttgcaagaggaaaaagaaagggg

SEQ ID NO: 3047 - DNA, 23 bp, Homo sapiens
gagccaatatgaggcacataagg

SEQ ID NO: 3048 - DNA, 23 bp, Homo sapiens
aaaacctccaagaaaggacatgg

SEQ ID NO: 3049 - DNA, 23 bp, Homo sapiens
tgcagttggaagacatatacagg

SEQ ID NO: 3050 - DNA, 23 bp, Homo sapiens
agcaccgtgaaaacctgaagggg

SEQ ID NO: 3051 - DNA, 23 bp, Homo sapiens
attttgcttctgcacacaggcgg

SEQ ID NO: 3052 - DNA, 23 bp, Homo sapiens
agtatcattctgaggtacagagg

SEQ ID NO: 3053 - DNA, 23 bp, Homo sapiens
agaagcaccgtcgctctcggagg

SEQ ID NO: 3054 - DNA, 23 bp, Homo sapiens
attctcaccttaagcgtagacgg

SEQ ID NO: 3055 - DNA, 23 bp, Homo sapiens
ctcagagaacactagagactagg

SEQ ID NO: 3056 - DNA, 23 bp, Homo sapiens
aaagccagcacgtttatttctgg

SEQ ID NO: 3057 - DNA, 23 bp, Homo sapiens
ccagccccctccagtgtgagagg

SEQ ID NO: 3058 - DNA, 23 bp, Homo sapiens
agctggtcatcgacaggtgaggg

SEQ ID NO: 3059 - DNA, 23 bp, Homo sapiens
gccctgggccacaggctacatgg

SEQ ID NO: 3060 - DNA, 23 bp, Homo sapiens
actagaaagcttgcaaactctgg

SEQ ID NO: 3061 - DNA, 23 bp, Homo sapiens
cagccacctttcagcaagagcgg

SEQ ID NO: 3062 - DNA, 23 bp, Homo sapiens
tatccttgaccactttactgggg

SEQ ID NO: 3063 - DNA, 23 bp, Homo sapiens
gctgcggcagaagcctccccggg

SEQ ID NO: 3064 - DNA, 23 bp, Homo sapiens
ggggaagtgccaggctcacatgg

SEQ ID NO: 3065 - DNA, 23 bp, Homo sapiens
agctatgaaaaacggtagtaagg

SEQ ID NO: 3066 - DNA, 23 bp, Homo sapiens
gtgagtctgacacacagccaagg

SEQ ID NO: 3067 - DNA, 23 bp, Homo sapiens
tccagttctggaatcatggatgg

SEQ ID NO: 3068 - DNA, 23 bp, Homo sapiens
acttgggttcagaaactcactgg

SEQ ID NO: 3069 - DNA, 23 bp, Homo sapiens
agaagctgtaaatggccttgtgg

SEQ ID NO: 3070 - DNA, 23 bp, Homo sapiens
gccaacagaccaactcagattgg

SEQ ID NO: 3071 - DNA, 23 bp, Homo sapiens
attggcacagaaagatcttcagg

SEQ ID NO: 3072 - DNA, 23 bp, Homo sapiens
agagaaggctaggttttacatgg

SEQ ID NO: 3073 - DNA, 23 bp, Homo sapiens
agttttgaaagtaactgtggggg

SEQ ID NO: 3074 - DNA, 23 bp, Homo sapiens
ttctcagtacatttaaccactgg

SEQ ID NO: 3075 - DNA, 23 bp, Homo sapiens
caaagagccgcagttatttgcgg

SEQ ID NO: 3076 - DNA, 23 bp, Homo sapiens
gatggcacatgcgaaaacgatgg

SEQ ID NO: 3077 - DNA, 23 bp, Homo sapiens
ccttctcctattccagaaccagg

SEQ ID NO: 3078 - DNA, 23 bp, Homo sapiens
atgactttaacacgcttagtggg

SEQ ID NO: 3079 - DNA, 23 bp, Homo sapiens
tgcatcaacaagtccaagatagg

SEQ ID NO: 3080 - DNA, 23 bp, Homo sapiens
gggcggagggtcacacatacagg

SEQ ID NO: 3081 - DNA, 23 bp, Homo sapiens
tgtcacttgttctatgaacttgg

SEQ ID NO: 3082 - DNA, 23 bp, Homo sapiens
tggcttctgacatatataggtgg

SEQ ID NO: 3083 - DNA, 23 bp, Homo sapiens
cccacgaggttcagtcagcctgg

SEQ ID NO: 3084 - DNA, 23 bp, Homo sapiens
gggctacttcttctttttcttgg

SEQ ID NO: 3085 - DNA, 23 bp, Homo sapiens
gccccacggagtcccctcacagg

SEQ ID NO: 3086 - DNA, 23 bp, Homo sapiens
cgtgcctgtcagcagaacagggg

SEQ ID NO: 3087 - DNA, 23 bp, Homo sapiens
accagcatgaactagaacagagg

SEQ ID NO: 3088 - DNA, 23 bp, Homo sapiens
tctcccttattcattccatttgg

SEQ ID NO: 3089 - DNA, 23 bp, Homo sapiens
catccacgcctcgttattaaagg

SEQ ID NO: 3090 - DNA, 23 bp, Homo sapiens
cgctgggcctctggcctagaagg

SEQ ID NO: 3091 - DNA, 23 bp, Homo sapiens
ggaaaatgttgggggtcacttgg

SEQ ID NO: 3092 - DNA, 23 bp, Homo sapiens
ttcccatggtcacttgtgccagg

SEQ ID NO: 3093 - DNA, 23 bp, Homo sapiens
gctatgttaaacggttagagagg

SEQ ID NO: 3094 - DNA, 23 bp, Homo sapiens
gtccttgagtaagacaagtctgg

SEQ ID NO: 3095 - DNA, 23 bp, Homo sapiens
aaattctcatcagagaccacagg

SEQ ID NO: 3096 - DNA, 23 bp, Homo sapiens
tgaagcactgaagaattagcagg

SEQ ID NO: 3097 - DNA, 23 bp, Homo sapiens
aggcgcaggctggtcagtacagg

SEQ ID NO: 3098 - DNA, 23 bp, Homo sapiens
aagtgggattctctctgtcctgg

SEQ ID NO: 3099 - DNA, 23 bp, Homo sapiens
tttcaactgtgggtttgcccggg

SEQ ID NO: 3100 - DNA, 23 bp, Homo sapiens
ggccgggtccgggaggcctgagg

SEQ ID NO: 3101 - DNA, 23 bp, Homo sapiens
accccaagccccagcctgaaggg

SEQ ID NO: 3102 - DNA, 23 bp, Homo sapiens
ggcagaagccagagcctactcgg

SEQ ID NO: 3103 - DNA, 23 bp, Homo sapiens
agagggaaatggatgaacttagg

SEQ ID NO: 3104 - DNA, 23 bp, Homo sapiens
gtgaaggccaatagcattcaagg

SEQ ID NO: 3105 - DNA, 23 bp, Homo sapiens
ggggcctggctgggcctacttgg

SEQ ID NO: 3106 - DNA, 23 bp, Homo sapiens
catcttgtgcatctgccaaatgg

SEQ ID NO: 3107 - DNA, 23 bp, Homo sapiens
tgaggagcagtccgctgcgtagg

SEQ ID NO: 3108 - DNA, 23 bp, Homo sapiens
gactgcccaaacccaggtacagg

SEQ ID NO: 3109 - DNA, 23 bp, Homo sapiens
cccctacctgcgggggtaacggg

SEQ ID NO: 3110 - DNA, 23 bp, Homo sapiens
gcttctctgaaggagacacatgg

SEQ ID NO: 3111 - DNA, 23 bp, Homo sapiens
atggacttgattctgatgagagg

SEQ ID NO: 3112 - DNA, 23 bp, Homo sapiens
atttactgttctgctgctgctgg

SEQ ID NO: 3113 - DNA, 23 bp, Homo sapiens
accgcacccccaaagtcactggg

SEQ ID NO: 3114 - DNA, 23 bp, Homo sapiens
tcaggtctgctgagagttagcgg

SEQ ID NO: 3115 - DNA, 23 bp, Homo sapiens
agcaagtaaggaggggaaaatgg

SEQ ID NO: 3116 - DNA, 23 bp, Homo sapiens
gtattctgcacagagttccaagg

SEQ ID NO: 3117 - DNA, 23 bp, Homo sapiens
tttgatagcagtgatgatgatgg

SEQ ID NO: 3118 - DNA, 23 bp, Homo sapiens
agctgctgtttgttaccagatgg

SEQ ID NO: 3119 - DNA, 23 bp, Homo sapiens
gagctactactagcactagatgg

SEQ ID NO: 3120 - DNA, 23 bp, Homo sapiens
agtccaggctgctccctaggagg

SEQ ID NO: 3121 - DNA, 23 bp, Homo sapiens
ctggtgagcgttagcattcgcgg

SEQ ID NO: 3122 - DNA, 23 bp, Homo sapiens
gcaggcacgtgcacgaacacagg

SEQ ID NO: 3123 - DNA, 23 bp, Homo sapiens
cagcgagtccggatttaaggagg

SEQ ID NO: 3124 - DNA, 23 bp, Homo sapiens
aaaaaaaaggacacagagagggg

SEQ ID NO: 3125 - DNA, 23 bp, Homo sapiens
attaaggacatcttccacattgg

SEQ ID NO: 3126 - DNA, 23 bp, Homo sapiens
atctctgggatggctttacatgg

SEQ ID NO: 3127 - DNA, 23 bp, Homo sapiens
aaatcagagtcctctcataaagg

SEQ ID NO: 3128 - DNA, 23 bp, Homo sapiens
aggaggggccaggggttagctgg

SEQ ID NO: 3129 - DNA, 23 bp, Homo sapiens
gaagatggagagacagattgtgg

SEQ ID NO: 3130 - DNA, 23 bp, Homo sapiens
aatgttgtagttacggatcttgg

SEQ ID NO: 3131 - DNA, 23 bp, Homo sapiens
cgggtggcaggaggagctagcgg

SEQ ID NO: 3132 - DNA, 23 bp, Homo sapiens
ttggaggcttgaagtgaattcgg

SEQ ID NO: 3133 - DNA, 23 bp, Homo sapiens
tcttctttttgtactgcctttgg

SEQ ID NO: 3134 - DNA, 23 bp, Homo sapiens
ctaagctcatgcattaaggctgg

SEQ ID NO: 3135 - DNA, 23 bp, Homo sapiens
tacagcgccctgaggtaggctgg

SEQ ID NO: 3136 - DNA, 23 bp, Homo sapiens
ctggacatgcggtcataacgtgg

SEQ ID NO: 3137 - DNA, 23 bp, Homo sapiens
tttttttgagctgactcttctgg

SEQ ID NO: 3138 - DNA, 23 bp, Homo sapiens
ccccatgcatgcacctcacatgg

SEQ ID NO: 3139 - DNA, 23 bp, Homo sapiens
gttggatgttgtttatcacctgg

SEQ ID NO: 3140 - DNA, 23 bp, Homo sapiens
cttgattttcagctaaaggcagg

SEQ ID NO: 3141 - DNA, 23 bp, Homo sapiens
attaggttacggaaatgaactgg

SEQ ID NO: 3142 - DNA, 23 bp, Homo sapiens
cccaggccctgcaccctatgtgg

SEQ ID NO: 3143 - DNA, 23 bp, Homo sapiens
cattctcaaaagtatgggtgtgg

SEQ ID NO: 3144 - DNA, 23 bp, Homo sapiens
tttcaatcagtcttccgctttgg

SEQ ID NO: 3145 - DNA, 23 bp, Homo sapiens
atgctggctacgccctgcctcgg

SEQ ID NO: 3146 - DNA, 23 bp, Homo sapiens
aggaatcagactgctgaatatgg

SEQ ID NO: 3147 - DNA, 23 bp, Homo sapiens
ttcccggtgccccgggcatgagg

SEQ ID NO: 3148 - DNA, 23 bp, Homo sapiens
aagaaaagcagaagagacgttgg

SEQ ID NO: 3149 - DNA, 23 bp, Homo sapiens
ctcaaagcactgagcgatgcagg

SEQ ID NO: 3150 - DNA, 23 bp, Homo sapiens
tttcttggagaggctcttggtgg

SEQ ID NO: 3151 - DNA, 23 bp, Homo sapiens
gaaacggcgcctgcatcgctcgg

SEQ ID NO: 3152 - DNA, 23 bp, Homo sapiens
taagtcgaaagtgtttggtctgg

SEQ ID NO: 3153 - DNA, 23 bp, Homo sapiens
ggtacaagcacgaaatcctgagg

SEQ ID NO: 3154 - DNA, 23 bp, Homo sapiens
gagcaagaagaccagctgtgagg

SEQ ID NO: 3155 - DNA, 23 bp, Homo sapiens
ctgctcagtaagggtatccatgg

SEQ ID NO: 3156 - DNA, 23 bp, Homo sapiens
ttgagttttacacaagcaaccgg

SEQ ID NO: 3157 - DNA, 23 bp, Homo sapiens
ggcggtcaaaagaaaatggctgg

SEQ ID NO: 3158 - DNA, 23 bp, Homo sapiens
tttgtagtgcaagatgaggaggg

SEQ ID NO: 3159 - DNA, 23 bp, Homo sapiens
ttatatgtgatgtggctttctgg

SEQ ID NO: 3160 - DNA, 23 bp, Homo sapiens
tctggaataatggacgccgctgg

SEQ ID NO: 3161 - DNA, 23 bp, Homo sapiens
caggttcgtgtcctggaattagg

SEQ ID NO: 3162 - DNA, 23 bp, Homo sapiens
aaaaagagtgcatctcacattgg

SEQ ID NO: 3163 - DNA, 23 bp, Homo sapiens
cctgttcccccgatgattgaagg

SEQ ID NO: 3164 - DNA, 23 bp, Homo sapiens
acagaagagtggccctacaaagg

SEQ ID NO: 3165 - DNA, 23 bp, Homo sapiens
gccgtcctgagctcagatcttgg

SEQ ID NO: 3166 - DNA, 23 bp, Homo sapiens
gtattcccaggagctactaaagg

SEQ ID NO: 3167 - DNA, 23 bp, Homo sapiens
gtgttgctgtcagcagcagctgg

SEQ ID NO: 3168 - DNA, 23 bp, Homo sapiens
tgctgttcccacggtgtcactgg

SEQ ID NO: 3169 - DNA, 23 bp, Homo sapiens
cagaccgtgtggtatgagtacgg

SEQ ID NO: 3170 - DNA, 23 bp, Homo sapiens
ctccgccatctctctccataggg

SEQ ID NO: 3171 - DNA, 23 bp, Homo sapiens
cagcttcatacactctcaaaagg

SEQ ID NO: 3172 - DNA, 23 bp, Homo sapiens
acttgcctggcaatagcattggg

SEQ ID NO: 3173 - DNA, 23 bp, Homo sapiens
acttaactgtttctgtgcacagg

SEQ ID NO: 3174 - DNA, 23 bp, Homo sapiens
ggtgaggaagcactcagggacgg

SEQ ID NO: 3175 - DNA, 23 bp, Homo sapiens
cacggctggggatgttcaggagg

SEQ ID NO: 3176 - DNA, 23 bp, Homo sapiens
ctggacagtgacgacagcaacgg

SEQ ID NO: 3177 - DNA, 23 bp, Homo sapiens
tctcatcgatctggtcaagaagg

SEQ ID NO: 3178 - DNA, 23 bp, Homo sapiens
cagagctggatggggactgatgg

SEQ ID NO: 3179 - DNA, 23 bp, Homo sapiens
ggaatccctgttcatggcacagg

SEQ ID NO: 3180 - DNA, 23 bp, Homo sapiens
ggggagcagctcaggagggaggg

SEQ ID NO: 3181 - DNA, 23 bp, Homo sapiens
cagctgcttagctgctcatctgg

SEQ ID NO: 3182 - DNA, 23 bp, Homo sapiens
taccttgcaagattcttcaaagg

SEQ ID NO: 3183 - DNA, 23 bp, Homo sapiens
tggcggctgggtcctctaggagg

SEQ ID NO: 3184 - DNA, 23 bp, Homo sapiens
agggtcaggggacatctcactgg

SEQ ID NO: 3185 - DNA, 23 bp, Homo sapiens
ggcccctctactcctcagccagg

SEQ ID NO: 3186 - DNA, 23 bp, Homo sapiens
agaggcacagaaaaatgctgagg

SEQ ID NO: 3187 - DNA, 23 bp, Homo sapiens
gctttggagttggagatttttgg

SEQ ID NO: 3188 - DNA, 23 bp, Homo sapiens
gtagcagagttcaagtcttcagg

SEQ ID NO: 3189 - DNA, 23 bp, Homo sapiens
ggactatatcaaggacatgaagg

SEQ ID NO: 3190 - DNA, 23 bp, Homo sapiens
acccagtggtccgggagttcagg

SEQ ID NO: 3191 - DNA, 23 bp, Homo sapiens
cactaaagcctggtcatcactgg

SEQ ID NO: 3192 - DNA, 23 bp, Homo sapiens
ggaggcttcaagacctctcaagg

SEQ ID NO: 3193 - DNA, 23 bp, Homo sapiens
cctgaagctgaatgcctgagggg

SEQ ID NO: 3194 - DNA, 23 bp, Homo sapiens
cggtcataggttaactgctgcgg

SEQ ID NO: 3195 - DNA, 23 bp, Homo sapiens
ggagtgagtgttcaagtcttcgg

SEQ ID NO: 3196 - DNA, 23 bp, Homo sapiens
cgcaaatccaaaacagacttggg

SEQ ID NO: 3197 - DNA, 23 bp, Homo sapiens
tcactgggctatggccctttagg

SEQ ID NO: 3198 - DNA, 23 bp, Homo sapiens
tgtcagctatttaaggaaggagg

SEQ ID NO: 3199 - DNA, 23 bp, Homo sapiens
ttgacaagttcaattcttcctgg

SEQ ID NO: 3200 - DNA, 23 bp, Homo sapiens
tagcaggtggtttggttgccagg

SEQ ID NO: 3201 - DNA, 23 bp, Homo sapiens
ctcctgatatcagctaattcagg

SEQ ID NO: 3202 - DNA, 23 bp, Homo sapiens
cagctgagtcacaattgtttcgg

SEQ ID NO: 3203 - DNA, 23 bp, Homo sapiens
tttgggatgctaaggaaaatggg

SEQ ID NO: 3204 - DNA, 23 bp, Homo sapiens
caggggaaacacgaaacatacgg

SEQ ID NO: 3205 - DNA, 23 bp, Homo sapiens
cctggagctgagtgcctgagggg

SEQ ID NO: 3206 - DNA, 23 bp, Homo sapiens
gagcagctcagttcagttccagg

SEQ ID NO: 3207 - DNA, 23 bp, Homo sapiens
aagatgcctaccacaggcaaggg

SEQ ID NO: 3208 - DNA, 23 bp, Homo sapiens
atgggacctttgaggtcatctgg

SEQ ID NO: 3209 - DNA, 23 bp, Homo sapiens
cctctgctcccagccagctgtgg

SEQ ID NO: 3210 - DNA, 23 bp, Homo sapiens
taccaggctggcagggaatgggg

SEQ ID NO: 3211 - DNA, 23 bp, Homo sapiens
taccccacccgctccttgaaggg

SEQ ID NO: 3212 - DNA, 23 bp, Homo sapiens
tctttggagatgagctaggatgg

SEQ ID NO: 3213 - DNA, 23 bp, Homo sapiens
atgttcaaagctttggagtttgg

SEQ ID NO: 3214 - DNA, 23 bp, Homo sapiens
cagggattccatgaagcatctgg

SEQ ID NO: 3215 - DNA, 23 bp, Homo sapiens
tggaccaggactcagcatgatgg

SEQ ID NO: 3216 - DNA, 23 bp, Homo sapiens
ggtctccgtagagcttcagcagg

SEQ ID NO: 3217 - DNA, 23 bp, Homo sapiens
tattgtagaagaagaactgcagg

SEQ ID NO: 3218 - DNA, 23 bp, Homo sapiens
tgttacagatttagtgtctctgg

SEQ ID NO: 3219 - DNA, 23 bp, Homo sapiens
tttagccaaggctgtggcaaagg

SEQ ID NO: 3220 - DNA, 23 bp, Homo sapiens
gcagcagcaagtttctagcaggg

SEQ ID NO: 3221 - DNA, 23 bp, Homo sapiens
cccactgataggaaggtcctagg

SEQ ID NO: 3222 - DNA, 23 bp, Homo sapiens
gtggctgctgctagagtaccagg

SEQ ID NO: 3223 - DNA, 23 bp, Homo sapiens
ctagagttctgacttccatttgg

SEQ ID NO: 3224 - DNA, 23 bp, Homo sapiens
tgcgggacgtggacatctgaggg

SEQ ID NO: 3225 - DNA, 23 bp, Homo sapiens
ggcccaactggcatcctcacagg

SEQ ID NO: 3226 - DNA, 23 bp, Homo sapiens
gagggcctctccagggctacagg

SEQ ID NO: 3227 - DNA, 23 bp, Homo sapiens
cccctcagccagaagatagttgg

SEQ ID NO: 3228 - DNA, 23 bp, Homo sapiens
tggggtggtcacgccatttccgg

SEQ ID NO: 3229 - DNA, 23 bp, Homo sapiens
cttctttagtgttttcctggtgg

SEQ ID NO: 3230 - DNA, 23 bp, Homo sapiens
gacacacttacagcctcacaagg

SEQ ID NO: 3231 - DNA, 23 bp, Homo sapiens
tcctgaaatggtcccttaactgg

SEQ ID NO: 3232 - DNA, 23 bp, Homo sapiens
gaaggtgcactcttgatcactgg

SEQ ID NO: 3233 - DNA, 23 bp, Homo sapiens
atggttagagagattctaccagg

SEQ ID NO: 3234 - DNA, 23 bp, Homo sapiens
gctcccgacaatggatcaactgg

SEQ ID NO: 3235 - DNA, 23 bp, Homo sapiens
tgaaactacatgacagaaacagg

SEQ ID NO: 3236 - DNA, 23 bp, Homo sapiens
gtggaggcagaggggctagttgg

SEQ ID NO: 3237 - DNA, 23 bp, Homo sapiens
gtctgagtgtttcttacaaccgg

SEQ ID NO: 3238 - DNA, 23 bp, Homo sapiens
caccggctgctttgacagatagg

SEQ ID NO: 3239 - DNA, 23 bp, Homo sapiens
aggctcacgttatctcatccagg

SEQ ID NO: 3240 - DNA, 23 bp, Homo sapiens
gctcaggacatggcaggcacagg

SEQ ID NO: 3241 - DNA, 23 bp, Homo sapiens
tgaggtgggaggatcacttgagg

SEQ ID NO: 3242 - DNA, 23 bp, Homo sapiens
agcaggcatcggaggtgaggcgg

SEQ ID NO: 3243 - DNA, 23 bp, Homo sapiens
tcttagtcacttaccctcagagg

SEQ ID NO: 3244 - DNA, 23 bp, Homo sapiens
atctgttttatttcgagctcggg

SEQ ID NO: 3245 - DNA, 23 bp, Homo sapiens
ggcctgggccaggaccttagggg

SEQ ID NO: 3246 - DNA, 23 bp, Homo sapiens
tttttttacttaggaaggggtgg

SEQ ID NO: 3247 - DNA, 23 bp, Homo sapiens
gactcactgttaagtgcccaagg

SEQ ID NO: 3248 - DNA, 23 bp, Homo sapiens
gtgattggcatcaggaccgttgg

SEQ ID NO: 3249 - DNA, 23 bp, Homo sapiens
cctccgtagttaagagatgatgg

SEQ ID NO: 3250 - DNA, 23 bp, Homo sapiens
taaagccatcctctcttaaaagg

SEQ ID NO: 3251 - DNA, 23 bp, Homo sapiens
caacatttggccgctttctttgg

SEQ ID NO: 3252 - DNA, 23 bp, Homo sapiens
cggttttatgtaaaccgacctgg

SEQ ID NO: 3253 - DNA, 23 bp, Homo sapiens
tcgcactaatggaagacaaatgg

SEQ ID NO: 3254 - DNA, 23 bp, Homo sapiens
gggagcatgaactctctgctggg

SEQ ID NO: 3255 - DNA, 23 bp, Homo sapiens
agtctctcctgggacaactaggg

SEQ ID NO: 3256 - DNA, 23 bp, Homo sapiens
gccagtcttcaggacaaagaagg

SEQ ID NO: 3257 - DNA, 23 bp, Homo sapiens
ggggagcaggaagtctcggctgg

SEQ ID NO: 3258 - DNA, 23 bp, Homo sapiens
ctctccatccacagcagagccgg

SEQ ID NO: 3259 - DNA, 23 bp, Homo sapiens
atcatggagatcatgatccatgg

SEQ ID NO: 3260 - DNA, 23 bp, Homo sapiens
atatctgtgggcttgtgacacgg

SEQ ID NO: 3261 - DNA, 23 bp, Homo sapiens
agctttctatcacatagtgaagg

SEQ ID NO: 3262 - DNA, 23 bp, Homo sapiens
caggcagaagagtcgcctatggg

SEQ ID NO: 3263 - DNA, 23 bp, Homo sapiens
agcgtagactacattttgtgagg

SEQ ID NO: 3264 - DNA, 23 bp, Homo sapiens
cctcagagaagacccctcagagg

SEQ ID NO: 3265 - DNA, 23 bp, Homo sapiens
gtggatgctagtttacacttcgg

SEQ ID NO: 3266 - DNA, 23 bp, Homo sapiens
ccccctgcccacctttgagcagg

SEQ ID NO: 3267 - DNA, 23 bp, Homo sapiens
agaatacatgaggtgctattcgg

SEQ ID NO: 3268 - DNA, 23 bp, Homo sapiens
aaactctaggccagcaggatggg

SEQ ID NO: 3269 - DNA, 23 bp, Homo sapiens
tcaggttttcagaattccctagg

SEQ ID NO: 3270 - DNA, 23 bp, Homo sapiens
aagacgagaatatcgattagagg

SEQ ID NO: 3271 - DNA, 23 bp, Homo sapiens
atcacaagtctctctatagtagg

SEQ ID NO: 3272 - DNA, 23 bp, Homo sapiens
cttggattgagcattcactgcgg

SEQ ID NO: 3273 - DNA, 23 bp, Homo sapiens
gtggctttattagttttccctgg

SEQ ID NO: 3274 - DNA, 23 bp, Homo sapiens
agcacgtgggaatgcttaacagg

SEQ ID NO: 3275 - DNA, 23 bp, Homo sapiens
ccttgcctagcactcactcctgg

SEQ ID NO: 3276 - DNA, 23 bp, Homo sapiens
gtggtaaacactcgataatctgg

SEQ ID NO: 3277 - DNA, 23 bp, Homo sapiens
cttcattcttcagattctccagg

SEQ ID NO: 3278 - DNA, 23 bp, Homo sapiens
gctggaatgtcttctctgaaagg

SEQ ID NO: 3279 - DNA, 23 bp, Homo sapiens
ttgatgaaattatgcgagctggg

SEQ ID NO: 3280 - DNA, 23 bp, Homo sapiens
atgggtggggtgcctctcagtgg

SEQ ID NO: 3281 - DNA, 23 bp, Homo sapiens
tccaagtgggaagaaagactggg

SEQ ID NO: 3282 - DNA, 23 bp, Homo sapiens
aaagaaacacccacctcctgtgg

SEQ ID NO: 3283 - DNA, 23 bp, Homo sapiens
acatcttcttcttggattgacgg

SEQ ID NO: 3284 - DNA, 23 bp, Homo sapiens
gaagacgaggaggaagatgaagg

SEQ ID NO: 3285 - DNA, 23 bp, Homo sapiens
aaatgactgaagagtgatgatgg

SEQ ID NO: 3286 - DNA, 23 bp, Homo sapiens
ttggatcttaggcaaagccccgg

SEQ ID NO: 3287 - DNA, 23 bp, Homo sapiens
cctgtacaggagtctcaagctgg

SEQ ID NO: 3288 - DNA, 23 bp, Homo sapiens
aatgctggtcaccagccttgtgg

SEQ ID NO: 3289 - DNA, 23 bp, Homo sapiens
cattctgagccacactgaaaagg

SEQ ID NO: 3290 - DNA, 23 bp, Homo sapiens
gccacactgaaaaggaaaatggg

SEQ ID NO: 3291 - DNA, 23 bp, Homo sapiens
aagtcattttgtggcttcagagg

SEQ ID NO: 3292 - DNA, 23 bp, Homo sapiens
atgggtctgtttacagagtgtgg

SEQ ID NO: 3293 - DNA, 23 bp, Homo sapiens
ctggaatgtagttccttgtgtgg

SEQ ID NO: 3294 - DNA, 23 bp, Homo sapiens
ggccaggtactcacagcgtctgg

SEQ ID NO: 3295 - DNA, 23 bp, Homo sapiens
cgtctggtaggtgctgtccttgg

SEQ ID NO: 3296 - DNA, 23 bp, Homo sapiens
gtgggggtaatagagttagcagg

SEQ ID NO: 3297 - DNA, 23 bp, Homo sapiens
accttcagcactaaatgtgttgg

SEQ ID NO: 3298 - DNA, 23 bp, Homo sapiens
ctggccacctgaggatcacctgg

SEQ ID NO: 3299 - DNA, 23 bp, Homo sapiens
taggtcttgcgctttggttcagg

SEQ ID NO: 3300 - DNA, 23 bp, Homo sapiens
gagacatgatgatggctcatggg

SEQ ID NO: 3301 - DNA, 23 bp, Homo sapiens
gtcagggggaagagtctcacagg

SEQ ID NO: 3302 - DNA, 23 bp, Homo sapiens
gatgtggcaaggcgagtcacagg

SEQ ID NO: 3303 - DNA, 23 bp, Homo sapiens
aaagcaaatgtcaccagagttgg

SEQ ID NO: 3304 - DNA, 23 bp, Homo sapiens
gatagttaccctggtcatattgg

SEQ ID NO: 3305 - DNA, 23 bp, Homo sapiens
atgagttttctgctgccccatgg

SEQ ID NO: 3306 - DNA, 23 bp, Homo sapiens
ctggaaacgtcaccggaatcagg

SEQ ID NO: 3307 - DNA, 23 bp, Homo sapiens
aaacaaggtgaaggcatctgagg

SEQ ID NO: 3308 - DNA, 23 bp, Homo sapiens
tcacatcaccagatttgtgacgg

SEQ ID NO: 3309 - DNA, 23 bp, Homo sapiens
caggatttgttttcttccagagg

SEQ ID NO: 3310 - DNA, 23 bp, Homo sapiens
tgtcccatcagaaccgtgacagg

SEQ ID NO: 3311 - DNA, 23 bp, Homo sapiens
ggggtgaagttctgctacgcagg

SEQ ID NO: 3312 - DNA, 23 bp, Homo sapiens
ccatccagtgtcaatgtttgagg

SEQ ID NO: 3313 - DNA, 23 bp, Homo sapiens
tcccccggactgcgatgacacgg

SEQ ID NO: 3314 - DNA, 23 bp, Homo sapiens
agtctttggtctgcgagagaagg

SEQ ID NO: 3315 - DNA, 23 bp, Homo sapiens
agttccagttgttgtttcactgg

SEQ ID NO: 3316 - DNA, 23 bp, Homo sapiens
gtcaacagccagtctcttcgtgg

SEQ ID NO: 3317 - DNA, 23 bp, Homo sapiens
tcgattgagccgcaaagagctgg

SEQ ID NO: 3318 - DNA, 23 bp, Homo sapiens
tacagggcacaggccatggatgg

SEQ ID NO: 3319 - DNA, 23 bp, Homo sapiens
tgcagaaccagcgtgtgatgggg

SEQ ID NO: 3320 - DNA, 23 bp, Homo sapiens
tcccgcaggtgctggctcagggg

SEQ ID NO: 3321 - DNA, 23 bp, Homo sapiens
cagacatcatgctaggtgctagg

SEQ ID NO: 3322 - DNA, 23 bp, Homo sapiens
tgaatgtcagtgctacaccaagg

SEQ ID NO: 3323 - DNA, 23 bp, Homo sapiens
ttgctgtcagagtgtttcagagg

SEQ ID NO: 3324 - DNA, 23 bp, Homo sapiens
gcagcctatcgctcctgacacgg

SEQ ID NO: 3325 - DNA, 23 bp, Homo sapiens
agctgtcctgtcttcttgagtgg

SEQ ID NO: 3326 - DNA, 23 bp, Homo sapiens
cccagcaggctcaggtgtagagg

SEQ ID NO: 3327 - DNA, 23 bp, Homo sapiens
cagtgtgataaggaagacatagg

SEQ ID NO: 3328 - DNA, 23 bp, Homo sapiens
tgatggacagcagatgctactgg

SEQ ID NO: 3329 - DNA, 23 bp, Homo sapiens
tcagcctggctctatcttccagg

SEQ ID NO: 3330 - DNA, 23 bp, Homo sapiens
acaggccttggaggactccttgg

SEQ ID NO: 3331 - DNA, 23 bp, Homo sapiens
tgcagatccatctctctaagtgg

SEQ ID NO: 3332 - DNA, 23 bp, Homo sapiens
gaccacaaagaaggtcttgaagg

SEQ ID NO: 3333 - DNA, 23 bp, Homo sapiens
tgcaggctaaggcctgctgatgg

SEQ ID NO: 3334 - DNA, 23 bp, Homo sapiens
ttcctctgcccaggttgaccagg

SEQ ID NO: 3335 - DNA, 23 bp, Homo sapiens
ccaccttggtctcagagccaagg

SEQ ID NO: 3336 - DNA, 23 bp, Homo sapiens
tcgaagtttgtctcagcgtaggg

SEQ ID NO: 3337 - DNA, 23 bp, Homo sapiens
ttcaaactgagagaaaagtcagg

SEQ ID NO: 3338 - DNA, 23 bp, Homo sapiens
gaagactgtgttttggtagttgg

SEQ ID NO: 3339 - DNA, 23 bp, Homo sapiens
cagaagacctcgctgccctgagg

SEQ ID NO: 3340 - DNA, 23 bp, Homo sapiens
taccacagggtcagcctccccgg

SEQ ID NO: 3341 - DNA, 23 bp, Homo sapiens
tgctcttgtgggttcctcactgg

SEQ ID NO: 3342 - DNA, 23 bp, Homo sapiens
gagccccacaggagaaaggctgg

SEQ ID NO: 3343 - DNA, 23 bp, Homo sapiens
gctgataccgaattgtgactcgg

SEQ ID NO: 3344 - DNA, 23 bp, Homo sapiens
gatcttactcagtgttggtgtgg

SEQ ID NO: 3345 - DNA, 23 bp, Homo sapiens
ttggggagggcggggcctaacgg

SEQ ID NO: 3346 - DNA, 23 bp, Homo sapiens
gatgtgcaagatgaatcctcagg

SEQ ID NO: 3347 - DNA, 23 bp, Homo sapiens
accttggaggaaactgggctcgg

SEQ ID NO: 3348 - DNA, 23 bp, Homo sapiens
gtcagatgcgtctctgattcagg

SEQ ID NO: 3349 - DNA, 23 bp, Homo sapiens
ttcccgggggcagactacacagg

SEQ ID NO: 3350 - DNA, 23 bp, Homo sapiens
ttcaaggaaaccagttgaggagg

SEQ ID NO: 3351 - DNA, 23 bp, Homo sapiens
gcctggcctcgtgcctcaaatgg

SEQ ID NO: 3352 - DNA, 23 bp, Homo sapiens
ggccaagaagccaaccaataagg

SEQ ID NO: 3353 - DNA, 23 bp, Homo sapiens
tcagtgcaggagagacagtgagg

SEQ ID NO: 3354 - DNA, 23 bp, Homo sapiens
tcagagtttgagtaagccaaagg

SEQ ID NO: 3355 - DNA, 23 bp, Homo sapiens
aactgcaagaatcaaagccaagg

SEQ ID NO: 3356 - DNA, 23 bp, Homo sapiens
gaatgtggacatgaagattgggg

SEQ ID NO: 3357 - DNA, 23 bp, Homo sapiens
tctcatcagctgtcataaactgg

SEQ ID NO: 3358 - DNA, 23 bp, Homo sapiens
accactccagcagagcagagagg

SEQ ID NO: 3359 - DNA, 23 bp, Homo sapiens
ctctgtgggtctcatcagttagg

SEQ ID NO: 3360 - DNA, 23 bp, Homo sapiens
agaagactatacaacctcctagg

SEQ ID NO: 3361 - DNA, 23 bp, Homo sapiens
agcctccttgcacagtgtggtgg

SEQ ID NO: 3362 - DNA, 23 bp, Homo sapiens
gctcatctcaggtaagtaacagg

SEQ ID NO: 3363 - DNA, 23 bp, Homo sapiens
atgatctgcatggggctcagagg

SEQ ID NO: 3364 - DNA, 23 bp, Homo sapiens
cacctcttctgcttcagttgagg

SEQ ID NO: 3365 - DNA, 23 bp, Homo sapiens
tactgcagatcatagccctatgg

SEQ ID NO: 3366 - DNA, 23 bp, Homo sapiens
tggctaagtcagcaagcccatgg

SEQ ID NO: 3367 - DNA, 23 bp, Homo sapiens
caagaactggagtgacctagagg

SEQ ID NO: 3368 - DNA, 23 bp, Homo sapiens
tataatcgcaacgttttgggagg

SEQ ID NO: 3369 - DNA, 23 bp, Homo sapiens
acaacctgtatcccaagcagcgg

SEQ ID NO: 3370 - DNA, 23 bp, Homo sapiens
cagcctgcagtgtacttacttgg

SEQ ID NO: 3371 - DNA, 23 bp, Homo sapiens
tggtgttgacttagggatgaagg

SEQ ID NO: 3372 - DNA, 23 bp, Homo sapiens
ctgcacccaccaggaagatgtgg

SEQ ID NO: 3373 - DNA, 23 bp, Homo sapiens
gatgtggctgtcatctgctcagg

SEQ ID NO: 3374 - DNA, 23 bp, Homo sapiens
gacatcagcgcagcctaggccgg

SEQ ID NO: 3375 - DNA, 23 bp, Homo sapiens
gtggctacgaggtgatgtagggg

SEQ ID NO: 3376 - DNA, 23 bp, Homo sapiens
ggtttgaagcaaatgctcagagg

SEQ ID NO: 3377 - DNA, 23 bp, Homo sapiens
aaacacagaggtcagcagcatgg

SEQ ID NO: 3378 - DNA, 23 bp, Homo sapiens
gcaggggcccactgggtcactgg

SEQ ID NO: 3379 - DNA, 23 bp, Homo sapiens
actttggacagatgactcaacgg

SEQ ID NO: 3380 - DNA, 23 bp, Homo sapiens
taatcagcagcagtggtcagggg

SEQ ID NO: 3381 - DNA, 23 bp, Homo sapiens
tgcaaaggactgtcctaatctgg

SEQ ID NO: 3382 - DNA, 23 bp, Homo sapiens
ccgcctctgctgctctcacatgg

SEQ ID NO: 3383 - DNA, 23 bp, Homo sapiens
gaggacccgtcttctgggctggg

SEQ ID NO: 3384 - DNA, 23 bp, Homo sapiens
ggtgtcacggcttctccagctgg

SEQ ID NO: 3385 - DNA, 23 bp, Homo sapiens
ggcgacctggctctcactcctgg

SEQ ID NO: 3386 - DNA, 23 bp, Homo sapiens
ttctgcggacactgttatacagg

SEQ ID NO: 3387 - DNA, 23 bp, Homo sapiens
cggaacagctccgtgtactgagg

SEQ ID NO: 3388 - DNA, 23 bp, Homo sapiens
agcaaggtccccaagtactgagg

SEQ ID NO: 3389 - DNA, 23 bp, Homo sapiens
aagacagaactggtatgagcagg

SEQ ID NO: 3390 - DNA, 23 bp, Homo sapiens
cttatcagcaaactgcacttcgg

SEQ ID NO: 3391 - DNA, 23 bp, Homo sapiens
atttcatagcttgaagtcccagg

SEQ ID NO: 3392 - DNA, 23 bp, Homo sapiens
tcgaacttttaaaaacacgctgg

SEQ ID NO: 3393 - DNA, 23 bp, Homo sapiens
cgcccagatgtagatatcacagg

SEQ ID NO: 3394 - DNA, 23 bp, Homo sapiens
gttagacgtatctcgccgaaagg

SEQ ID NO: 3395 - DNA, 23 bp, Homo sapiens
taatgtagtggctgttgcacagg

SEQ ID NO: 3396 - DNA, 23 bp, Homo sapiens
gcctatgttttcaggatccatgg

SEQ ID NO: 3397 - DNA, 23 bp, Homo sapiens
actggagaaatgttccagaatgg

SEQ ID NO: 3398 - DNA, 23 bp, Homo sapiens
cccatggatcctgaaaacatagg

SEQ ID NO: 3399 - DNA, 23 bp, Homo sapiens
gaagccgggctctcctccgccgg

SEQ ID NO: 3400 - DNA, 23 bp, Homo sapiens
gctgactctagaccatctcgcgg

SEQ ID NO: 3401 - DNA, 23 bp, Homo sapiens
cactttcagcagtctgtcccagg

SEQ ID NO: 3402 - DNA, 23 bp, Homo sapiens
acttgcaggagatacactgctgg

SEQ ID NO: 3403 - DNA, 23 bp, Homo sapiens
gcaaagtctcacgagactagagg

SEQ ID NO: 3404 - DNA, 23 bp, Homo sapiens
aagaaaaaagaaaaagggccagg

SEQ ID NO: 3405 - DNA, 23 bp, Homo sapiens
ctggctctgcgttggcattccgg

SEQ ID NO: 3406 - DNA, 23 bp, Homo sapiens
ccgaaccagcccggatctgaggg

SEQ ID NO: 3407 - DNA, 23 bp, Homo sapiens
gggcattctctggctgtcactgg

SEQ ID NO: 3408 - DNA, 23 bp, Homo sapiens
cgcctcggaatccactaagaagg

SEQ ID NO: 3409 - DNA, 23 bp, Homo sapiens
ttgaacaaaatgagcctgaaagg

SEQ ID NO: 3410 - DNA, 23 bp, Homo sapiens
actgtgctggcccagagctaggg

SEQ ID NO: 3411 - DNA, 23 bp, Homo sapiens
tgtagacctctctactggggagg

SEQ ID NO: 3412 - DNA, 23 bp, Homo sapiens
cgctgaagaagaagaaagcccgg

SEQ ID NO: 3413 - DNA, 23 bp, Homo sapiens
gagaaattggtaaggagagcagg

SEQ ID NO: 3414 - DNA, 23 bp, Homo sapiens
gagggaaggcatcgctcagaagg

SEQ ID NO: 3415 - DNA, 23 bp, Homo sapiens
tggagaggtaagttttccctagg

SEQ ID NO: 3416 - DNA, 23 bp, Homo sapiens
atcctgctattctgtctcgatgg

SEQ ID NO: 3417 - DNA, 23 bp, Homo sapiens
gaaccaccagatctgcttcaagg

SEQ ID NO: 3418 - DNA, 23 bp, Homo sapiens
gagaggaatagcgtttgttttgg

SEQ ID NO: 3419 - DNA, 23 bp, Homo sapiens
ctgactggagtcacgtgctgtgg

SEQ ID NO: 3420 - DNA, 23 bp, Homo sapiens
ggtgatgggttggtcttcagcgg

SEQ ID NO: 3421 - DNA, 23 bp, Homo sapiens
ctagtagcaattccatacagagg

SEQ ID NO: 3422 - DNA, 23 bp, Homo sapiens
gtcttctgtcacgccatagttgg

SEQ ID NO: 3423 - DNA, 23 bp, Homo sapiens
gtcgtctgaagaagctctgaggg

SEQ ID NO: 3424 - DNA, 23 bp, Homo sapiens
gactggcgcaggcccctcactgg

SEQ ID NO: 3425 - DNA, 23 bp, Homo sapiens
agtggctggaatgttatcatggg

SEQ ID NO: 3426 - DNA, 23 bp, Homo sapiens
agatgaacgattattgggcttgg

SEQ ID NO: 3427 - DNA, 23 bp, Homo sapiens
ggagagcagcatgacagatgcgg

SEQ ID NO: 3428 - DNA, 23 bp, Homo sapiens
atctgttcttcttgggttattgg

SEQ ID NO: 3429 - DNA, 23 bp, Homo sapiens
tgaggatgactctggcacggagg

SEQ ID NO: 3430 - DNA, 23 bp, Homo sapiens
tcccaagacgggcgatgagaagg

SEQ ID NO: 3431 - DNA, 23 bp, Homo sapiens
agatgatgaacccaaaatgatgg

SEQ ID NO: 3432 - DNA, 23 bp, Homo sapiens
gggatggtctcattaaattgtgg

SEQ ID NO: 3433 - DNA, 23 bp, Homo sapiens
ctccggaaactcaacccaaaagg

SEQ ID NO: 3434 - DNA, 23 bp, Homo sapiens
ttcatagcagcacacacctgcgg

SEQ ID NO: 3435 - DNA, 23 bp, Homo sapiens
ccagtgctgaggcagctcacggg

SEQ ID NO: 3436 - DNA, 23 bp, Homo sapiens
ctggcggcttcaggtgtcacagg

SEQ ID NO: 3437 - DNA, 23 bp, Homo sapiens
caaggagagctctccaattcagg

SEQ ID NO: 3438 - DNA, 23 bp, Homo sapiens
tgatgaggtcaaggtgtgagggg

SEQ ID NO: 3439 - DNA, 23 bp, Homo sapiens
aggcagcctcgtgtcctatgtgg

SEQ ID NO: 3440 - DNA, 23 bp, Homo sapiens
ggatgaggtgctgaatgtaatgg

SEQ ID NO: 3441 - DNA, 23 bp, Homo sapiens
gatgaaatccgtgtgtgaggcgg

SEQ ID NO: 3442 - DNA, 23 bp, Homo sapiens
cggggaatgagggaacctagagg

SEQ ID NO: 3443 - DNA, 23 bp, Homo sapiens
aggccatggagcaattctagggg

SEQ ID NO: 3444 - DNA, 23 bp, Homo sapiens
cagctcgtggatacgaaggcggg

SEQ ID NO: 3445 - DNA, 23 bp, Homo sapiens
acttatttccctcctgtcctagg

SEQ ID NO: 3446 - DNA, 23 bp, Homo sapiens
tagatatgctgatttgctgctgg

SEQ ID NO: 3447 - DNA, 23 bp, Homo sapiens
caaggaaacccgtttgacaaagg

SEQ ID NO: 3448 - DNA, 23 bp, Homo sapiens
tctgctgttattcttgaagctgg

SEQ ID NO: 3449 - DNA, 23 bp, Homo sapiens
ggttttgggaaacattggacagg

SEQ ID NO: 3450 - DNA, 23 bp, Homo sapiens
gctctctgactgccttggaaagg

SEQ ID NO: 3451 - DNA, 23 bp, Homo sapiens
tttcagttcaaatggcaaactgg

SEQ ID NO: 3452 - DNA, 23 bp, Homo sapiens
cctgagactcccagatcttcagg

SEQ ID NO: 3453 - DNA, 23 bp, Homo sapiens
gtggccagagaggatgcctgagg

SEQ ID NO: 3454 - DNA, 23 bp, Homo sapiens
ctttcccttggtggagagctagg

SEQ ID NO: 3455 - DNA, 23 bp, Homo sapiens
atcctggtggagacctgagcagg

SEQ ID NO: 3456 - DNA, 23 bp, Homo sapiens
ccactgcatctcattcaaccagg

SEQ ID NO: 3457 - DNA, 23 bp, Homo sapiens
tagccaaatatcatggctttggg

SEQ ID NO: 3458 - DNA, 23 bp, Homo sapiens
gctggtagaagacaattaagagg

SEQ ID NO: 3459 - DNA, 23 bp, Homo sapiens
caactttggtgtctcatttgtgg

SEQ ID NO: 3460 - DNA, 23 bp, Homo sapiens
aatggatcaagttattctgctgg

SEQ ID NO: 3461 - DNA, 23 bp, Homo sapiens
cactcactgctttcattttgtgg

SEQ ID NO: 3462 - DNA, 23 bp, Homo sapiens
ggactcacgaagttagaagctgg

SEQ ID NO: 3463 - DNA, 23 bp, Homo sapiens
aagcagcatcaagaccacgatgg

SEQ ID NO: 3464 - DNA, 23 bp, Homo sapiens
cgttgtcattcacatcagacagg

SEQ ID NO: 3465 - DNA, 23 bp, Homo sapiens
ctgttcatacccttgtcccctgg

SEQ ID NO: 3466 - DNA, 23 bp, Homo sapiens
gaggcggcgaggacgactagggg

SEQ ID NO: 3467 - DNA, 23 bp, Homo sapiens
agcagaaatgtatggtggtgggg

SEQ ID NO: 3468 - DNA, 23 bp, Homo sapiens
tcccaaagagacaacacgcgtgg

SEQ ID NO: 3469 - DNA, 23 bp, Homo sapiens
acttcctttcctctatgtggtgg

SEQ ID NO: 3470 - DNA, 23 bp, Homo sapiens
atcgtcatcaaaagtgtctttgg

SEQ ID NO: 3471 - DNA, 23 bp, Homo sapiens
accctgataaagtcacttaaggg

SEQ ID NO: 3472 - DNA, 23 bp, Homo sapiens
aagctaagctgaagaggctgagg

SEQ ID NO: 3473 - DNA, 23 bp, Homo sapiens
aagttctgtgcctagcacgatgg

SEQ ID NO: 3474 - DNA, 23 bp, Homo sapiens
agcgaacttctcttgaatgaagg

SEQ ID NO: 3475 - DNA, 23 bp, Homo sapiens
cgccccagggtcaggctgtccgg

SEQ ID NO: 3476 - DNA, 23 bp, Homo sapiens
cctgaaggcgactgtctgaatgg

SEQ ID NO: 3477 - DNA, 23 bp, Homo sapiens
tttcaaattcagcttctcagagg

SEQ ID NO: 3478 - DNA, 23 bp, Homo sapiens
atctgaaagaacaacttaggggg

SEQ ID NO: 3479 - DNA, 23 bp, Homo sapiens
tcctgtactcaaaccagccgagg

SEQ ID NO: 3480 - DNA, 23 bp, Homo sapiens
tgaaaatgcaggctctggtcagg

SEQ ID NO: 3481 - DNA, 23 bp, Homo sapiens
tgcagtgcagtcaaataattagg

SEQ ID NO: 3482 - DNA, 23 bp, Homo sapiens
cttgctgacatgtatggtggagg

SEQ ID NO: 3483 - DNA, 23 bp, Homo sapiens
gacccgcgccgctgtggtgacgg

SEQ ID NO: 3484 - DNA, 23 bp, Homo sapiens
cggcagggcgaggggctaggagg

SEQ ID NO: 3485 - DNA, 23 bp, Homo sapiens
aatccctgagctgtgtttgttgg

SEQ ID NO: 3486 - DNA, 23 bp, Homo sapiens
ccaccctgcctgggctgttcagg

SEQ ID NO: 3487 - DNA, 23 bp, Homo sapiens
gatggacagccagactaggtggg

SEQ ID NO: 3488 - DNA, 23 bp, Homo sapiens
gtcacagctctgtgatctccagg

SEQ ID NO: 3489 - DNA, 23 bp, Homo sapiens
tcaaccaatgttggttagattgg

SEQ ID NO: 3490 - DNA, 23 bp, Homo sapiens
gggccagcccgggcgctcagggg

SEQ ID NO: 3491 - DNA, 23 bp, Homo sapiens
ttcaaaagcgactccgtttgagg

SEQ ID NO: 3492 - DNA, 23 bp, Homo sapiens
agagaacaggtagttaggagcgg

SEQ ID NO: 3493 - DNA, 23 bp, Homo sapiens
tggcggggaggacgactaggcgg

SEQ ID NO: 3494 - DNA, 23 bp, Homo sapiens
catgtatggaggtggtgaagagg

SEQ ID NO: 3495 - DNA, 23 bp, Homo sapiens
ggaggagctgctgtattaggcgg

SEQ ID NO: 3496 - DNA, 23 bp, Homo sapiens
tgcagatatgtatggaggagtgg

SEQ ID NO: 3497 - DNA, 23 bp, Homo sapiens
agctctttcagagcaagccctgg

SEQ ID NO: 3498 - DNA, 23 bp, Homo sapiens
gctatgagtacaaactctcttgg

SEQ ID NO: 3499 - DNA, 23 bp, Homo sapiens
ctgggcgaactctactctgttgg

SEQ ID NO: 3500 - DNA, 23 bp, Homo sapiens
tgatagtgaccgagactaagagg

SEQ ID NO: 3501 - DNA, 23 bp, Homo sapiens
gaagaagagtgtgcacaacaagg

SEQ ID NO: 3502 - DNA, 23 bp, Homo sapiens
tgaataaggcaatttcgcagtgg

SEQ ID NO: 3503 - DNA, 23 bp, Homo sapiens
gacaccacggacctgtgacaggg

SEQ ID NO: 3504 - DNA, 23 bp, Homo sapiens
ccacacccaggaaagtaaacggg

SEQ ID NO: 3505 - DNA, 23 bp, Homo sapiens
ggagcccggcgctggctctgagg

SEQ ID NO: 3506 - DNA, 23 bp, Homo sapiens
tgatgactcctacatctaagtgg

SEQ ID NO: 3507 - DNA, 23 bp, Homo sapiens
cgtacaagcgcctgtgctaacgg

SEQ ID NO: 3508 - DNA, 23 bp, Homo sapiens
gctccagcgtcacttcttcttgg

SEQ ID NO: 3509 - DNA, 23 bp, Homo sapiens
gatccagccaaacgaatttctgg

SEQ ID NO: 3510 - DNA, 23 bp, Homo sapiens
tatccctcctggtcagtacatgg

SEQ ID NO: 3511 - DNA, 23 bp, Homo sapiens
gcaagcgctgtaaaccctgacgg

SEQ ID NO: 3512 - DNA, 23 bp, Homo sapiens
tgccgcgagccaggctgaccagg

SEQ ID NO: 3513 - DNA, 23 bp, Homo sapiens
gcttcagcctcaagttctgaagg

SEQ ID NO: 3514 - DNA, 23 bp, Homo sapiens
ctgaagtctctgggttagtaagg

SEQ ID NO: 3515 - DNA, 23 bp, Homo sapiens
ctggcagaggcagaggcagaggg

SEQ ID NO: 3516 - DNA, 23 bp, Homo sapiens
gagaaagcatgcgggcctttggg

SEQ ID NO: 3517 - DNA, 23 bp, Homo sapiens
ggaagctggtacagctgagatgg

SEQ ID NO: 3518 - DNA, 23 bp, Homo sapiens
cagcccagtttagcaaatgctgg

SEQ ID NO: 3519 - DNA, 23 bp, Homo sapiens
tcggtctgtggcttagaactcgg

SEQ ID NO: 3520 - DNA, 23 bp, Homo sapiens
aattcttcttatccagagacagg

SEQ ID NO: 3521 - DNA, 23 bp, Homo sapiens
ttcatgatcgacacgtgaaatgg

SEQ ID NO: 3522 - DNA, 23 bp, Homo sapiens
caggacgagggaagaacaggcgg

SEQ ID NO: 3523 - DNA, 23 bp, Homo sapiens
caacgggagctggtcagtaccgg

SEQ ID NO: 3524 - DNA, 23 bp, Homo sapiens
aaggctatcagagtcgaagatgg

SEQ ID NO: 3525 - DNA, 23 bp, Homo sapiens
ccgattcctcagcgtctaggggg

SEQ ID NO: 3526 - DNA, 23 bp, Homo sapiens
ggccaacttctcacccctccagg

SEQ ID NO: 3527 - DNA, 23 bp, Homo sapiens
ccaacaaggcagctaggatctgg

SEQ ID NO: 3528 - DNA, 23 bp, Homo sapiens
gcggaacgcccgcacgtaacagg

SEQ ID NO: 3529 - DNA, 23 bp, Homo sapiens
taaaagagtcactatggctcagg

SEQ ID NO: 3530 - DNA, 23 bp, Homo sapiens
tgtggccttgacattctcaatgg

SEQ ID NO: 3531 - DNA, 23 bp, Homo sapiens
agccactccattgctcactccgg

SEQ ID NO: 3532 - DNA, 23 bp, Homo sapiens
gggggtcccggggcctagggcgg

SEQ ID NO: 3533 - DNA, 23 bp, Homo sapiens
gctacagtgctcaccgatccagg

SEQ ID NO: 3534 - DNA, 23 bp, Homo sapiens
cggcccctgggtatccctagcgg

SEQ ID NO: 3535 - DNA, 23 bp, Homo sapiens
tctctgcaggaccactctgaggg

SEQ ID NO: 3536 - DNA, 23 bp, Homo sapiens
gaaagttcttctcaggagcctgg

SEQ ID NO: 3537 - DNA, 23 bp, Homo sapiens
acacggagggtgtcacagagagg

SEQ ID NO: 3538 - DNA, 23 bp, Homo sapiens
agtccgctatactaactagaagg

SEQ ID NO: 3539 - DNA, 23 bp, Homo sapiens
tcggagctgaatacagcctgagg

SEQ ID NO: 3540 - DNA, 23 bp, Homo sapiens
agaacagaggccttagaacaagg

SEQ ID NO: 3541 - DNA, 23 bp, Homo sapiens
agtactcacatcagacacatcgg

SEQ ID NO: 3542 - DNA, 23 bp, Homo sapiens
agtttgagcgcgtcttctgaggg

SEQ ID NO: 3543 - DNA, 23 bp, Homo sapiens
tccgtgggcttggctctgctggg

SEQ ID NO: 3544 - DNA, 23 bp, Homo sapiens
gcttcaagaacagaataaggtgg

SEQ ID NO: 3545 - DNA, 23 bp, Homo sapiens
tcctagctcctttaaatgtttgg

SEQ ID NO: 3546 - DNA, 23 bp, Homo sapiens
accaaaatggttctcagtgctgg

SEQ ID NO: 3547 - DNA, 23 bp, Homo sapiens
gtggagatggccattgcgagggg

SEQ ID NO: 3548 - DNA, 23 bp, Homo sapiens
tgcattttctactctacatctgg

SEQ ID NO: 3549 - DNA, 23 bp, Homo sapiens
tgttacagctcacctcacactgg

SEQ ID NO: 3550 - DNA, 23 bp, Homo sapiens
agttttctgaaagcaagtgaagg

SEQ ID NO: 3551 - DNA, 23 bp, Homo sapiens
ttttgagcggaagtacctgttgg

SEQ ID NO: 3552 - DNA, 23 bp, Homo sapiens
catgagaatgcggcactgacggg

SEQ ID NO: 3553 - DNA, 23 bp, Homo sapiens
ccctaccagcacaaattacaagg

SEQ ID NO: 3554 - DNA, 23 bp, Homo sapiens
ggcggattagggcttcctcttgg

SEQ ID NO: 3555 - DNA, 23 bp, Homo sapiens
tttacgtttgacgtcttctgagg

SEQ ID NO: 3556 - DNA, 23 bp, Homo sapiens
agaccccgcgcaagaggctgcgg

SEQ ID NO: 3557 - DNA, 23 bp, Homo sapiens
gaagccaaggaagaggaatgagg

SEQ ID NO: 3558 - DNA, 23 bp, Homo sapiens
gatggcccagctcctcagccagg

SEQ ID NO: 3559 - DNA, 23 bp, Homo sapiens
gcctctctggttctttcaatcgg

SEQ ID NO: 3560 - DNA, 23 bp, Homo sapiens
tgtagaagcaggcatgcgtaggg

SEQ ID NO: 3561 - DNA, 23 bp, Homo sapiens
tcttgaggatgttttagtgctgg

SEQ ID NO: 3562 - DNA, 23 bp, Homo sapiens
tcacttctggtagtaaattgtgg

SEQ ID NO: 3563 - DNA, 23 bp, Homo sapiens
aacctggcgtcagtcccccgtgg

SEQ ID NO: 3564 - DNA, 23 bp, Homo sapiens
gaacgagctcggtcgtaggcggg

SEQ ID NO: 3565 - DNA, 23 bp, Homo sapiens
atgcaggcaaacggggctggggg

SEQ ID NO: 3566 - DNA, 23 bp, Homo sapiens
actcttaaatgctctgcccttgg

SEQ ID NO: 3567 - DNA, 23 bp, Homo sapiens
gggaatggatcctctcacctagg

SEQ ID NO: 3568 - DNA, 23 bp, Homo sapiens
cttgatggtctgtattgccccgg

SEQ ID NO: 3569 - DNA, 23 bp, Homo sapiens
tggagatcagagctctgttttgg

SEQ ID NO: 3570 - DNA, 23 bp, Homo sapiens
ctcgctggagaacaactaagggg

SEQ ID NO: 3571 - DNA, 23 bp, Homo sapiens
cagcagccccgggaaacctgagg

SEQ ID NO: 3572 - DNA, 23 bp, Homo sapiens
catctgagcagcactcactcagg

SEQ ID NO: 3573 - DNA, 23 bp, Homo sapiens
tctggaagacactgattgactgg

SEQ ID NO: 3574 - DNA, 23 bp, Homo sapiens
aagaatgagaggagagtgatcgg

SEQ ID NO: 3575 - DNA, 23 bp, Homo sapiens
gctgctgtgcgtcttgactttgg

SEQ ID NO: 3576 - DNA, 23 bp, Homo sapiens
ctttagcttcagcccatcatcgg

SEQ ID NO: 3577 - DNA, 23 bp, Homo sapiens
gcaatgctgatccttttcagtgg

SEQ ID NO: 3578 - DNA, 23 bp, Homo sapiens
acccactgcccgcctgttaaggg

SEQ ID NO: 3579 - DNA, 23 bp, Homo sapiens
gccccgaacgggctcttaacagg

SEQ ID NO: 3580 - DNA, 23 bp, Homo sapiens
gttggtcagtagcgaactgtagg

SEQ ID NO: 3581 - DNA, 23 bp, Homo sapiens
acccaccttgaaggtataactgg

SEQ ID NO: 3582 - DNA, 23 bp, Homo sapiens
ccaccacagaggacgagtagggg

SEQ ID NO: 3583 - DNA, 23 bp, Homo sapiens
gactgttgagtaactctccttgg

SEQ ID NO: 3584 - DNA, 23 bp, Homo sapiens
accagacacgtgctgaggagggg

SEQ ID NO: 3585 - DNA, 23 bp, Homo sapiens
agccactcacaatacaattaagg

SEQ ID NO: 3586 - DNA, 23 bp, Homo sapiens
ctgccaagcatgtagaaagccgg

SEQ ID NO: 3587 - DNA, 23 bp, Homo sapiens
ctctccaatgcctgtgaaagagg

SEQ ID NO: 3588 - DNA, 23 bp, Homo sapiens
tgcagaacccggtgggtcactgg

SEQ ID NO: 3589 - DNA, 23 bp, Homo sapiens
tcaacctattgagatacagcagg

SEQ ID NO: 3590 - DNA, 23 bp, Homo sapiens
ttgtgccactataaagtcaaggg

SEQ ID NO: 3591 - DNA, 23 bp, Homo sapiens
ttaacatggattctatcccttgg

SEQ ID NO: 3592 - DNA, 23 bp, Homo sapiens
ccatgttaaagtacttgcagagg

SEQ ID NO: 3593 - DNA, 23 bp, Homo sapiens
ctcccttttcagctacctgcagg

SEQ ID NO: 3594 - DNA, 23 bp, Homo sapiens
atttctgtggctgttagggatgg

SEQ ID NO: 3595 - DNA, 23 bp, Homo sapiens
tgttaggtgggtcattggagtgg

SEQ ID NO: 3596 - DNA, 23 bp, Homo sapiens
cagggtcacgctgttaccccagg

SEQ ID NO: 3597 - DNA, 23 bp, Homo sapiens
tgatcaaccactactcaatcagg

SEQ ID NO: 3598 - DNA, 23 bp, Homo sapiens
gctggtgccaacttcctgatggg

SEQ ID NO: 3599 - DNA, 23 bp, Homo sapiens
attagacggaggggttgatttgg

SEQ ID NO: 3600 - DNA, 23 bp, Homo sapiens
ctctgacagctccatctcctagg

SEQ ID NO: 3601 - DNA, 23 bp, Homo sapiens
tgtgtggcaggtcaggaccacgg

SEQ ID NO: 3602 - DNA, 23 bp, Homo sapiens
gatggaccacaaagcagaagtgg

SEQ ID NO: 3603 - DNA, 23 bp, Homo sapiens
atagatggaagctgctgtcctgg

SEQ ID NO: 3604 - DNA, 23 bp, Homo sapiens
caaagcagatgtggtctcttagg

SEQ ID NO: 3605 - DNA, 23 bp, Homo sapiens
catgattggagtgctggttgggg

SEQ ID NO: 3606 - DNA, 23 bp, Homo sapiens
ctgctatatcagagccaccctgg

SEQ ID NO: 3607 - DNA, 23 bp, Homo sapiens
gattggagtactggctgggatgg

SEQ ID NO: 3608 - DNA, 23 bp, Homo sapiens
ctactatatcagagccaccctgg

SEQ ID NO: 3609 - DNA, 23 bp, Homo sapiens
gccatgggcaactgcgcgtgagg

SEQ ID NO: 3610 - DNA, 23 bp, Homo sapiens
tcctccggccactgctagcgcgg

SEQ ID NO: 3611 - DNA, 23 bp, Homo sapiens
ccgccccggccgcgcgttaccgg

SEQ ID NO: 3612 - DNA, 23 bp, Homo sapiens
ggcgtggggggttgcagctgagg

SEQ ID NO: 3613 - DNA, 23 bp, Homo sapiens
acagcagatggcgacaatgcagg

SEQ ID NO: 3614 - DNA, 23 bp, Homo sapiens
gggaggctgaacgtgatgactgg

SEQ ID NO: 3615 - DNA, 23 bp, Homo sapiens
actgagaagtctggaatgtatgg

SEQ ID NO: 3616 - DNA, 23 bp, Homo sapiens
taacattggcatgaatgccatgg

SEQ ID NO: 3617 - DNA, 23 bp, Homo sapiens
taagcctccaacacttcccctgg

SEQ ID NO: 3618 - DNA, 23 bp, Homo sapiens
ctcagatgcctgcagtcattagg

SEQ ID NO: 3619 - DNA, 23 bp, Homo sapiens
gactcaggaaaatgttcagttgg

SEQ ID NO: 3620 - DNA, 23 bp, Homo sapiens
ttacatcgactggatcaattcgg

SEQ ID NO: 3621 - DNA, 23 bp, Homo sapiens
ctacaacgactggatcaattcgg

SEQ ID NO: 3622 - DNA, 23 bp, Homo sapiens
cagctgggccttggttctagtgg

SEQ ID NO: 3623 - DNA, 23 bp, Homo sapiens
cagaggggagcacgctcagtagg

SEQ ID NO: 3624 - DNA, 23 bp, Homo sapiens
ctctggggttaggatcagtaagg

SEQ ID NO: 3625 - DNA, 23 bp, Homo sapiens
atgccaaccggccctactgaggg

SEQ ID NO: 3626 - DNA, 23 bp, Homo sapiens
gaaagaagtgtgctcaaggatgg

SEQ ID NO: 3627 - DNA, 23 bp, Homo sapiens
gctcccgccggcgctcagtacgg

SEQ ID NO: 3628 - DNA, 23 bp, Homo sapiens
ccacagtctcgcgctgagctagg

SEQ ID NO: 3629 - DNA, 23 bp, Homo sapiens
ggggagaccaggactcgcacagg

SEQ ID NO: 3630 - DNA, 23 bp, Homo sapiens
accaaccagagcaagtgtttcgg

SEQ ID NO: 3631 - DNA, 23 bp, Homo sapiens
cggctgtgggcgcggtcagtagg

SEQ ID NO: 3632 - DNA, 23 bp, Homo sapiens
tcagtgaaagcaggtcagtaagg

SEQ ID NO: 3633 - DNA, 23 bp, Homo sapiens
actgggagcgcccaggccgatgg

SEQ ID NO: 3634 - DNA, 23 bp, Homo sapiens
ccacggcccagggttaatgcagg

SEQ ID NO: 3635 - DNA, 23 bp, Homo sapiens
aagtgagggtcactcctgagggg

SEQ ID NO: 3636 - DNA, 23 bp, Homo sapiens
gtgaagaagaagaagttgtgagg

SEQ ID NO: 3637 - DNA, 23 bp, Homo sapiens
atgacactaatggggtgagcagg

SEQ ID NO: 3638 - DNA, 23 bp, Homo sapiens
cccccaggtattattttttccgg

SEQ ID NO: 3639 - DNA, 23 bp, Homo sapiens
cggggccttgaggagggactcgg

SEQ ID NO: 3640 - DNA, 23 bp, Homo sapiens
caggcgggagttcgaggtcttgg

SEQ ID NO: 3641 - DNA, 23 bp, Homo sapiens
tcatctacgttaaagacacctgg

SEQ ID NO: 3642 - DNA, 23 bp, Homo sapiens
gaagaacactttcctcattccgg

SEQ ID NO: 3643 - DNA, 23 bp, Homo sapiens
gtctactgagttttgcactcagg

SEQ ID NO: 3644 - DNA, 23 bp, Homo sapiens
gacacacaaagtgccttcactgg

SEQ ID NO: 3645 - DNA, 23 bp, Homo sapiens
gctgcagaacaatttccttaagg

SEQ ID NO: 3646 - DNA, 23 bp, Homo sapiens
tcttccattcccagagcagaggg

SEQ ID NO: 3647 - DNA, 23 bp, Homo sapiens
gaccgttagataactcacagagg

SEQ ID NO: 3648 - DNA, 23 bp, Homo sapiens
gggtaatgtgctaatggacacgg

SEQ ID NO: 3649 - DNA, 23 bp, Homo sapiens
agaagctttccatcagtaaaagg

SEQ ID NO: 3650 - DNA, 23 bp, Homo sapiens
atcaaatagtggttaccccaagg

SEQ ID NO: 3651 - DNA, 23 bp, Homo sapiens
gtagcttcagcacatactgatgg

SEQ ID NO: 3652 - DNA, 23 bp, Homo sapiens
caaacacgatcaggtcaattcgg

SEQ ID NO: 3653 - DNA, 23 bp, Homo sapiens
caggggccagccaccctcacagg

SEQ ID NO: 3654 - DNA, 23 bp, Homo sapiens
ccccctgctctactgtgacctgg

SEQ ID NO: 3655 - DNA, 23 bp, Homo sapiens
gtgtgtttcctcgccacaggtgg

SEQ ID NO: 3656 - DNA, 23 bp, Homo sapiens
tgctgaggcaccctgggtgatgg

SEQ ID NO: 3657 - DNA, 23 bp, Homo sapiens
gaaaatctacctccgacaagagg

SEQ ID NO: 3658 - DNA, 23 bp, Homo sapiens
gatacaatgggacaaacagaagg

SEQ ID NO: 3659 - DNA, 23 bp, Homo sapiens
ttgggtatgcaagtgagcagtgg

SEQ ID NO: 3660 - DNA, 23 bp, Homo sapiens
agaaaagttggatatgagtctgg

SEQ ID NO: 3661 - DNA, 23 bp, Homo sapiens
gataaaatcgctttgtgcagagg

SEQ ID NO: 3662 - DNA, 23 bp, Homo sapiens
tgggttcaagtgcacatgtgagg

SEQ ID NO: 3663 - DNA, 23 bp, Homo sapiens
tgaagaagcctataagaaactgg

SEQ ID NO: 3664 - DNA, 23 bp, Homo sapiens
gccagcagaggctggagtggtgg

SEQ ID NO: 3665 - DNA, 23 bp, Homo sapiens
tcggaaagtcagctccgaaatgg

SEQ ID NO: 3666 - DNA, 23 bp, Homo sapiens
tgttgaagcctggccactactgg

SEQ ID NO: 3667 - DNA, 23 bp, Homo sapiens
tagactgctcttctcatccctgg

SEQ ID NO: 3668 - DNA, 23 bp, Homo sapiens
gatggtcttgtgctctttcatgg

SEQ ID NO: 3669 - DNA, 23 bp, Homo sapiens
gcatgtactggccgcagcaaagg

SEQ ID NO: 3670 - DNA, 23 bp, Homo sapiens
agggatctcagccgtggctgagg

SEQ ID NO: 3671 - DNA, 23 bp, Homo sapiens
gctgagatccctagaagtccagg

SEQ ID NO: 3672 - DNA, 23 bp, Homo sapiens
acgtacgccaagcgctgacgcgg

SEQ ID NO: 3673 - DNA, 23 bp, Homo sapiens
tgactacatatcaaggcagaagg

SEQ ID NO: 3674 - DNA, 23 bp, Homo sapiens
ccgacagatcagagagattttgg

SEQ ID NO: 3675 - DNA, 23 bp, Homo sapiens
tctcttgtctctgcagctgctgg

SEQ ID NO: 3676 - DNA, 23 bp, Homo sapiens
aagttcacaacccaaaaaagagg

SEQ ID NO: 3677 - DNA, 23 bp, Homo sapiens
acgccaagtaccaagtgaccagg

SEQ ID NO: 3678 - DNA, 23 bp, Homo sapiens
ctatgttcaggagaatgtgaagg

SEQ ID NO: 3679 - DNA, 23 bp, Homo sapiens
ctatctagccaacaagatagtgg

SEQ ID NO: 3680 - DNA, 23 bp, Homo sapiens
atttcatctgcaaaagcaactgg

SEQ ID NO: 3681 - DNA, 23 bp, Homo sapiens
gtgaaggtgtatcgcttctgagg

SEQ ID NO: 3682 - DNA, 23 bp, Homo sapiens
attcaaccccgatggggaagagg

SEQ ID NO: 3683 - DNA, 23 bp, Homo sapiens
ccaggtctggggcctagatcagg

SEQ ID NO: 3684 - DNA, 23 bp, Homo sapiens
tcaactgcagtcctgtggctggg

SEQ ID NO: 3685 - DNA, 23 bp, Homo sapiens
cgactaattggtgaagctcttgg

SEQ ID NO: 3686 - DNA, 23 bp, Homo sapiens
tcctggctgtggctgctacctgg

SEQ ID NO: 3687 - DNA, 23 bp, Homo sapiens
taggtgacctttagtaaatgggg

SEQ ID NO: 3688 - DNA, 23 bp, Homo sapiens
ttatgcccaaaacagagcaaggg

SEQ ID NO: 3689 - DNA, 23 bp, Homo sapiens
agaagcccggaaatgcttgcggg

SEQ ID NO: 3690 - DNA, 23 bp, Homo sapiens
atcagatcagtgaaaagcagggg

SEQ ID NO: 3691 - DNA, 23 bp, Homo sapiens
gagacaaagtctttacttccagg

SEQ ID NO: 3692 - DNA, 23 bp, Homo sapiens
aagaatcgcttgaacctgggagg

SEQ ID NO: 3693 - DNA, 23 bp, Homo sapiens
aagaaacagagattacacacagg

SEQ ID NO: 3694 - DNA, 23 bp, Homo sapiens
atgtccaaatcactacttgtagg

SEQ ID NO: 3695 - DNA, 23 bp, Homo sapiens
actttgaacagtattccacatgg

SEQ ID NO: 3696 - DNA, 23 bp, Homo sapiens
acaaagcagtagtttgtgttggg

SEQ ID NO: 3697 - DNA, 23 bp, Homo sapiens
agcatcaagacagtgtaagaagg

SEQ ID NO: 3698 - DNA, 23 bp, Homo sapiens
tgagaagagatgatatcatgtgg

SEQ ID NO: 3699 - DNA, 23 bp, Homo sapiens
ttcaaatctaaagcactccaagg

SEQ ID NO: 3700 - DNA, 23 bp, Homo sapiens
ctttgggacgctgaggctggcgg

SEQ ID NO: 3701 - DNA, 23 bp, Homo sapiens
tcatcacattctagagcgcttgg

SEQ ID NO: 3702 - DNA, 23 bp, Homo sapiens
ccatgtgaaggggtttaacctgg

SEQ ID NO: 3703 - DNA, 23 bp, Homo sapiens
aagagttcctcataccgtcttgg

SEQ ID NO: 3704 - DNA, 23 bp, Homo sapiens
taggacctgaagacctccagagg

SEQ ID NO: 3705 - DNA, 23 bp, Homo sapiens
ttagaagaggagatgaagcttgg

SEQ ID NO: 3706 - DNA, 23 bp, Homo sapiens
tttctttactgcaggtacaatgg

SEQ ID NO: 3707 - DNA, 23 bp, Homo sapiens
gcttctcggcaggagtcagcagg

SEQ ID NO: 3708 - DNA, 23 bp, Homo sapiens
ctgaatctgcatgtgctgtttgg

SEQ ID NO: 3709 - DNA, 23 bp, Homo sapiens
gacagtcagatcaggaatgcagg

SEQ ID NO: 3710 - DNA, 23 bp, Homo sapiens
tgaagaagatctgctatttctgg

SEQ ID NO: 3711 - DNA, 23 bp, Homo sapiens
aagattcaaagtgaactggatgg

SEQ ID NO: 3712 - DNA, 23 bp, Homo sapiens
tctccaagaacatcattctccgg

SEQ ID NO: 3713 - DNA, 23 bp, Homo sapiens
gaaaactgtgtcacacagtgagg

SEQ ID NO: 3714 - DNA, 23 bp, Homo sapiens
gaccgctatgctcaggacatggg

SEQ ID NO: 3715 - DNA, 23 bp, Homo sapiens
tgaagagaagaagaaactagagg

SEQ ID NO: 3716 - DNA, 23 bp, Homo sapiens
gggctcccgcagattctagcagg

SEQ ID NO: 3717 - DNA, 23 bp, Homo sapiens
attatcaagtctggcctcatagg

SEQ ID NO: 3718 - DNA, 23 bp, Homo sapiens
acatttcagctattgcatgttgg

SEQ ID NO: 3719 - DNA, 23 bp, Homo sapiens
ttctgaagacatgtatgtgcagg

SEQ ID NO: 3720 - DNA, 23 bp, Homo sapiens
gctcttcaagctgaaactcctgg

SEQ ID NO: 3721 - DNA, 23 bp, Homo sapiens
ccagccccgagatgagctctagg

SEQ ID NO: 3722 - DNA, 23 bp, Homo sapiens
gcttctcagctgtgtgagtctgg

SEQ ID NO: 3723 - DNA, 23 bp, Homo sapiens
cagtctttatggaggaagcatgg

SEQ ID NO: 3724 - DNA, 23 bp, Homo sapiens
cgggcccctccacactcactcgg

SEQ ID NO: 3725 - DNA, 23 bp, Homo sapiens
gagtgcggctgccgctaacccgg

SEQ ID NO: 3726 - DNA, 23 bp, Homo sapiens
tggttcagtcattcttacgatgg

SEQ ID NO: 3727 - DNA, 23 bp, Homo sapiens
tcctgtaggcttccagctaatgg

SEQ ID NO: 3728 - DNA, 23 bp, Homo sapiens
cacacaacagccacatagccggg

SEQ ID NO: 3729 - DNA, 23 bp, Homo sapiens
tactgggctgaagagtaaggtgg

SEQ ID NO: 3730 - DNA, 23 bp, Homo sapiens
tgcgatcatccttcgatacctgg

SEQ ID NO: 3731 - DNA, 23 bp, Homo sapiens
tttctatgcctggcgggagctgg

SEQ ID NO: 3732 - DNA, 23 bp, Homo sapiens
cctgactggctcctgctccatgg

SEQ ID NO: 3733 - DNA, 23 bp, Homo sapiens
acagctctatgtgttctgtctgg

SEQ ID NO: 3734 - DNA, 23 bp, Homo sapiens
agctctgtgtgtctctcttcagg

SEQ ID NO: 3735 - DNA, 23 bp, Homo sapiens
aggttcaggcctggcctcagagg

SEQ ID NO: 3736 - DNA, 23 bp, Homo sapiens
agaagcagaggcaattctaaggg

SEQ ID NO: 3737 - DNA, 23 bp, Homo sapiens
ctggattttaccacaagagtggg

SEQ ID NO: 3738 - DNA, 23 bp, Homo sapiens
aaaagaaaaagaaaggctggagg

SEQ ID NO: 3739 - DNA, 23 bp, Homo sapiens
ttctgaaccgacttcagtaaagg

SEQ ID NO: 3740 - DNA, 23 bp, Homo sapiens
acactgatcttaatagaggctgg

SEQ ID NO: 3741 - DNA, 23 bp, Homo sapiens
taatagcaatgaactcctcttgg

SEQ ID NO: 3742 - DNA, 23 bp, Homo sapiens
gagacttctagctcaagctctgg

SEQ ID NO: 3743 - DNA, 23 bp, Homo sapiens
actgatggacaaggaggaggagg

SEQ ID NO: 3744 - DNA, 23 bp, Homo sapiens
ccaggtgggctcttaggatttgg

SEQ ID NO: 3745 - DNA, 23 bp, Homo sapiens
tcttctctctgtgtcctacttgg

SEQ ID NO: 3746 - DNA, 23 bp, Homo sapiens
aaagtgaaaagagcgggtacggg

SEQ ID NO: 3747 - DNA, 23 bp, Homo sapiens
tggcgtgttactgcgtgtcaagg

SEQ ID NO: 3748 - DNA, 23 bp, Homo sapiens
gtatctcccagttcagaacaagg

SEQ ID NO: 3749 - DNA, 23 bp, Homo sapiens
ggtgaacttaactagagatgtgg

SEQ ID NO: 3750 - DNA, 23 bp, Homo sapiens
tgttgagtgctttgccccgcagg

SEQ ID NO: 3751 - DNA, 23 bp, Homo sapiens
gaaaccagaaatgacagcagagg

SEQ ID NO: 3752 - DNA, 23 bp, Homo sapiens
ctgcaatctacgagaagagttgg

SEQ ID NO: 3753 - DNA, 23 bp, Homo sapiens
atagcaaactcaaaggtctgcgg

SEQ ID NO: 3754 - DNA, 23 bp, Homo sapiens
gagagcaaatcaaagctttgagg

SEQ ID NO: 3755 - DNA, 23 bp, Homo sapiens
agctacctctgtgaactgagggg

SEQ ID NO: 3756 - DNA, 23 bp, Homo sapiens
tcaaatcaaaaacaggctcacgg

SEQ ID NO: 3757 - DNA, 23 bp, Homo sapiens
caccatcaagggtgctcctttgg

SEQ ID NO: 3758 - DNA, 23 bp, Homo sapiens
tgaatttgttgggtatacactgg

SEQ ID NO: 3759 - DNA, 23 bp, Homo sapiens
gacatctcatcagcttcaggagg

SEQ ID NO: 3760 - DNA, 23 bp, Homo sapiens
tgatgctcacggaactacggtgg

SEQ ID NO: 3761 - DNA, 23 bp, Homo sapiens
caggaggaagccttttcaactgg

SEQ ID NO: 3762 - DNA, 23 bp, Homo sapiens
gaaggagagagaaaagacattgg

SEQ ID NO: 3763 - DNA, 23 bp, Homo sapiens
gctcaccagagggggtcagttgg

SEQ ID NO: 3764 - DNA, 23 bp, Homo sapiens
ttcaggttagaacgtcattttgg

SEQ ID NO: 3765 - DNA, 23 bp, Homo sapiens
ctctacgtcttccaccgggctgg

SEQ ID NO: 3766 - DNA, 23 bp, Homo sapiens
gcctacaactaaacgatgcctgg

SEQ ID NO: 3767 - DNA, 23 bp, Homo sapiens
aacactcactggcttttatatgg

SEQ ID NO: 3768 - DNA, 23 bp, Homo sapiens
ccaaagctcctggcctagctcgg

SEQ ID NO: 3769 - DNA, 23 bp, Homo sapiens
tgggcgcgggcatttacggaagg

SEQ ID NO: 3770 - DNA, 23 bp, Homo sapiens
tcgaggaggagccttgcagaggg

SEQ ID NO: 3771 - DNA, 23 bp, Homo sapiens
ctggaggggtatcagaaagatgg

SEQ ID NO: 3772 - DNA, 23 bp, Homo sapiens
ctgtgtcagggctaggaggcagg

SEQ ID NO: 3773 - DNA, 23 bp, Homo sapiens
tgctctgtgcagaggcttagggg

SEQ ID NO: 3774 - DNA, 23 bp, Homo sapiens
gcaggggagggaggggctagggg

SEQ ID NO: 3775 - DNA, 23 bp, Homo sapiens
acagacagaaggaacaacaaagg

SEQ ID NO: 3776 - DNA, 23 bp, Homo sapiens
cccctaatgtccgtacagcttgg

SEQ ID NO: 3777 - DNA, 23 bp, Homo sapiens
cgcctggaggccgcctgagccgg

SEQ ID NO: 3778 - DNA, 23 bp, Homo sapiens
aaactccaagatgaggatttggg

SEQ ID NO: 3779 - DNA, 23 bp, Homo sapiens
cctgcggaaggccgggacttggg

SEQ ID NO: 3780 - DNA, 23 bp, Homo sapiens
atcgacagcgtcctggcctaggg

SEQ ID NO: 3781 - DNA, 23 bp, Homo sapiens
ttgaaattgagcgagatctcagg

SEQ ID NO: 3782 - DNA, 23 bp, Homo sapiens
aacatgttgggatgggaaactgg

SEQ ID NO: 3783 - DNA, 23 bp, Homo sapiens
accttcgatcagaagttcagagg

SEQ ID NO: 3784 - DNA, 23 bp, Homo sapiens
aatgtgtcagaatgggaaactgg

SEQ ID NO: 3785 - DNA, 23 bp, Homo sapiens
gaataccccagatgcgaataagg

SEQ ID NO: 3786 - DNA, 23 bp, Homo sapiens
tgcttgcttcattcacatatagg

SEQ ID NO: 3787 - DNA, 23 bp, Homo sapiens
ggattagctaccatgtaggaagg

SEQ ID NO: 3788 - DNA, 23 bp, Homo sapiens
gggccagaaggggctcacaaagg

SEQ ID NO: 3789 - DNA, 23 bp, Homo sapiens
acacttggagagaaattgggagg

SEQ ID NO: 3790 - DNA, 23 bp, Homo sapiens
gcagagctatggacattcagggg

SEQ ID NO: 3791 - DNA, 23 bp, Homo sapiens
gcagttccatgttaatcacatgg

SEQ ID NO: 3792 - DNA, 23 bp, Homo sapiens
tggtttcttatgtgtaggagagg

SEQ ID NO: 3793 - DNA, 23 bp, Homo sapiens
ttactagatgtcctataggatgg

SEQ ID NO: 3794 - DNA, 23 bp, Homo sapiens
ttgcaaagaccctgaggaagagg

SEQ ID NO: 3795 - DNA, 23 bp, Homo sapiens
aagaagaggtgcaagatacaagg

SEQ ID NO: 3796 - DNA, 23 bp, Homo sapiens
tactgcagtggcacgccgtgtgg

SEQ ID NO: 3797 - DNA, 23 bp, Homo sapiens
atcccgtctcccggggccctagg

SEQ ID NO: 3798 - DNA, 23 bp, Homo sapiens
ccccgatcctcccacaataaagg

SEQ ID NO: 3799 - DNA, 23 bp, Homo sapiens
aactcacaagattgttgactagg

SEQ ID NO: 3800 - DNA, 23 bp, Homo sapiens
cttgaggaccacgagctaacagg

SEQ ID NO: 3801 - DNA, 23 bp, Homo sapiens
cccgggagagcactcagatctgg

SEQ ID NO: 3802 - DNA, 23 bp, Homo sapiens
caccatggagactaccattgcgg

SEQ ID NO: 3803 - DNA, 23 bp, Homo sapiens
ctgggtcacatttgtggctgagg

SEQ ID NO: 3804 - DNA, 23 bp, Homo sapiens
tgaggtgcacattgttcaagtgg

SEQ ID NO: 3805 - DNA, 23 bp, Homo sapiens
cgatgtcttcaaagagtcttcgg

SEQ ID NO: 3806 - DNA, 23 bp, Homo sapiens
tctgtcccagcgcggtgatgtgg

SEQ ID NO: 3807 - DNA, 23 bp, Homo sapiens
ggctctggcgctggtgtgagggg

SEQ ID NO: 3808 - DNA, 23 bp, Homo sapiens
agatgagcatcttttcgctttgg

SEQ ID NO: 3809 - DNA, 23 bp, Homo sapiens
aaagctggccgccattaaacagg

SEQ ID NO: 3810 - DNA, 23 bp, Homo sapiens
cagtgtggagcagataaggtggg

SEQ ID NO: 3811 - DNA, 23 bp, Homo sapiens
tgctctcaggatgcacccagtgg

SEQ ID NO: 3812 - DNA, 23 bp, Homo sapiens
agaagccgaggtcccatcaaggg

SEQ ID NO: 3813 - DNA, 23 bp, Homo sapiens
caaatttgctgctcctccagtgg

SEQ ID NO: 3814 - DNA, 23 bp, Homo sapiens
ctagtggcaggagtcaaggttgg

SEQ ID NO: 3815 - DNA, 23 bp, Homo sapiens
tacttgtccattttcagctgagg

SEQ ID NO: 3816 - DNA, 23 bp, Homo sapiens
ctgagctccctgccctgaagagg

SEQ ID NO: 3817 - DNA, 23 bp, Homo sapiens
gtgccgacttgcaaacggattgg

SEQ ID NO: 3818 - DNA, 23 bp, Homo sapiens
agaagttcaacctggagagatgg

SEQ ID NO: 3819 - DNA, 23 bp, Homo sapiens
cagagcatgcttgagaagggagg

SEQ ID NO: 3820 - DNA, 23 bp, Homo sapiens
ggctaagcagtcaacactccagg

SEQ ID NO: 3821 - DNA, 23 bp, Homo sapiens
actgcaaccaaagaagaggaggg

SEQ ID NO: 3822 - DNA, 23 bp, Homo sapiens
ccgtcagaggagtcctcaggagg

SEQ ID NO: 3823 - DNA, 23 bp, Homo sapiens
ctgcgtgagcgccgcccacaagg

SEQ ID NO: 3824 - DNA, 23 bp, Homo sapiens
gatgaaatcttgagagcagtggg

SEQ ID NO: 3825 - DNA, 23 bp, Homo sapiens
ggtgttccacttacttcttgagg

SEQ ID NO: 3826 - DNA, 23 bp, Homo sapiens
tgatgcttccaccagatgtctgg

SEQ ID NO: 3827 - DNA, 23 bp, Homo sapiens
tgttgctgttggctgtgttgtgg

SEQ ID NO: 3828 - DNA, 23 bp, Homo sapiens
cggagcatacctggagtagtcgg

SEQ ID NO: 3829 - DNA, 23 bp, Homo sapiens
atcttcctcctcaagacagctgg

SEQ ID NO: 3830 - DNA, 23 bp, Homo sapiens
agctcattcctggtgcaagtagg

SEQ ID NO: 3831 - DNA, 23 bp, Homo sapiens
tgttctagtgatctctccaaagg

SEQ ID NO: 3832 - DNA, 23 bp, Homo sapiens
gatctgtatagacgactgactgg

SEQ ID NO: 3833 - DNA, 23 bp, Homo sapiens
gtctgcatcttcactgctgctgg

SEQ ID NO: 3834 - DNA, 23 bp, Homo sapiens
actacaaccagatgcccctgggg

SEQ ID NO: 3835 - DNA, 23 bp, Homo sapiens
gttctaattggtgtcgttgttgg

SEQ ID NO: 3836 - DNA, 23 bp, Homo sapiens
gctagactcacttgatggggggg

SEQ ID NO: 3837 - DNA, 23 bp, Homo sapiens
tcagtcatcagcatcttcactgg

SEQ ID NO: 3838 - DNA, 23 bp, Homo sapiens
tagtacatcgtcgtcatctgagg

SEQ ID NO: 3839 - DNA, 23 bp, Homo sapiens
agcagcaactgtcttagcgctgg

SEQ ID NO: 3840 - DNA, 23 bp, Homo sapiens
ttggcttcctgccacatgatcgg

SEQ ID NO: 3841 - DNA, 23 bp, Homo sapiens
aacacagcagcacacacagctgg

SEQ ID NO: 3842 - DNA, 23 bp, Homo sapiens
ggccagggacgagtgtaagtagg

SEQ ID NO: 3843 - DNA, 23 bp, Homo sapiens
atcatatctgtgaacagacaagg

SEQ ID NO: 3844 - DNA, 23 bp, Homo sapiens
cagctgcaggcactacggcgggg

SEQ ID NO: 3845 - DNA, 23 bp, Homo sapiens
ccaatgacagtcagcccctttgg

SEQ ID NO: 3846 - DNA, 23 bp, Homo sapiens
tgcagcgagtgcatccttgatgg

SEQ ID NO: 3847 - DNA, 23 bp, Homo sapiens
gaagccttggctccctgtgaagg

SEQ ID NO: 3848 - DNA, 23 bp, Homo sapiens
cagctgtgattgctgcaactggg

SEQ ID NO: 3849 - DNA, 23 bp, Homo sapiens
ctggataaaactcctcagtcagg

SEQ ID NO: 3850 - DNA, 23 bp, Homo sapiens
tgctaatctggtcgaaaaatcgg

SEQ ID NO: 3851 - DNA, 23 bp, Homo sapiens
ttctacgacctgctctaggtggg

SEQ ID NO: 3852 - DNA, 23 bp, Homo sapiens
ggctttagcgactcaattccagg

SEQ ID NO: 3853 - DNA, 23 bp, Homo sapiens
ccaccagaagaggaagcttgggg

SEQ ID NO: 3854 - DNA, 23 bp, Homo sapiens
gggagggtggagtcaggatgagg

SEQ ID NO: 3855 - DNA, 23 bp, Homo sapiens
tatgttgtgtttatgcccgaagg

SEQ ID NO: 3856 - DNA, 23 bp, Homo sapiens
tagaggagtcctctgaataatgg

SEQ ID NO: 3857 - DNA, 23 bp, Homo sapiens
tggaagtattttgttatgccagg

SEQ ID NO: 3858 - DNA, 23 bp, Homo sapiens
taattttgaaggtgcttctctgg

SEQ ID NO: 3859 - DNA, 23 bp, Homo sapiens
gccaggcctgcgtggccttaggg

SEQ ID NO: 3860 - DNA, 23 bp, Homo sapiens
ggggcacggctagttcctcaagg

SEQ ID NO: 3861 - DNA, 23 bp, Homo sapiens
gccttcgggatcaagtgtgacgg

SEQ ID NO: 3862 - DNA, 23 bp, Homo sapiens
ggggcactcagtccctccgcagg

SEQ ID NO: 3863 - DNA, 23 bp, Homo sapiens
gaacggcaactcaaggctttagg

SEQ ID NO: 3864 - DNA, 23 bp, Homo sapiens
tggccacactccgcagctagggg

SEQ ID NO: 3865 - DNA, 23 bp, Homo sapiens
actaaagcagttggctgagtggg

SEQ ID NO: 3866 - DNA, 23 bp, Homo sapiens
tgggctggatccatgtaatgggg

SEQ ID NO: 3867 - DNA, 23 bp, Homo sapiens
tatcaaacaattggcagcttggg

SEQ ID NO: 3868 - DNA, 23 bp, Homo sapiens
aaatcatcttcatccagttctgg

SEQ ID NO: 3869 - DNA, 23 bp, Homo sapiens
atgatgcaaatctatgaagcagg

SEQ ID NO: 3870 - DNA, 23 bp, Homo sapiens
ctggtggcagcttcgtaacgtgg

SEQ ID NO: 3871 - DNA, 23 bp, Homo sapiens
ttcacttgagggtcctacaatgg

SEQ ID NO: 3872 - DNA, 23 bp, Homo sapiens
acggtatcagagactggtggtgg

SEQ ID NO: 3873 - DNA, 23 bp, Homo sapiens
aaatctgcacaatcagcttttgg

SEQ ID NO: 3874 - DNA, 23 bp, Homo sapiens
gtcaaaatggcatttgacagagg

SEQ ID NO: 3875 - DNA, 23 bp, Homo sapiens
ggaatggcttgaaatcacaaagg

SEQ ID NO: 3876 - DNA, 23 bp, Homo sapiens
taccagaaaagaaagtggcatgg

SEQ ID NO: 3877 - DNA, 23 bp, Homo sapiens
gatgccacaacagattgagtggg

SEQ ID NO: 3878 - DNA, 23 bp, Homo sapiens
gcatccgatttcttcactaaagg

SEQ ID NO: 3879 - DNA, 23 bp, Homo sapiens
ggcacaaacggagtcacttcagg

SEQ ID NO: 3880 - DNA, 23 bp, Homo sapiens
ctactctttgaacaggagcaggg

SEQ ID NO: 3881 - DNA, 23 bp, Homo sapiens
ccaggcgggctaagtgctattgg

SEQ ID NO: 3882 - DNA, 23 bp, Homo sapiens
atgtcatcaagcacctgaacagg

SEQ ID NO: 3883 - DNA, 23 bp, Homo sapiens
tttaggagtcagcttcatcatgg

SEQ ID NO: 3884 - DNA, 23 bp, Homo sapiens
aaagaagccgaaggctcttaggg

SEQ ID NO: 3885 - DNA, 23 bp, Homo sapiens
ctgtctgtcttgcctaacagtgg

SEQ ID NO: 3886 - DNA, 23 bp, Homo sapiens
tatgtcttggtcactttgtctgg

SEQ ID NO: 3887 - DNA, 23 bp, Homo sapiens
ggagaggggactatcagcattgg

SEQ ID NO: 3888 - DNA, 23 bp, Homo sapiens
ataagaacataggcgctacaagg

SEQ ID NO: 3889 - DNA, 23 bp, Homo sapiens
tgatacaacctcattctacaagg

SEQ ID NO: 3890 - DNA, 23 bp, Homo sapiens
atcggcactgccaggtaggcagg

SEQ ID NO: 3891 - DNA, 23 bp, Homo sapiens
aagagaagttgtactggcagggg

SEQ ID NO: 3892 - DNA, 23 bp, Homo sapiens
ggaaccctagccgtgtttgcagg

SEQ ID NO: 3893 - DNA, 23 bp, Homo sapiens
gacttagtcccagccctcacagg

SEQ ID NO: 3894 - DNA, 23 bp, Homo sapiens
gcagtcagatcattccagctagg

SEQ ID NO: 3895 - DNA, 23 bp, Homo sapiens
tagtgcttatgcatcttccctgg

SEQ ID NO: 3896 - DNA, 23 bp, Homo sapiens
agattggaaattcatagcccagg

SEQ ID NO: 3897 - DNA, 23 bp, Homo sapiens
ctggctggcatgatctaggaagg

SEQ ID NO: 3898 - DNA, 23 bp, Homo sapiens
ccagtacgaaaacagtcatcagg

SEQ ID NO: 3899 - DNA, 23 bp, Homo sapiens
ttcttgatcggatgtttctgtgg

SEQ ID NO: 3900 - DNA, 23 bp, Homo sapiens
cagccactacttgggaacacagg

SEQ ID NO: 3901 - DNA, 23 bp, Homo sapiens
gcgtggttacgcaaagtctttgg

SEQ ID NO: 3902 - DNA, 23 bp, Homo sapiens
tcatagaccgattcttcatgtgg

SEQ ID NO: 3903 - DNA, 23 bp, Homo sapiens
accctccagtcttcaaggaaagg

SEQ ID NO: 3904 - DNA, 23 bp, Homo sapiens
agatgaggaagggcctcacttgg

SEQ ID NO: 3905 - DNA, 23 bp, Homo sapiens
gtggctacatagttaccattagg

SEQ ID NO: 3906 - DNA, 23 bp, Homo sapiens
acgctgcccagcgtgactgaggg

SEQ ID NO: 3907 - DNA, 23 bp, Homo sapiens
tccctccaaggcattcagagagg

SEQ ID NO: 3908 - DNA, 23 bp, Homo sapiens
gacaagcgcttcatctagggtgg

SEQ ID NO: 3909 - DNA, 23 bp, Homo sapiens
aagtcggtgcgagctaaggctgg

SEQ ID NO: 3910 - DNA, 23 bp, Homo sapiens
agtggttggttggctcagtctgg

SEQ ID NO: 3911 - DNA, 23 bp, Homo sapiens
ttccgccccttctcgtgacccgg

SEQ ID NO: 3912 - DNA, 23 bp, Homo sapiens
ttagcaaaaagtctggtttctgg

SEQ ID NO: 3913 - DNA, 23 bp, Homo sapiens
accccctttattccaatttcagg

SEQ ID NO: 3914 - DNA, 23 bp, Homo sapiens
aacgcgaaagctttcagtctcgg

SEQ ID NO: 3915 - DNA, 23 bp, Homo sapiens
cctacctgcggctgctctagcgg

SEQ ID NO: 3916 - DNA, 23 bp, Homo sapiens
tcactgctgacacgcctccttgg

SEQ ID NO: 3917 - DNA, 23 bp, Homo sapiens
atgctgttccccattattcatgg

SEQ ID NO: 3918 - DNA, 23 bp, Homo sapiens
tcgcggatgaggcgtttgcgtgg

SEQ ID NO: 3919 - DNA, 23 bp, Homo sapiens
cggaagccccgtctctaaaaggg

SEQ ID NO: 3920 - DNA, 23 bp, Homo sapiens
accttctgggtcacgtagggggg

SEQ ID NO: 3921 - DNA, 23 bp, Homo sapiens
cctgagcaaatccactaagaggg

SEQ ID NO: 3922 - DNA, 23 bp, Homo sapiens
aaggcccagagttctcagtcagg

SEQ ID NO: 3923 - DNA, 23 bp, Homo sapiens
cctcgcacccccgaaattagtgg

SEQ ID NO: 3924 - DNA, 23 bp, Homo sapiens
gacagggatgggaggctacgtgg

SEQ ID NO: 3925 - DNA, 23 bp, Homo sapiens
ctttgcagatctgtactgagggg

SEQ ID NO: 3926 - DNA, 23 bp, Homo sapiens
agtcgtgagacagtatttaaagg

SEQ ID NO: 3927 - DNA, 23 bp, Homo sapiens
gcaataataatggctcagtgagg

SEQ ID NO: 3928 - DNA, 23 bp, Homo sapiens
ccatgcaactggctgaactctgg

SEQ ID NO: 3929 - DNA, 23 bp, Homo sapiens
gcggcgcagcctgtacatcaggg

SEQ ID NO: 3930 - DNA, 23 bp, Homo sapiens
ggagggaaaatggtgtttaaggg

SEQ ID NO: 3931 - DNA, 23 bp, Homo sapiens
gtcagagcatatgacaagtgagg

SEQ ID NO: 3932 - DNA, 23 bp, Homo sapiens
gatgggcaggcttcaatcattgg

SEQ ID NO: 3933 - DNA, 23 bp, Homo sapiens
catgaggcaaatgaggaacaggg

SEQ ID NO: 3934 - DNA, 23 bp, Homo sapiens
taatagtgcttaaatggccaagg

SEQ ID NO: 3935 - DNA, 23 bp, Homo sapiens
aataagagagtcatttgtcgggg

SEQ ID NO: 3936 - DNA, 23 bp, Homo sapiens
accatgctgtgtctgttatgcgg

SEQ ID NO: 3937 - DNA, 23 bp, Homo sapiens
cgggacccaggtcctctagtcgg

SEQ ID NO: 3938 - DNA, 23 bp, Homo sapiens
ccaaagtcgaggtagctcagagg

SEQ ID NO: 3939 - DNA, 23 bp, Homo sapiens
agccttcaaacctggggaaaagg

SEQ ID NO: 3940 - DNA, 23 bp, Homo sapiens
caatcttcatgatgcctaggagg

SEQ ID NO: 3941 - DNA, 23 bp, Homo sapiens
agctgtatgccctgggctagagg

SEQ ID NO: 3942 - DNA, 23 bp, Homo sapiens
cacgctggggctgctgtcacagg

SEQ ID NO: 3943 - DNA, 23 bp, Homo sapiens
actttccacatccggatctgagg

SEQ ID NO: 3944 - DNA, 23 bp, Homo sapiens
ccttccacatccgaatctgatgg

SEQ ID NO: 3945 - DNA, 23 bp, Homo sapiens
tcctttcggattcacttctgggg

SEQ ID NO: 3946 - DNA, 23 bp, Homo sapiens
cagctgccacaggcaggtgaggg

SEQ ID NO: 3947 - DNA, 23 bp, Homo sapiens
ggcaggttcacgtgtggataggg

SEQ ID NO: 3948 - DNA, 23 bp, Homo sapiens
ccgcctccattcctactaagggg

SEQ ID NO: 3949 - DNA, 23 bp, Homo sapiens
tcactgcagtatcttcagacagg

SEQ ID NO: 3950 - DNA, 23 bp, Homo sapiens
agcacagctgggatcatctcagg

SEQ ID NO: 3951 - DNA, 23 bp, Homo sapiens
accacaaaacttagttgatcagg

SEQ ID NO: 3952 - DNA, 23 bp, Homo sapiens
ggtagggtccggcagtgacctgg

SEQ ID NO: 3953 - DNA, 23 bp, Homo sapiens
gctcttggagatgtacaggaagg

SEQ ID NO: 3954 - DNA, 23 bp, Homo sapiens
tctcaggacgtcagagagctcgg

SEQ ID NO: 3955 - DNA, 23 bp, Homo sapiens
atactgagattcacagtttctgg

SEQ ID NO: 3956 - DNA, 23 bp, Homo sapiens
aaatatgcctctgtgctatatgg

SEQ ID NO: 3957 - DNA, 23 bp, Homo sapiens
actttagtatgtgtacctcctgg

SEQ ID NO: 3958 - DNA, 23 bp, Homo sapiens
actgtcataactgtctctgtagg

SEQ ID NO: 3959 - DNA, 23 bp, Homo sapiens
agagacagttatgacagttacgg

SEQ ID NO: 3960 - DNA, 23 bp, Homo sapiens
ttactcgttgtgtgtagctgagg

SEQ ID NO: 3961 - DNA, 23 bp, Homo sapiens
gaagagactggagacaatgtggg

SEQ ID NO: 3962 - DNA, 23 bp, Homo sapiens
agttagagtgatgtcatctctgg

SEQ ID NO: 3963 - DNA, 23 bp, Homo sapiens
gtgggctccccactctgaggggg

SEQ ID NO: 3964 - DNA, 23 bp, Homo sapiens
ttgccccgtacagtcagagctgg

SEQ ID NO: 3965 - DNA, 23 bp, Homo sapiens
cccgctgtcccaggtgaacaagg

SEQ ID NO: 3966 - DNA, 23 bp, Homo sapiens
acttggcattagcagctagatgg

SEQ ID NO: 3967 - DNA, 23 bp, Homo sapiens
gagtcaacagctcactctgctgg

SEQ ID NO: 3968 - DNA, 23 bp, Homo sapiens
ccggctccgtgagctgctgaggg

SEQ ID NO: 3969 - DNA, 23 bp, Homo sapiens
ggtccctctatcaggttttgagg

SEQ ID NO: 3970 - DNA, 23 bp, Homo sapiens
actgtgccgggtgtactatgagg

SEQ ID NO: 3971 - DNA, 23 bp, Homo sapiens
agccattctggcaggggctcagg

SEQ ID NO: 3972 - DNA, 23 bp, Homo sapiens
aggcgctgcctgtaacattgggg

SEQ ID NO: 3973 - DNA, 23 bp, Homo sapiens
agtggagaagattcacgaaaagg

SEQ ID NO: 3974 - DNA, 23 bp, Homo sapiens
agacgacttgaaaaaaagactgg

SEQ ID NO: 3975 - DNA, 23 bp, Homo sapiens
tgtgggccgggcttcatttctgg

SEQ ID NO: 3976 - DNA, 23 bp, Homo sapiens
caacattgacagttggtggaggg

SEQ ID NO: 3977 - DNA, 23 bp, Homo sapiens
tttcatgcacaggctttttctgg

SEQ ID NO: 3978 - DNA, 23 bp, Homo sapiens
ggtgggcaggcgcctacttctgg

SEQ ID NO: 3979 - DNA, 23 bp, Homo sapiens
ggcgatggggagttaatgcttgg

SEQ ID NO: 3980 - DNA, 23 bp, Homo sapiens
ccaccccctctgcctcagtttgg

SEQ ID NO: 3981 - DNA, 23 bp, Homo sapiens
gcttgccagcttcatttctttgg

SEQ ID NO: 3982 - DNA, 23 bp, Homo sapiens
aagagaagaatatgtggttctgg

SEQ ID NO: 3983 - DNA, 23 bp, Homo sapiens
atgtctccacgcacagctaatgg

SEQ ID NO: 3984 - DNA, 23 bp, Homo sapiens
gatcccactactgatgtttctgg

SEQ ID NO: 3985 - DNA, 23 bp, Homo sapiens
cccactcttctgcctaatgtcgg

SEQ ID NO: 3986 - DNA, 23 bp, Homo sapiens
agtgtcagtttgagcttgcgtgg

SEQ ID NO: 3987 - DNA, 23 bp, Homo sapiens
agctgacattaaatttggtcagg

SEQ ID NO: 3988 - DNA, 23 bp, Homo sapiens
ctgcagctgtcaatagcctaggg

SEQ ID NO: 3989 - DNA, 23 bp, Homo sapiens
agagcagacaagaaagagaatgg

SEQ ID NO: 3990 - DNA, 23 bp, Homo sapiens
cttcgttaaggttcaaatggtgg

SEQ ID NO: 3991 - DNA, 23 bp, Homo sapiens
tcagcagcccctgtggctagagg

SEQ ID NO: 3992 - DNA, 23 bp, Homo sapiens
accctgcacctgggggctcatgg

SEQ ID NO: 3993 - DNA, 23 bp, Homo sapiens
aggtcgtgggagggggtcaaagg

SEQ ID NO: 3994 - DNA, 23 bp, Homo sapiens
gccacccacgaggggctcattgg

SEQ ID NO: 3995 - DNA, 23 bp, Homo sapiens
agttgaacattattgaagcgggg

SEQ ID NO: 3996 - DNA, 23 bp, Homo sapiens
ggagagagaagaaacggaagagg

SEQ ID NO: 3997 - DNA, 23 bp, Homo sapiens
acatgatggattcggggtcctgg

SEQ ID NO: 3998 - DNA, 23 bp, Homo sapiens
cccttagaccgagaagtaggagg

SEQ ID NO: 3999 - DNA, 23 bp, Homo sapiens
tagttgaagagaatggaatcagg

SEQ ID NO: 4000 - DNA, 23 bp, Homo sapiens
gggtgggctgggctgtcagatgg

SEQ ID NO: 4001 - DNA, 23 bp, Homo sapiens
ctctcgctggcccagacgtgagg

SEQ ID NO: 4002 - DNA, 23 bp, Homo sapiens
ccgccagctccaaagtgagccgg

SEQ ID NO: 4003 - DNA, 23 bp, Homo sapiens
ccgccagccccaaagtgagccgg

SEQ ID NO: 4004 - DNA, 23 bp, Homo sapiens
tcacacgtagtctttcccgctgg

SEQ ID NO: 4005 - DNA, 23 bp, Homo sapiens
tctcggacaaagtatcatggtgg

SEQ ID NO: 4006 - DNA, 23 bp, Homo sapiens
aagagtgcccacgtataagaggg

SEQ ID NO: 4007 - DNA, 23 bp, Homo sapiens
gtttcacacaccacttaatgggg

SEQ ID NO: 4008 - DNA, 23 bp, Homo sapiens
cggccacgcacagcgggtacagg

SEQ ID NO: 4009 - DNA, 23 bp, Homo sapiens
gggccagagctgctacacgtagg

SEQ ID NO: 4010 - DNA, 23 bp, Homo sapiens
aatgtatgctgtagacacaaggg

SEQ ID NO: 4011 - DNA, 23 bp, Homo sapiens
aaggaggcattagacataactgg

SEQ ID NO: 4012 - DNA, 23 bp, Homo sapiens
gcattacacatagtcgtgcttgg

SEQ ID NO: 4013 - DNA, 23 bp, Homo sapiens
ctggggcataggatgggcatagg

SEQ ID NO: 4014 - DNA, 23 bp, Homo sapiens
gcggagctcagacgtactctcgg

SEQ ID NO: 4015 - DNA, 23 bp, Homo sapiens
ggactggacattacacacccagg

SEQ ID NO: 4016 - DNA, 23 bp, Homo sapiens
ttcttcacacataccctgtcagg

SEQ ID NO: 4017 - DNA, 23 bp, Homo sapiens
caattccacacacaatctgaagg

SEQ ID NO: 4018 - DNA, 23 bp, Homo sapiens
cctttctggcttagtgtttcagg

SEQ ID NO: 4019 - DNA, 23 bp, Homo sapiens
caggctctacaagcgtctagagg

SEQ ID NO: 4020 - DNA, 23 bp, Homo sapiens
agtgtccctacctggaagatggg

SEQ ID NO: 4021 - DNA, 23 bp, Homo sapiens
catgctaagacctaggaacctgg

SEQ ID NO: 4022 - DNA, 23 bp, Homo sapiens
accgcaaggactacgtctaaggg

SEQ ID NO: 4023 - DNA, 23 bp, Homo sapiens
ccgtacggccaagtgcatcctgg

SEQ ID NO: 4024 - DNA, 23 bp, Homo sapiens
gctgccagcaactacgtgtaagg

SEQ ID NO: 4025 - DNA, 23 bp, Homo sapiens
acaagaagaactacgtctgaggg

SEQ ID NO: 4026 - DNA, 23 bp, Homo sapiens
accaagaattacgtctgacgtgg

SEQ ID NO: 4027 - DNA, 23 bp, Homo sapiens
ccatctttattggctgggcaggg

SEQ ID NO: 4028 - DNA, 23 bp, Homo sapiens
tccaaggagtatgtgtgacctgg

SEQ ID NO: 4029 - DNA, 23 bp, Homo sapiens
caactacacatactgacttctgg

SEQ ID NO: 4030 - DNA, 23 bp, Homo sapiens
aagagggactacgtgtgaggcgg

SEQ ID NO: 4031 - DNA, 23 bp, Homo sapiens
cttaatgaaggcatatcgtgtgg

SEQ ID NO: 4032 - DNA, 23 bp, Homo sapiens
aggctgcagtcacagacacacgg

SEQ ID NO: 4033 - DNA, 23 bp, Homo sapiens
aggcagctcagtgactctcctgg

SEQ ID NO: 4034 - DNA, 23 bp, Homo sapiens
tgcgagttccccttctagcgggg

SEQ ID NO: 4035 - DNA, 23 bp, Homo sapiens
acatattttagggaggcatgagg

SEQ ID NO: 4036 - DNA, 23 bp, Homo sapiens
ttccactcgtggtatgagagtgg

SEQ ID NO: 4037 - DNA, 23 bp, Homo sapiens
cccagtgaagactgaggatttgg

SEQ ID NO: 4038 - DNA, 23 bp, Homo sapiens
tgtacgtctctaactattgaggg

SEQ ID NO: 4039 - DNA, 23 bp, Homo sapiens
cttggctctagtgatgcataggg

SEQ ID NO: 4040 - DNA, 23 bp, Homo sapiens
aagctggtgctgccagccgacgg

SEQ ID NO: 4041 - DNA, 23 bp, Homo sapiens
ggcactgactcagtcctcagcgg

SEQ ID NO: 4042 - DNA, 23 bp, Homo sapiens
cctcggccctgggcttcaacagg

SEQ ID NO: 4043 - DNA, 23 bp, Homo sapiens
gtcctcatcgtggatgttattgg

SEQ ID NO: 4044 - DNA, 23 bp, Homo sapiens
cggtggggcccagggtcctgagg

SEQ ID NO: 4045 - DNA, 23 bp, Homo sapiens
gacaagacaggatcaatgaatgg

SEQ ID NO: 4046 - DNA, 23 bp, Homo sapiens
ccccctgaaacattaggcgaagg

SEQ ID NO: 4047 - DNA, 23 bp, Homo sapiens
cctctttgcattaaggtagttgg

SEQ ID NO: 4048 - DNA, 23 bp, Homo sapiens
gatggagtccatagttccagagg

SEQ ID NO: 4049 - DNA, 23 bp, Homo sapiens
tctgctgggaccccttagatagg

SEQ ID NO: 4050 - DNA, 23 bp, Homo sapiens
ccgaaagaaaatggatttgcagg

SEQ ID NO: 4051 - DNA, 23 bp, Homo sapiens
aagatggcctatacttgaggtgg

SEQ ID NO: 4052 - DNA, 23 bp, Homo sapiens
cattggagaaagacctattgagg

SEQ ID NO: 4053 - DNA, 23 bp, Homo sapiens
ccagttcgggatcgtgtagccgg

SEQ ID NO: 4054 - DNA, 23 bp, Homo sapiens
atctcacaaactgacctttgagg

SEQ ID NO: 4055 - DNA, 23 bp, Homo sapiens
atcttgcaaattgacttctgagg

SEQ ID NO: 4056 - DNA, 23 bp, Homo sapiens
ttctagttcaatgttgttccagg

SEQ ID NO: 4057 - DNA, 23 bp, Homo sapiens
tttcggatttgtgaaatggtagg

SEQ ID NO: 4058 - DNA, 23 bp, Homo sapiens
atgaaggcagcatcccttcctgg

SEQ ID NO: 4059 - DNA, 23 bp, Homo sapiens
atgggtccttcatcccctagtgg

SEQ ID NO: 4060 - DNA, 23 bp, Homo sapiens
caggttgctcttagttactgagg

SEQ ID NO: 4061 - DNA, 23 bp, Homo sapiens
acggctggatctgtgagaaaagg

SEQ ID NO: 4062 - DNA, 23 bp, Homo sapiens
gtggagaacccaacaatagcggg

SEQ ID NO: 4063 - DNA, 23 bp, Homo sapiens
caactattcgtctctgaagcagg

SEQ ID NO: 4064 - DNA, 23 bp, Homo sapiens
cacagggaactgtgatcatttgg

SEQ ID NO: 4065 - DNA, 23 bp, Homo sapiens
ggaaacctacaggatggggctgg

SEQ ID NO: 4066 - DNA, 23 bp, Homo sapiens
acccatctccaaattgtgtatgg

SEQ ID NO: 4067 - DNA, 23 bp, Homo sapiens
atgagggcacactacacagttgg

SEQ ID NO: 4068 - DNA, 23 bp, Homo sapiens
ttcaaagctgtggaattcaaagg

SEQ ID NO: 4069 - DNA, 23 bp, Homo sapiens
acacaatttctttcagacagagg

SEQ ID NO: 4070 - DNA, 23 bp, Homo sapiens
tgcataagggaaaatgttactgg

SEQ ID NO: 4071 - DNA, 23 bp, Homo sapiens
acgcaaaagaagagtacgaaagg

SEQ ID NO: 4072 - DNA, 23 bp, Homo sapiens
acctaatggaacatgtgttttgg

SEQ ID NO: 4073 - DNA, 23 bp, Homo sapiens
tcccaggaggggcttatttgagg

SEQ ID NO: 4074 - DNA, 23 bp, Homo sapiens
tgtggctaaacagaagagttagg

SEQ ID NO: 4075 - DNA, 23 bp, Homo sapiens
gacgcggggtggggcgctagcgg

SEQ ID NO: 4076 - DNA, 23 bp, Homo sapiens
tacctgtcccagtgataaggagg

SEQ ID NO: 4077 - DNA, 23 bp, Homo sapiens
aaaatggctgtgctcaggatcgg

SEQ ID NO: 4078 - DNA, 23 bp, Homo sapiens
aggaacaagtaccactgaaaggg

SEQ ID NO: 4079 - DNA, 23 bp, Homo sapiens
tgttcaatctcttgatcagctgg

SEQ ID NO: 4080 - DNA, 23 bp, Homo sapiens
atttgcaaaggcatcttgcttgg

SEQ ID NO: 4081 - DNA, 23 bp, Homo sapiens
ccactggaggcttcatcagaagg

SEQ ID NO: 4082 - DNA, 23 bp, Homo sapiens
ggacaaagctcagaaacaagagg

SEQ ID NO: 4083 - DNA, 23 bp, Homo sapiens
gggcggagatgcagtcttagagg

SEQ ID NO: 4084 - DNA, 23 bp, Homo sapiens
aacttctgcttcttcccaaaagg

SEQ ID NO: 4085 - DNA, 23 bp, Homo sapiens
tgacctatcggggaattaatggg

SEQ ID NO: 4086 - DNA, 23 bp, Homo sapiens
ttcttcagaaggtcaaagaaagg

SEQ ID NO: 4087 - DNA, 23 bp, Homo sapiens
actccagtcgggatatcagtcgg

SEQ ID NO: 4088 - DNA, 23 bp, Homo sapiens
ccgcaacccaagcagatgacagg

SEQ ID NO: 4089 - DNA, 23 bp, Homo sapiens
atgctgcaatgcttcatccaagg

SEQ ID NO: 4090 - DNA, 23 bp, Homo sapiens
tgatgggaagaaggaagcacagg

SEQ ID NO: 4091 - DNA, 23 bp, Homo sapiens
tcccacaactggatgttagcagg

SEQ ID NO: 4092 - DNA, 23 bp, Homo sapiens
ccattgtaattcagaccgtttgg

SEQ ID NO: 4093 - DNA, 23 bp, Homo sapiens
atcccgagtatcaggagagctgg

SEQ ID NO: 4094 - DNA, 23 bp, Homo sapiens
atcagaaacaaaacactctctgg

SEQ ID NO: 4095 - DNA, 23 bp, Homo sapiens
acacccttcacgtcagcagtcgg

SEQ ID NO: 4096 - DNA, 23 bp, Homo sapiens
caggtactggtcagatgcacggg

SEQ ID NO: 4097 - DNA, 23 bp, Homo sapiens
cacctcttgcctctgtagcctgg

SEQ ID NO: 4098 - DNA, 23 bp, Homo sapiens
aacagttgctggacagtttgagg

SEQ ID NO: 4099 - DNA, 23 bp, Homo sapiens
aggaagcacgtgtgctactgtgg

SEQ ID NO: 4100 - DNA, 23 bp, Homo sapiens
tctacttcagatccatgaaccgg

SEQ ID NO: 4101 - DNA, 23 bp, Homo sapiens
gcaggcaggtggctgctagatgg

SEQ ID NO: 4102 - DNA, 23 bp, Homo sapiens
cccagctctcaggtgctagctgg

SEQ ID NO: 4103 - DNA, 23 bp, Homo sapiens
gggtgggcagtctcactgcttgg

SEQ ID NO: 4104 - DNA, 23 bp, Homo sapiens
gaaaattggaaggcagaagttgg

SEQ ID NO: 4105 - DNA, 23 bp, Homo sapiens
atgcttcctgccttcgaatacgg

SEQ ID NO: 4106 - DNA, 23 bp, Homo sapiens
gactttaatgtctcaggagctgg

SEQ ID NO: 4107 - DNA, 23 bp, Homo sapiens
gccggtgccatatgatttagagg

SEQ ID NO: 4108 - DNA, 23 bp, Homo sapiens
gccagcagaggacaagaaaaagg

SEQ ID NO: 4109 - DNA, 23 bp, Homo sapiens
gggcgccccacacggactgaagg

SEQ ID NO: 4110 - DNA, 23 bp, Homo sapiens
agctgtttgcagcatctgcttgg

SEQ ID NO: 4111 - DNA, 23 bp, Homo sapiens
ggaccatgcagagtttcaaaagg

SEQ ID NO: 4112 - DNA, 23 bp, Homo sapiens
gtcagttccaggctcagctgtgg

SEQ ID NO: 4113 - DNA, 23 bp, Homo sapiens
tgcagatctaatgtactgaaagg

SEQ ID NO: 4114 - DNA, 23 bp, Homo sapiens
agaggccacggtcacagctgagg

SEQ ID NO: 4115 - DNA, 23 bp, Homo sapiens
cagaataaaattccgtcccttgg

SEQ ID NO: 4116 - DNA, 23 bp, Homo sapiens
aaaacagatgatagcacttcagg

SEQ ID NO: 4117 - DNA, 23 bp, Homo sapiens
tttgacccacatggttaagctgg

SEQ ID NO: 4118 - DNA, 23 bp, Homo sapiens
ggggcacgggtcagtagctgagg

SEQ ID NO: 4119 - DNA, 23 bp, Homo sapiens
gcagacccctgggcactagtagg

SEQ ID NO: 4120 - DNA, 23 bp, Homo sapiens
acccccccacaccgctactaagg

SEQ ID NO: 4121 - DNA, 23 bp, Homo sapiens
gtggctcttcagtgcaccagcgg

SEQ ID NO: 4122 - DNA, 23 bp, Homo sapiens
agaagaatggtatgcaagacagg

SEQ ID NO: 4123 - DNA, 23 bp, Homo sapiens
tgcacctagcaggcacctagcgg

SEQ ID NO: 4124 - DNA, 23 bp, Homo sapiens
gacagccacagcctggctttggg

SEQ ID NO: 4125 - DNA, 23 bp, Homo sapiens
ggagagtctgcgcaagcaagagg

SEQ ID NO: 4126 - DNA, 23 bp, Homo sapiens
aggaataccgcaaaaagcaccgg

SEQ ID NO: 4127 - DNA, 23 bp, Homo sapiens
agtcattgtcactctcatccagg

SEQ ID NO: 4128 - DNA, 23 bp, Homo sapiens
ccgagcgtgcagggatagagagg

SEQ ID NO: 4129 - DNA, 23 bp, Homo sapiens
taacttcattggctacgtagtgg

SEQ ID NO: 4130 - DNA, 23 bp, Homo sapiens
tcagggttcagtccagagccagg

SEQ ID NO: 4131 - DNA, 23 bp, Homo sapiens
catgcaaccattgctttctctgg

SEQ ID NO: 4132 - DNA, 23 bp, Homo sapiens
tacgcttgccacctccatcaagg

SEQ ID NO: 4133 - DNA, 23 bp, Homo sapiens
tccaggattaatttgcctgcagg

SEQ ID NO: 4134 - DNA, 23 bp, Homo sapiens
agagcacatttgcctactaatgg

SEQ ID NO: 4135 - DNA, 23 bp, Homo sapiens
cctacattgacgaggccagaagg

SEQ ID NO: 4136 - DNA, 23 bp, Homo sapiens
gaagcttccaacaagcatgtagg

SEQ ID NO: 4137 - DNA, 23 bp, Homo sapiens
tatttttcggattcctctggagg

SEQ ID NO: 4138 - DNA, 23 bp, Homo sapiens
ttgatgcagacttccgtgttagg

SEQ ID NO: 4139 - DNA, 23 bp, Homo sapiens
cttgagctgggagcttcaccagg

SEQ ID NO: 4140 - DNA, 23 bp, Homo sapiens
cagtgaggatcaaagcatgccgg

SEQ ID NO: 4141 - DNA, 23 bp, Homo sapiens
gtgcagatttttgacaaggaagg

SEQ ID NO: 4142 - DNA, 23 bp, Homo sapiens
acggttcactaaaactattctgg

SEQ ID NO: 4143 - DNA, 23 bp, Homo sapiens
cagtgtgtttcgtcaaaagtagg

SEQ ID NO: 4144 - DNA, 23 bp, Homo sapiens
gggatgtcaggggtcattccagg

SEQ ID NO: 4145 - DNA, 23 bp, Homo sapiens
ttaggacacagacttagaaaagg

SEQ ID NO: 4146 - DNA, 23 bp, Homo sapiens
ggcatttactctatgtcgggggg

SEQ ID NO: 4147 - DNA, 23 bp, Homo sapiens
ggcgccgggctggcttcaggcgg

SEQ ID NO: 4148 - DNA, 23 bp, Homo sapiens
gcaaagggaaagaaatgacttgg

SEQ ID NO: 4149 - DNA, 23 bp, Homo sapiens
ccgactcggactctgactgaagg

SEQ ID NO: 4150 - DNA, 23 bp, Homo sapiens
atccagcgcctggacacgtgagg

SEQ ID NO: 4151 - DNA, 23 bp, Homo sapiens
acctgctgagtttgaatcactgg

SEQ ID NO: 4152 - DNA, 23 bp, Homo sapiens
ggtagccccagagtcactgctgg

SEQ ID NO: 4153 - DNA, 23 bp, Homo sapiens
cagagtctttaggcattaagtgg

SEQ ID NO: 4154 - DNA, 23 bp, Homo sapiens
ggggttgtggcctcatcagacgg

SEQ ID NO: 4155 - DNA, 23 bp, Homo sapiens
ggtaaatcactgtatggtcctgg

SEQ ID NO: 4156 - DNA, 23 bp, Homo sapiens
ctccttcatccagatgcacaggg

SEQ ID NO: 4157 - DNA, 23 bp, Homo sapiens
tgaatgctgccattgctaaaagg

SEQ ID NO: 4158 - DNA, 23 bp, Homo sapiens
tagagcccccggattctgtaagg

SEQ ID NO: 4159 - DNA, 23 bp, Homo sapiens
tgccatctcaacttcttttttgg

SEQ ID NO: 4160 - DNA, 23 bp, Homo sapiens
aaggtgcacactgtggagcaggg

SEQ ID NO: 4161 - DNA, 23 bp, Homo sapiens
gtacaaaatccgagaactcttgg

SEQ ID NO: 4162 - DNA, 23 bp, Homo sapiens
tctttctcagttctgagcttagg

SEQ ID NO: 4163 - DNA, 23 bp, Homo sapiens
tgcacgggaatgcacaattgagg

SEQ ID NO: 4164 - DNA, 23 bp, Homo sapiens
gttcttgtgattaatggagctgg

SEQ ID NO: 4165 - DNA, 23 bp, Homo sapiens
ggtctcccagctgaaggactagg

SEQ ID NO: 4166 - DNA, 23 bp, Homo sapiens
tgtcattgaacatgaggcctagg

SEQ ID NO: 4167 - DNA, 23 bp, Homo sapiens
gaactgaagatccgagagtaagg

SEQ ID NO: 4168 - DNA, 23 bp, Homo sapiens
tcggttctatgtagagtcgatgg

SEQ ID NO: 4169 - DNA, 23 bp, Homo sapiens
tcgtcagcagcagccagctcagg

SEQ ID NO: 4170 - DNA, 23 bp, Homo sapiens
cggggatgctacaaaaacagagg

SEQ ID NO: 4171 - DNA, 23 bp, Homo sapiens
ggatggggatggggtcactctgg

SEQ ID NO: 4172 - DNA, 23 bp, Homo sapiens
gaggagaaggcggagtaaggtgg

SEQ ID NO: 4173 - DNA, 23 bp, Homo sapiens
gtctgcacatcacatatcccagg

SEQ ID NO: 4174 - DNA, 23 bp, Homo sapiens
ttctgctgagggcggagaagagg

SEQ ID NO: 4175 - DNA, 23 bp, Homo sapiens
catattgtcagaaggaaggatgg

SEQ ID NO: 4176 - DNA, 23 bp, Homo sapiens
acgttggtgagtttctaaggggg

SEQ ID NO: 4177 - DNA, 23 bp, Homo sapiens
aaaggtagtagaagaaggagagg

SEQ ID NO: 4178 - DNA, 23 bp, Homo sapiens
acatgaagaagcagagcaagtgg

SEQ ID NO: 4179 - DNA, 23 bp, Homo sapiens
cgaggttacggtgattagcaagg

SEQ ID NO: 4180 - DNA, 23 bp, Homo sapiens
tcaacttacctgttgccacttgg

SEQ ID NO: 4181 - DNA, 23 bp, Homo sapiens
agagtgctggccagggtcagagg

SEQ ID NO: 4182 - DNA, 23 bp, Homo sapiens
gaggcagcaggggaaaacatagg

SEQ ID NO: 4183 - DNA, 23 bp, Homo sapiens
tgaatgagtgtgtgctagagagg

SEQ ID NO: 4184 - DNA, 23 bp, Homo sapiens
aaactgttgactcactgagaggg

SEQ ID NO: 4185 - DNA, 23 bp, Homo sapiens
ggtggcccgtatcttgggcatgg

SEQ ID NO: 4186 - DNA, 23 bp, Homo sapiens
gaaggccttgtggccctaggcgg

SEQ ID NO: 4187 - DNA, 23 bp, Homo sapiens
caggaggaggccggctactgagg

SEQ ID NO: 4188 - DNA, 23 bp, Homo sapiens
gattaccaatatagcgaccaagg

SEQ ID NO: 4189 - DNA, 23 bp, Homo sapiens
acacctctgatcacatgacaggg

SEQ ID NO: 4190 - DNA, 23 bp, Homo sapiens
tgcagccagcgcggcctagatgg

SEQ ID NO: 4191 - DNA, 23 bp, Homo sapiens
ttgtctcttcttttcagtgttgg

SEQ ID NO: 4192 - DNA, 23 bp, Homo sapiens
ggcggaacccaggcgtttaacgg

SEQ ID NO: 4193 - DNA, 23 bp, Homo sapiens
ccacgagaatgccatctgacagg

SEQ ID NO: 4194 - DNA, 23 bp, Homo sapiens
gagatgcagtttcgtctaactgg

SEQ ID NO: 4195 - DNA, 23 bp, Homo sapiens
tctttgtctatatatggcactgg

SEQ ID NO: 4196 - DNA, 23 bp, Homo sapiens
gtatcactttctctgcacagtgg

SEQ ID NO: 4197 - DNA, 23 bp, Homo sapiens
tttgacattttggtctcagaagg

SEQ ID NO: 4198 - DNA, 23 bp, Homo sapiens
ttttagaaggcttgctgagcagg

SEQ ID NO: 4199 - DNA, 23 bp, Homo sapiens
gagggaggggccggtgtcactgg

SEQ ID NO: 4200 - DNA, 23 bp, Homo sapiens
tacaagtctccacactactgtgg

SEQ ID NO: 4201 - DNA, 23 bp, Homo sapiens
ggttgctcctctttgcctaatgg

SEQ ID NO: 4202 - DNA, 23 bp, Homo sapiens
gcatccaccttcctggcaggagg

SEQ ID NO: 4203 - DNA, 23 bp, Homo sapiens
acttgcctaatcggaggtagtgg

SEQ ID NO: 4204 - DNA, 23 bp, Homo sapiens
tgattcattgctcacaggaatgg

SEQ ID NO: 4205 - DNA, 23 bp, Homo sapiens
ttcatgtcatgactgcttgttgg

SEQ ID NO: 4206 - DNA, 23 bp, Homo sapiens
tcaacaacatgcagcagtgatgg

SEQ ID NO: 4207 - DNA, 23 bp, Homo sapiens
ggaacagggaaggatcactgagg

SEQ ID NO: 4208 - DNA, 23 bp, Homo sapiens
tttcagatttgactttctgctgg

SEQ ID NO: 4209 - DNA, 23 bp, Homo sapiens
tggtgagaacactcatatgatgg

SEQ ID NO: 4210 - DNA, 23 bp, Homo sapiens
ttcgttttcccaggctaggtagg

SEQ ID NO: 4211 - DNA, 23 bp, Homo sapiens
tgctaatcatactgagctctagg

SEQ ID NO: 4212 - DNA, 23 bp, Homo sapiens
aaagtagctcactctggctttgg

SEQ ID NO: 4213 - DNA, 23 bp, Homo sapiens
gctcatcatgcgatatgtgcagg

SEQ ID NO: 4214 - DNA, 23 bp, Homo sapiens
agctctgagtcacttcccattgg

SEQ ID NO: 4215 - DNA, 23 bp, Homo sapiens
atgtatcttagtgtgtctgctgg

SEQ ID NO: 4216 - DNA, 23 bp, Homo sapiens
gggtgggctcagagctcatcagg

SEQ ID NO: 4217 - DNA, 23 bp, Homo sapiens
gcaagggtcaaagatcttctcgg

SEQ ID NO: 4218 - DNA, 23 bp, Homo sapiens
gcatcaggctcacagagcctcgg

SEQ ID NO: 4219 - DNA, 23 bp, Homo sapiens
gacctctctgattgctgatgagg

SEQ ID NO: 4220 - DNA, 23 bp, Homo sapiens
tatgtaagagagatctcttgggg

SEQ ID NO: 4221 - DNA, 23 bp, Homo sapiens
tcagaaagagccactttcagagg

SEQ ID NO: 4222 - DNA, 23 bp, Homo sapiens
caaaaggatagagattgcagagg

SEQ ID NO: 4223 - DNA, 23 bp, Homo sapiens
gtctggaatgctgctaggagagg

SEQ ID NO: 4224 - DNA, 23 bp, Homo sapiens
ttgcttcctctaacacatgaggg

SEQ ID NO: 4225 - DNA, 23 bp, Homo sapiens
atgagagacaattattgaggagg

SEQ ID NO: 4226 - DNA, 23 bp, Homo sapiens
agactgggatcccagcacgtggg

SEQ ID NO: 4227 - DNA, 23 bp, Homo sapiens
gatcaagagactgctggcagtgg

SEQ ID NO: 4228 - DNA, 23 bp, Homo sapiens
atcttctttcatcttcaccttgg

SEQ ID NO: 4229 - DNA, 23 bp, Homo sapiens
atgctgaaaatgacaaggaatgg

SEQ ID NO: 4230 - DNA, 23 bp, Homo sapiens
gcagcttcaggttctcaatatgg

SEQ ID NO: 4231 - DNA, 23 bp, Homo sapiens
ctttggcatccttgtctacttgg

SEQ ID NO: 4232 - DNA, 23 bp, Homo sapiens
ggtgagtgtcaacgatcaccagg

SEQ ID NO: 4233 - DNA, 23 bp, Homo sapiens
ggttccaggatcagagctccagg

SEQ ID NO: 4234 - DNA, 23 bp, Homo sapiens
aaaggagttaatatcaccacagg

SEQ ID NO: 4235 - DNA, 23 bp, Homo sapiens
taatgatttccctcacagctagg

SEQ ID NO: 4236 - DNA, 23 bp, Homo sapiens
aggaagaccacagggatttgagg

SEQ ID NO: 4237 - DNA, 23 bp, Homo sapiens
ttaagtcagcagttttcaccagg

SEQ ID NO: 4238 - DNA, 23 bp, Homo sapiens
atggaaagaaaatgggtgctagg

SEQ ID NO: 4239 - DNA, 23 bp, Homo sapiens
ccttctgactcattcagacctgg

SEQ ID NO: 4240 - DNA, 23 bp, Homo sapiens
aaaggaatggctcatttgagggg

SEQ ID NO: 4241 - DNA, 23 bp, Homo sapiens
tctctgttgatagatgcgtatgg

SEQ ID NO: 4242 - DNA, 23 bp, Homo sapiens
agagaatgtagacagtgctgagg

SEQ ID NO: 4243 - DNA, 23 bp, Homo sapiens
cacagtgagcgagtgtaaacggg

SEQ ID NO: 4244 - DNA, 23 bp, Homo sapiens
acaagacagtattcctcatctgg

SEQ ID NO: 4245 - DNA, 23 bp, Homo sapiens
tgaggagccgggggggagtctgg

SEQ ID NO: 4246 - DNA, 23 bp, Homo sapiens
tgcgggaggtttttcagtcttgg

SEQ ID NO: 4247 - DNA, 23 bp, Homo sapiens
aaacggtgatgaagtgaaaaagg

SEQ ID NO: 4248 - DNA, 23 bp, Homo sapiens
ggagttgcagagtctggaggggg

SEQ ID NO: 4249 - DNA, 23 bp, Homo sapiens
agggcgtcagggtcctaatctgg

SEQ ID NO: 4250 - DNA, 23 bp, Homo sapiens
taggtggtttggggtctcagtgg

SEQ ID NO: 4251 - DNA, 23 bp, Homo sapiens
gcaagattcagaggaagaaaagg

SEQ ID NO: 4252 - DNA, 23 bp, Homo sapiens
agaaacaactgcaaaatcctagg

SEQ ID NO: 4253 - DNA, 23 bp, Homo sapiens
cccttaacatttgggtaatgtgg

SEQ ID NO: 4254 - DNA, 23 bp, Homo sapiens
cactgagaacttttcagtcgagg

SEQ ID NO: 4255 - DNA, 23 bp, Homo sapiens
acctctgaaatattggcatttgg

SEQ ID NO: 4256 - DNA, 23 bp, Homo sapiens
ctcaggccaagcgcttctgatgg

SEQ ID NO: 4257 - DNA, 23 bp, Homo sapiens
tctgttcattcacacgagcaagg

SEQ ID NO: 4258 - DNA, 23 bp, Homo sapiens
tgtggcagggtaacatttaatgg

SEQ ID NO: 4259 - DNA, 23 bp, Homo sapiens
tcttagaatcccagcaataatgg

SEQ ID NO: 4260 - DNA, 23 bp, Homo sapiens
actgacaagctgtctgaacaagg

SEQ ID NO: 4261 - DNA, 23 bp, Homo sapiens
aaggctgctctgctgttgcctgg

SEQ ID NO: 4262 - DNA, 23 bp, Homo sapiens
gatcattgcctgtccatctatgg

SEQ ID NO: 4263 - DNA, 23 bp, Homo sapiens
gtgctcatccaggcagctacagg

SEQ ID NO: 4264 - DNA, 23 bp, Homo sapiens
gcacctggctttacctgatgagg

SEQ ID NO: 4265 - DNA, 23 bp, Homo sapiens
aatggttcagctgcttcaaaagg

SEQ ID NO: 4266 - DNA, 23 bp, Homo sapiens
actggttacaagatgatcatggg

SEQ ID NO: 4267 - DNA, 23 bp, Homo sapiens
agaagcgtctgcacttgctgcgg

SEQ ID NO: 4268 - DNA, 23 bp, Homo sapiens
tcagtaattcacactccgcatgg

SEQ ID NO: 4269 - DNA, 23 bp, Homo sapiens
gcccagcgtggggccctagccgg

SEQ ID NO: 4270 - DNA, 23 bp, Homo sapiens
tggagaggtcatactcaggcagg

SEQ ID NO: 4271 - DNA, 23 bp, Homo sapiens
agctctgtgtgtactcacattgg

SEQ ID NO: 4272 - DNA, 23 bp, Homo sapiens
gttggtcctgtttgttttcttgg

SEQ ID NO: 4273 - DNA, 23 bp, Homo sapiens
gcctgtctgcttcatgggatagg

SEQ ID NO: 4274 - DNA, 23 bp, Homo sapiens
ggtggggaggacaactaaggagg

SEQ ID NO: 4275 - DNA, 23 bp, Homo sapiens
tacaacgggcaaggctatccagg

SEQ ID NO: 4276 - DNA, 23 bp, Homo sapiens
gcttaccagtccaaggctgctgg

SEQ ID NO: 4277 - DNA, 23 bp, Homo sapiens
tcctgaggctatcagactccagg

SEQ ID NO: 4278 - DNA, 23 bp, Homo sapiens
tgacagacgctaggaagtaatgg

SEQ ID NO: 4279 - DNA, 23 bp, Homo sapiens
ggtggggaatttcagccaaaagg

SEQ ID NO: 4280 - DNA, 23 bp, Homo sapiens
aagtctatgctgggcggagaagg

SEQ ID NO: 4281 - DNA, 23 bp, Homo sapiens
gcatccaggcggtggctacttgg

SEQ ID NO: 4282 - DNA, 23 bp, Homo sapiens
atgcccatcagcgcacaggtggg

SEQ ID NO: 4283 - DNA, 23 bp, Homo sapiens
ttgggatggagggagtttacagg

SEQ ID NO: 4284 - DNA, 23 bp, Homo sapiens
caggaattctttgtggacattgg

SEQ ID NO: 4285 - DNA, 23 bp, Homo sapiens
ccagggcctctgggagtgacagg

SEQ ID NO: 4286 - DNA, 23 bp, Homo sapiens
ggcatcagacactaatagtttgg

SEQ ID NO: 4287 - DNA, 23 bp, Homo sapiens
gtaatgtgaagggtccctaaagg

SEQ ID NO: 4288 - DNA, 23 bp, Homo sapiens
ggctgcctgtgcctggctgctgg

SEQ ID NO: 4289 - DNA, 23 bp, Homo sapiens
tttcgttcagttttgagatgagg

SEQ ID NO: 4290 - DNA, 23 bp, Homo sapiens
gcttacccatgcctggctgttgg

SEQ ID NO: 4291 - DNA, 23 bp, Homo sapiens
tgaacagcaaagcagacagcagg

SEQ ID NO: 4292 - DNA, 23 bp, Homo sapiens
gggctctcacttcctgctgctgg

SEQ ID NO: 4293 - DNA, 23 bp, Homo sapiens
gccacgaggtcagaggtcagagg

SEQ ID NO: 4294 - DNA, 23 bp, Homo sapiens
tgtcaagaaacctgcattcaagg

SEQ ID NO: 4295 - DNA, 23 bp, Homo sapiens
ggtttttacaagaagcagaccgg

SEQ ID NO: 4296 - DNA, 23 bp, Homo sapiens
caagaatttggtgtggacgttgg

SEQ ID NO: 4297 - DNA, 23 bp, Homo sapiens
atgttcttctcatacagacttgg

SEQ ID NO: 4298 - DNA, 23 bp, Homo sapiens
cctggcagagatggtgttgcagg

SEQ ID NO: 4299 - DNA, 23 bp, Homo sapiens
tgcatgaagaacctgtgagccgg

SEQ ID NO: 4300 - DNA, 23 bp, Homo sapiens
cggcatcccacccagttgtgagg

SEQ ID NO: 4301 - DNA, 23 bp, Homo sapiens
tccatcaactgtgaaagctgggg

SEQ ID NO: 4302 - DNA, 23 bp, Homo sapiens
tacgtccaagaaaaaactgcagg

SEQ ID NO: 4303 - DNA, 23 bp, Homo sapiens
agctatacttcacgcagacctgg

SEQ ID NO: 4304 - DNA, 23 bp, Homo sapiens
gatgtcaagtgtgcatgaagagg

SEQ ID NO: 4305 - DNA, 23 bp, Homo sapiens
tgtatgaaaagcctgtagggtgg

SEQ ID NO: 4306 - DNA, 23 bp, Homo sapiens
gccggcttgcttcatgggctagg

SEQ ID NO: 4307 - DNA, 23 bp, Homo sapiens
aggaattcggcgttgaaattggg

SEQ ID NO: 4308 - DNA, 23 bp, Homo sapiens
ctctcagctgctgaagcagacgg

SEQ ID NO: 4309 - DNA, 23 bp, Homo sapiens
gtctccaggaaggtggcgctggg

SEQ ID NO: 4310 - DNA, 23 bp, Homo sapiens
cggagctgttttgtgctgaaagg

SEQ ID NO: 4311 - DNA, 23 bp, Homo sapiens
ggcggcgctagcagatccagcgg

SEQ ID NO: 4312 - DNA, 23 bp, Homo sapiens
gggtgcccgggctttagcagagg

SEQ ID NO: 4313 - DNA, 23 bp, Homo sapiens
cccggagtcatcagtgtgatggg

SEQ ID NO: 4314 - DNA, 23 bp, Homo sapiens
ttcatatggaaaatgctccaagg

SEQ ID NO: 4315 - DNA, 23 bp, Homo sapiens
tctcccaacccagagaacggtgg

SEQ ID NO: 4316 - DNA, 23 bp, Homo sapiens
tgaagatacaaggtcatcatagg

SEQ ID NO: 4317 - DNA, 23 bp, Homo sapiens
cccatacctttaagaatggaagg

SEQ ID NO: 4318 - DNA, 23 bp, Homo sapiens
cattatctgggcctcagtcctgg

SEQ ID NO: 4319 - DNA, 23 bp, Homo sapiens
tatgtccactcctccttttcagg

SEQ ID NO: 4320 - DNA, 23 bp, Homo sapiens
gaccccccccgcgggttatgtgg

SEQ ID NO: 4321 - DNA, 23 bp, Homo sapiens
tgcagcagtaagcctttcaaggg

SEQ ID NO: 4322 - DNA, 23 bp, Homo sapiens
tgatgctcaaggccccttgatgg

SEQ ID NO: 4323 - DNA, 23 bp, Homo sapiens
ggaggggtcggggagaaatcagg

SEQ ID NO: 4324 - DNA, 23 bp, Homo sapiens
aatgttgagctacaaaccagagg

SEQ ID NO: 4325 - DNA, 23 bp, Homo sapiens
ccaccagtgatttctataagagg

SEQ ID NO: 4326 - DNA, 23 bp, Homo sapiens
gaactcacagacaaagtacatgg

SEQ ID NO: 4327 - DNA, 23 bp, Homo sapiens
cttcatgtgtgagtttgacaagg

SEQ ID NO: 4328 - DNA, 23 bp, Homo sapiens
acttcatttgcgaaaaagacagg

SEQ ID NO: 4329 - DNA, 23 bp, Homo sapiens
tgcccgggatgaactctgagggg

SEQ ID NO: 4330 - DNA, 23 bp, Homo sapiens
cttcaagggatgagctatgaagg

SEQ ID NO: 4331 - DNA, 23 bp, Homo sapiens
tgcacgggtttgttcaccgttgg

SEQ ID NO: 4332 - DNA, 23 bp, Homo sapiens
cctgccgctacttcacctgaggg

SEQ ID NO: 4333 - DNA, 23 bp, Homo sapiens
tacatcatcttcagttaggctgg

SEQ ID NO: 4334 - DNA, 23 bp, Homo sapiens
agagactatacaagcacagctgg

SEQ ID NO: 4335 - DNA, 23 bp, Homo sapiens
agatgaagacaaatcactgtagg

SEQ ID NO: 4336 - DNA, 23 bp, Homo sapiens
agagcaactcagttgtaacttgg

SEQ ID NO: 4337 - DNA, 23 bp, Homo sapiens
ctgatgagctccctgggctgagg

SEQ ID NO: 4338 - DNA, 23 bp, Homo sapiens
gaggtgtgagcgcagactgcagg

SEQ ID NO: 4339 - DNA, 23 bp, Homo sapiens
ggccctggctcaaacactgtggg

SEQ ID NO: 4340 - DNA, 23 bp, Homo sapiens
tcagcagaaacactccatgctgg

SEQ ID NO: 4341 - DNA, 23 bp, Homo sapiens
ggtcctgcagttgaaataactgg

SEQ ID NO: 4342 - DNA, 23 bp, Homo sapiens
cagctggctggatcatttactgg

SEQ ID NO: 4343 - DNA, 23 bp, Homo sapiens
catcagctgcggcaagcctaggg

SEQ ID NO: 4344 - DNA, 23 bp, Homo sapiens
agggcccaggcagcgaagcaggg

SEQ ID NO: 4345 - DNA, 23 bp, Homo sapiens
gccacacacggaggctcaggagg

SEQ ID NO: 4346 - DNA, 23 bp, Homo sapiens
agtcctctgcagtttcgctaagg

SEQ ID NO: 4347 - DNA, 23 bp, Homo sapiens
cagggaatggccttaagtcttgg

SEQ ID NO: 4348 - DNA, 23 bp, Homo sapiens
tgacacaacagatatcaatctgg

SEQ ID NO: 4349 - DNA, 23 bp, Homo sapiens
cagtacgctcccagcgcctgagg

SEQ ID NO: 4350 - DNA, 23 bp, Homo sapiens
cttggcatctgtgggataagagg

SEQ ID NO: 4351 - DNA, 23 bp, Homo sapiens
acttctgacagtcacctgcatgg

SEQ ID NO: 4352 - DNA, 23 bp, Homo sapiens
ggtactaaccctcagaagggagg

SEQ ID NO: 4353 - DNA, 23 bp, Homo sapiens
tccaagatggtctttgaaacagg

SEQ ID NO: 4354 - DNA, 23 bp, Homo sapiens
ccaggctgtagtcagtaaactgg

SEQ ID NO: 4355 - DNA, 23 bp, Homo sapiens
ggctcacaagaagatgattcagg

SEQ ID NO: 4356 - DNA, 23 bp, Homo sapiens
caaggattcactgagccatctgg

SEQ ID NO: 4357 - DNA, 23 bp, Homo sapiens
tctccaaaaggttattcacttgg

SEQ ID NO: 4358 - DNA, 23 bp, Homo sapiens
tggatctgcttatcccacgttgg

SEQ ID NO: 4359 - DNA, 23 bp, Homo sapiens
tatccatggattgatgtctcagg

SEQ ID NO: 4360 - DNA, 23 bp, Homo sapiens
cgcgggctctttttctgatgagg

SEQ ID NO: 4361 - DNA, 23 bp, Homo sapiens
ttggtccaagtcgaattgaaagg

SEQ ID NO: 4362 - DNA, 23 bp, Homo sapiens
aagaagatgtccaaagtgaaagg

SEQ ID NO: 4363 - DNA, 23 bp, Homo sapiens
gctgccccagccggccctagtgg

SEQ ID NO: 4364 - DNA, 23 bp, Homo sapiens
agccagactgacggattatgtgg

SEQ ID NO: 4365 - DNA, 23 bp, Homo sapiens
gcagccagagggcatctcactgg

SEQ ID NO: 4366 - DNA, 23 bp, Homo sapiens
cacagccatgcatagatgtgagg

SEQ ID NO: 4367 - DNA, 23 bp, Homo sapiens
aacagtgaggtcttcaccgaagg

SEQ ID NO: 4368 - DNA, 23 bp, Homo sapiens
ccaggttcttcagtctgccaagg

SEQ ID NO: 4369 - DNA, 23 bp, Homo sapiens
catgaggtgcaccagacttgagg

SEQ ID NO: 4370 - DNA, 23 bp, Homo sapiens
atgaagtccatcacacataaagg

SEQ ID NO: 4371 - DNA, 23 bp, Homo sapiens
ggattgtccttgggaatttgtgg

SEQ ID NO: 4372 - DNA, 23 bp, Homo sapiens
ttcagcttttcatgcacagctgg

SEQ ID NO: 4373 - DNA, 23 bp, Homo sapiens
caggagctcaggccaagccctgg

SEQ ID NO: 4374 - DNA, 23 bp, Homo sapiens
tcgcgagtatctccgtttcctgg

SEQ ID NO: 4375 - DNA, 23 bp, Homo sapiens
ggcattgtggccattcattctgg

SEQ ID NO: 4376 - DNA, 23 bp, Homo sapiens
gagtactcatttgcttgcaaagg

SEQ ID NO: 4377 - DNA, 23 bp, Homo sapiens
tatccaggccggatgcagagtgg

SEQ ID NO: 4378 - DNA, 23 bp, Homo sapiens
aagaggcaggcccagcagtaggg

SEQ ID NO: 4379 - DNA, 23 bp, Homo sapiens
cccccatggaggctgtcatgagg

SEQ ID NO: 4380 - DNA, 23 bp, Homo sapiens
tctaaaccagcgtcggtgagagg

SEQ ID NO: 4381 - DNA, 23 bp, Homo sapiens
attagtttaggagaaaggtctgg

SEQ ID NO: 4382 - DNA, 23 bp, Homo sapiens
caaatagagaagtagcttcgtgg

SEQ ID NO: 4383 - DNA, 23 bp, Homo sapiens
aggccctgcggggctctacttgg

SEQ ID NO: 4384 - DNA, 23 bp, Homo sapiens
atggagaacggggatgcgtaggg

SEQ ID NO: 4385 - DNA, 23 bp, Homo sapiens
tggcaaagatagcagcctgaagg

SEQ ID NO: 4386 - DNA, 23 bp, Homo sapiens
gagatcaaaaacttgcggatggg

SEQ ID NO: 4387 - DNA, 23 bp, Homo sapiens
gctggggagctaacagttcttgg

SEQ ID NO: 4388 - DNA, 23 bp, Homo sapiens
gtgcgagctggtggacggcacgg

SEQ ID NO: 4389 - DNA, 23 bp, Homo sapiens
aggcgtggacgaggacgagtggg

SEQ ID NO: 4390 - DNA, 23 bp, Homo sapiens
atgggtgaggttttatttgcagg

SEQ ID NO: 4391 - DNA, 23 bp, Homo sapiens
ggggctggggttactccgtctgg

SEQ ID NO: 4392 - DNA, 23 bp, Homo sapiens
ggcgtcccagtgctctcagctgg

SEQ ID NO: 4393 - DNA, 23 bp, Homo sapiens
gagagttggcacctttgatgtgg

SEQ ID NO: 4394 - DNA, 23 bp, Homo sapiens
aaatactgtccagcttcaaatgg

SEQ ID NO: 4395 - DNA, 23 bp, Homo sapiens
ctctgtgcagctttgaagcctgg

SEQ ID NO: 4396 - DNA, 23 bp, Homo sapiens
tgctgacttcaattatatcctgg

SEQ ID NO: 4397 - DNA, 23 bp, Homo sapiens
ccagttctacatgattcctgagg

SEQ ID NO: 4398 - DNA, 23 bp, Homo sapiens
gcctccataaactgtcaaactgg

SEQ ID NO: 4399 - DNA, 23 bp, Homo sapiens
ggagaattccccttcctagaagg

SEQ ID NO: 4400 - DNA, 23 bp, Homo sapiens
agcagtgactctgctggctttgg

SEQ ID NO: 4401 - DNA, 23 bp, Homo sapiens
gctggctttggcgtatacacagg

SEQ ID NO: 4402 - DNA, 23 bp, Homo sapiens
tggtcctctaagaatcattttgg

SEQ ID NO: 4403 - DNA, 23 bp, Homo sapiens
gtcttagtcttaaggctttctgg

SEQ ID NO: 4404 - DNA, 23 bp, Homo sapiens
aaggaatgcatgagagccctagg

SEQ ID NO: 4405 - DNA, 23 bp, Homo sapiens
aggagtttctgaatctgacttgg

SEQ ID NO: 4406 - DNA, 23 bp, Homo sapiens
aatacgtctgcagcactcagagg

SEQ ID NO: 4407 - DNA, 23 bp, Homo sapiens
ctgccgttgtgttttctttcagg

SEQ ID NO: 4408 - DNA, 23 bp, Homo sapiens
tgtcattcactgctaagttaagg

SEQ ID NO: 4409 - DNA, 23 bp, Homo sapiens
caagaggatgctggacatgaagg

SEQ ID NO: 4410 - DNA, 23 bp, Homo sapiens
aactggtcatttattagcagtgg

SEQ ID NO: 4411 - DNA, 23 bp, Homo sapiens
gggactacgaaaagaacgagtgg

SEQ ID NO: 4412 - DNA, 23 bp, Homo sapiens
gttatccatagcctttagagagg

SEQ ID NO: 4413 - DNA, 23 bp, Homo sapiens
gggactatgagaagaagcagtgg

SEQ ID NO: 4414 - DNA, 23 bp, Homo sapiens
atgcggtttacactttgtcaagg

SEQ ID NO: 4415 - DNA, 23 bp, Homo sapiens
gtgctcagtgtgccagctgctgg

SEQ ID NO: 4416 - DNA, 23 bp, Homo sapiens
tattcatcttcgtagccagttgg

SEQ ID NO: 4417 - DNA, 23 bp, Homo sapiens
gggggcgtccggggcctcagggg

SEQ ID NO: 4418 - DNA, 23 bp, Homo sapiens
tttcccgggaagatctgaactgg

SEQ ID NO: 4419 - DNA, 23 bp, Homo sapiens
attattcgtggcttagacactgg

SEQ ID NO: 4420 - DNA, 23 bp, Homo sapiens
tttgaggagatgaggaaggctgg

SEQ ID NO: 4421 - DNA, 23 bp, Homo sapiens
tgaaggagcggatcagcgcctgg

SEQ ID NO: 4422 - DNA, 23 bp, Homo sapiens
ggcttcatttcccaagaagcagg

SEQ ID NO: 4423 - DNA, 23 bp, Homo sapiens
caggcctcgtttcaggtagacgg

SEQ ID NO: 4424 - DNA, 23 bp, Homo sapiens
tggaaaaacttttgtagctctgg

SEQ ID NO: 4425 - DNA, 23 bp, Homo sapiens
tgggctgcgaagccatgtagagg

SEQ ID NO: 4426 - DNA, 23 bp, Homo sapiens
gagttaccccaaaggaatggagg

SEQ ID NO: 4427 - DNA, 23 bp, Homo sapiens
gcagagttaccccaaaagagtgg

SEQ ID NO: 4428 - DNA, 23 bp, Homo sapiens
gcagttggtgtcttactacaagg

SEQ ID NO: 4429 - DNA, 23 bp, Homo sapiens
tacaggaggccagagtgaagggg

SEQ ID NO: 4430 - DNA, 23 bp, Homo sapiens
gcagttcagaaggaattagatgg

SEQ ID NO: 4431 - DNA, 23 bp, Homo sapiens
attttgtagaacggtgtaagtgg

SEQ ID NO: 4432 - DNA, 23 bp, Homo sapiens
tgtcaaagggtcagctcagtagg

SEQ ID NO: 4433 - DNA, 23 bp, Homo sapiens
ttcttccccagggccctaatagg

SEQ ID NO: 4434 - DNA, 23 bp, Homo sapiens
ttctttaggaagtatgcttgagg

SEQ ID NO: 4435 - DNA, 23 bp, Homo sapiens
gcagagccatcgcctagtagagg

SEQ ID NO: 4436 - DNA, 23 bp, Homo sapiens
attcagggtgtgctccatgatgg

SEQ ID NO: 4437 - DNA, 23 bp, Homo sapiens
ccctcagtcgtgctgctagtagg

SEQ ID NO: 4438 - DNA, 23 bp, Homo sapiens
ctcagggacatttctttagcagg

SEQ ID NO: 4439 - DNA, 23 bp, Homo sapiens
gtggttgtaggattatctcaagg

SEQ ID NO: 4440 - DNA, 23 bp, Homo sapiens
tcagctttctcaactagtacagg

SEQ ID NO: 4441 - DNA, 23 bp, Homo sapiens
aaatagcttggcatgtcattagg

SEQ ID NO: 4442 - DNA, 23 bp, Homo sapiens
ggatgaaacagacactgaagagg

SEQ ID NO: 4443 - DNA, 23 bp, Homo sapiens
aggaagaattgatggaatggtgg

SEQ ID NO: 4444 - DNA, 23 bp, Homo sapiens
gcaaggccagctcctctagctgg

SEQ ID NO: 4445 - DNA, 23 bp, Homo sapiens
tttgctattcttagttccagcgg

SEQ ID NO: 4446 - DNA, 23 bp, Homo sapiens
ggcccgtggctcagctccagcgg

SEQ ID NO: 4447 - DNA, 23 bp, Homo sapiens
tttcattccgctggaactaaagg

SEQ ID NO: 4448 - DNA, 23 bp, Homo sapiens
gcaggatgtgtgcaaataaaagg

SEQ ID NO: 4449 - DNA, 23 bp, Homo sapiens
tgtcttcaattacggcttctagg

SEQ ID NO: 4450 - DNA, 23 bp, Homo sapiens
ttcttgagcatgtcctgcagcgg

SEQ ID NO: 4451 - DNA, 23 bp, Homo sapiens
tccccctctgccacttgacaggg

SEQ ID NO: 4452 - DNA, 23 bp, Homo sapiens
caaggcccaggccacactggggg

SEQ ID NO: 4453 - DNA, 23 bp, Homo sapiens
gaagtgttccgtgatgtgagggg

SEQ ID NO: 4454 - DNA, 23 bp, Homo sapiens
taggctttgttgcagctgagtgg

SEQ ID NO: 4455 - DNA, 23 bp, Homo sapiens
tggcactgtgggtttcaggcagg

SEQ ID NO: 4456 - DNA, 23 bp, Homo sapiens
ctatcgaggctcgggcagcaggg

SEQ ID NO: 4457 - DNA, 23 bp, Homo sapiens
cctccaagggaacctaggcctgg

SEQ ID NO: 4458 - DNA, 23 bp, Homo sapiens
gctgggcactggagctcaggcgg

SEQ ID NO: 4459 - DNA, 23 bp, Homo sapiens
tcactgcttctgttgtttcgtgg

SEQ ID NO: 4460 - DNA, 23 bp, Homo sapiens
agttcatggtgctagtgttctgg

SEQ ID NO: 4461 - DNA, 23 bp, Homo sapiens
aggttcagatgtgcgtgtgcagg

SEQ ID NO: 4462 - DNA, 23 bp, Homo sapiens
gaaaagctgttactctgaagcgg

SEQ ID NO: 4463 - DNA, 23 bp, Homo sapiens
gtccggagggaggcagtcacggg

SEQ ID NO: 4464 - DNA, 23 bp, Homo sapiens
catcttcacggtgtgcagcctgg

SEQ ID NO: 4465 - DNA, 23 bp, Homo sapiens
tgagtctgtaacacatgtgtagg

SEQ ID NO: 4466 - DNA, 23 bp, Homo sapiens
ggcacatccgtggtgtaggtcgg

SEQ ID NO: 4467 - DNA, 23 bp, Homo sapiens
ccagctccagagcagccctgagg

SEQ ID NO: 4468 - DNA, 23 bp, Homo sapiens
cacttagagaagagacatgcagg

SEQ ID NO: 4469 - DNA, 23 bp, Homo sapiens
tctacgccatccaagggactggg

SEQ ID NO: 4470 - DNA, 23 bp, Homo sapiens
aggaatagaagacgatctcatgg

SEQ ID NO: 4471 - DNA, 23 bp, Homo sapiens
tcttactgtttctaggacctagg

SEQ ID NO: 4472 - DNA, 23 bp, Homo sapiens
cactacaggcagtacagtgctgg

SEQ ID NO: 4473 - DNA, 23 bp, Homo sapiens
ggcatccacggggctagaagtgg

SEQ ID NO: 4474 - DNA, 23 bp, Homo sapiens
actggacgcattggattagaagg

SEQ ID NO: 4475 - DNA, 23 bp, Homo sapiens
caggcacagtctcagtgaactgg

SEQ ID NO: 4476 - DNA, 23 bp, Homo sapiens
gggcacttggcctttctcagtgg

SEQ ID NO: 4477 - DNA, 23 bp, Homo sapiens
tgataggaaactaacagacgtgg

SEQ ID NO: 4478 - DNA, 23 bp, Homo sapiens
aacgcttagatcttgcttccagg

SEQ ID NO: 4479 - DNA, 23 bp, Homo sapiens
gatgacgatattcgcgctctcgg

SEQ ID NO: 4480 - DNA, 23 bp, Homo sapiens
accgggatagagaacgggaccgg

SEQ ID NO: 4481 - DNA, 23 bp, Homo sapiens
gctccagtggaattactttttgg

SEQ ID NO: 4482 - DNA, 23 bp, Homo sapiens
ttgtctcaagtatctgaacttgg

SEQ ID NO: 4483 - DNA, 23 bp, Homo sapiens
tgatcttttccaagttcccaagg

SEQ ID NO: 4484 - DNA, 23 bp, Homo sapiens
ttcccaaggcctacagctgaagg

SEQ ID NO: 4485 - DNA, 23 bp, Homo sapiens
tgctggaaggagtcagaagtcgg

SEQ ID NO: 4486 - DNA, 23 bp, Homo sapiens
gcccagaagttaacttttgatgg

SEQ ID NO: 4487 - DNA, 23 bp, Homo sapiens
acatcacatagattgcactctgg

SEQ ID NO: 4488 - DNA, 23 bp, Homo sapiens
aaaggatgggatccttatgttgg

SEQ ID NO: 4489 - DNA, 23 bp, Homo sapiens
aacattcatgcagctcttctggg

SEQ ID NO: 4490 - DNA, 23 bp, Homo sapiens
ggagcggctaaggggacagaagg

SEQ ID NO: 4491 - DNA, 23 bp, Homo sapiens
ggcagaagagacgacagcgtggg

SEQ ID NO: 4492 - DNA, 23 bp, Homo sapiens
tagtacttgagcagccagcgtgg

SEQ ID NO: 4493 - DNA, 23 bp, Homo sapiens
ttcatttgtttgcagagttcggg

SEQ ID NO: 4494 - DNA, 23 bp, Homo sapiens
tcacatgatgctcttatagttgg

SEQ ID NO: 4495 - DNA, 23 bp, Homo sapiens
cagtttgtcttctgatcagctgg

SEQ ID NO: 4496 - DNA, 23 bp, Homo sapiens
gaatttatgtccgagagtgaagg

SEQ ID NO: 4497 - DNA, 23 bp, Homo sapiens
ggtctacgtccgagagtgagtgg

SEQ ID NO: 4498 - DNA, 23 bp, Homo sapiens
aaatcctgctgtggctgataggg

SEQ ID NO: 4499 - DNA, 23 bp, Homo sapiens
ggtcggaaggaccagtctgaggg

SEQ ID NO: 4500 - DNA, 23 bp, Homo sapiens
agtcactcggggctggtcaccgg

SEQ ID NO: 4501 - DNA, 23 bp, Homo sapiens
tacacggctgcgggatgacaggg

SEQ ID NO: 4502 - DNA, 23 bp, Homo sapiens
gggtagacttcataacagagtgg

SEQ ID NO: 4503 - DNA, 23 bp, Homo sapiens
ctcacctggagattctgaactgg

SEQ ID NO: 4504 - DNA, 23 bp, Homo sapiens
ctgtggggatgaggacctgaagg

SEQ ID NO: 4505 - DNA, 23 bp, Homo sapiens
tcctgcacatgttggagtgatgg

SEQ ID NO: 4506 - DNA, 23 bp, Homo sapiens
ccaccaggacgtgtggtcactgg

SEQ ID NO: 4507 - DNA, 23 bp, Homo sapiens
agtcctaggggctcagagcttgg

SEQ ID NO: 4508 - DNA, 23 bp, Homo sapiens
tgcaatggagagactgatttagg

SEQ ID NO: 4509 - DNA, 23 bp, Homo sapiens
accggaggagagactcatctagg

SEQ ID NO: 4510 - DNA, 23 bp, Homo sapiens
tcaagttgccgccggaagagcgg

SEQ ID NO: 4511 - DNA, 23 bp, Homo sapiens
tgcaggagaggggacctagatgg

SEQ ID NO: 4512 - DNA, 23 bp, Homo sapiens
atcttcagtgtctgggatcgtgg

SEQ ID NO: 4513 - DNA, 23 bp, Homo sapiens
aggacacaattagcctggcacgg

SEQ ID NO: 4514 - DNA, 23 bp, Homo sapiens
ccagctgtgctcttctatgctgg

SEQ ID NO: 4515 - DNA, 23 bp, Homo sapiens
atgctgctccggctgctgagagg

SEQ ID NO: 4516 - DNA, 23 bp, Homo sapiens
aatctgatttgtggcagtaaagg

SEQ ID NO: 4517 - DNA, 23 bp, Homo sapiens
agcaaccaagttgttgttcaagg

SEQ ID NO: 4518 - DNA, 23 bp, Homo sapiens
attttgcaggacagatactcagg

SEQ ID NO: 4519 - DNA, 23 bp, Homo sapiens
caccaccatcaaactctcctagg

SEQ ID NO: 4520 - DNA, 23 bp, Homo sapiens
gtgaacaccactttctaaagagg

SEQ ID NO: 4521 - DNA, 23 bp, Homo sapiens
tgtaccacagatgttgtagctgg

SEQ ID NO: 4522 - DNA, 23 bp, Homo sapiens
cgtgcagggctggaggcggcggg

SEQ ID NO: 4523 - DNA, 23 bp, Homo sapiens
gcacagcatcagcagccacgcgg

SEQ ID NO: 4524 - DNA, 23 bp, Homo sapiens
catgcagatgagatgtgagctgg

SEQ ID NO: 4525 - DNA, 23 bp, Homo sapiens
attcaggtctgttctgtgagtgg

SEQ ID NO: 4526 - DNA, 23 bp, Homo sapiens
acgctagagaagtttgtggaggg

SEQ ID NO: 4527 - DNA, 23 bp, Homo sapiens
cagatgctaatagcaattcctgg

SEQ ID NO: 4528 - DNA, 23 bp, Homo sapiens
gctgattacacctttgatgttgg

SEQ ID NO: 4529 - DNA, 23 bp, Homo sapiens
tagtaatacaaaggtcagtctgg

SEQ ID NO: 4530 - DNA, 23 bp, Homo sapiens
taagagaagacgacgccttccgg

SEQ ID NO: 4531 - DNA, 23 bp, Homo sapiens
tcttctggtgtcacgatttttgg

SEQ ID NO: 4532 - DNA, 23 bp, Homo sapiens
cagttcccagaaaggcctgatgg

SEQ ID NO: 4533 - DNA, 23 bp, Homo sapiens
caatccagacagtctgaccgtgg

SEQ ID NO: 4534 - DNA, 23 bp, Homo sapiens
gtgctggagggcttcatcaaggg

SEQ ID NO: 4535 - DNA, 23 bp, Homo sapiens
gggtaagtccggcacattacagg

SEQ ID NO: 4536 - DNA, 23 bp, Homo sapiens
gactctcattgaggaactcaagg

SEQ ID NO: 4537 - DNA, 23 bp, Homo sapiens
gcatatatcagactagcacgggg

SEQ ID NO: 4538 - DNA, 23 bp, Homo sapiens
gggagaacaaatgtctttcaagg

SEQ ID NO: 4539 - DNA, 23 bp, Homo sapiens
gtctgggtgtatcctcagcacgg

SEQ ID NO: 4540 - DNA, 23 bp, Homo sapiens
aggaaactcatggagattattgg

SEQ ID NO: 4541 - DNA, 23 bp, Homo sapiens
atcggggaattctgtttgtctgg

SEQ ID NO: 4542 - DNA, 23 bp, Homo sapiens
cagtccacagcagtctgagctgg

SEQ ID NO: 4543 - DNA, 23 bp, Homo sapiens
gagagaagccagagcagaggtgg

SEQ ID NO: 4544 - DNA, 23 bp, Homo sapiens
gcgaccgaggggtcacacagcgg

SEQ ID NO: 4545 - DNA, 23 bp, Homo sapiens
ttgcctttcttcacactgtttgg

SEQ ID NO: 4546 - DNA, 23 bp, Homo sapiens
acctggtttacttgaaagtgtgg

SEQ ID NO: 4547 - DNA, 23 bp, Homo sapiens
gagccgctgtagcctagggctgg

SEQ ID NO: 4548 - DNA, 23 bp, Homo sapiens
ggtgtgaacattggcgatgtggg

SEQ ID NO: 4549 - DNA, 23 bp, Homo sapiens
tctgcacctcgagataacgtagg

SEQ ID NO: 4550 - DNA, 23 bp, Homo sapiens
tggtacttttagtagagacaggg

SEQ ID NO: 4551 - DNA, 23 bp, Homo sapiens
ctcagtgtcacacagacaagtgg

SEQ ID NO: 4552 - DNA, 23 bp, Homo sapiens
tgacaaacgtagagatatcgagg

SEQ ID NO: 4553 - DNA, 23 bp, Homo sapiens
gttactcaaggaaaagtgcaagg

SEQ ID NO: 4554 - DNA, 23 bp, Homo sapiens
aatgctgtttgaacaattgcagg

SEQ ID NO: 4555 - DNA, 23 bp, Homo sapiens
acagaatcctccaggaggaaagg

SEQ ID NO: 4556 - DNA, 23 bp, Homo sapiens
ccttccggatctttgctgtcagg

SEQ ID NO: 4557 - DNA, 23 bp, Homo sapiens
tactcagctgaagtcctcatcgg

SEQ ID NO: 4558 - DNA, 23 bp, Homo sapiens
tcagtatcggctctgattggagg

SEQ ID NO: 4559 - DNA, 23 bp, Homo sapiens
agcaatcactcgttttcatctgg

SEQ ID NO: 4560 - DNA, 23 bp, Homo sapiens
ctgagcccctacagcttatctgg

SEQ ID NO: 4561 - DNA, 23 bp, Homo sapiens
gctcctacgtggcgttgtgatgg

SEQ ID NO: 4562 - DNA, 23 bp, Homo sapiens
aacactaacactttccatccagg

SEQ ID NO: 4563 - DNA, 23 bp, Homo sapiens
ttatggccggaagactgttcagg

SEQ ID NO: 4564 - DNA, 23 bp, Homo sapiens
cgcgcatccacgttcaaccgagg

SEQ ID NO: 4565 - DNA, 23 bp, Homo sapiens
gaaaaatcaaagtgctcgagtgg

SEQ ID NO: 4566 - DNA, 23 bp, Homo sapiens
ctctcatcgacgtcctcatctgg

SEQ ID NO: 4567 - DNA, 23 bp, Homo sapiens
gagtcggggaagtcatggcttgg

SEQ ID NO: 4568 - DNA, 23 bp, Homo sapiens
ccagcaggagctcatttctctgg

SEQ ID NO: 4569 - DNA, 23 bp, Homo sapiens
gctgggagcttcagtccctttgg

SEQ ID NO: 4570 - DNA, 23 bp, Homo sapiens
atcctgtcccgagactgatgcgg

SEQ ID NO: 4571 - DNA, 23 bp, Homo sapiens
ttgctctttcaagcaatttctgg

SEQ ID NO: 4572 - DNA, 23 bp, Homo sapiens
aaaccccagctgtggccctgagg

SEQ ID NO: 4573 - DNA, 23 bp, Homo sapiens
ataactgaaggcaaagtccaagg

SEQ ID NO: 4574 - DNA, 23 bp, Homo sapiens
tgcgagcccagctgctgagcagg

SEQ ID NO: 4575 - DNA, 23 bp, Homo sapiens
gagcactacacaatactctctgg

SEQ ID NO: 4576 - DNA, 23 bp, Homo sapiens
tttggttgctgtgggctagctgg

SEQ ID NO: 4577 - DNA, 23 bp, Homo sapiens
cggatggaccgcctgtgagcggg

SEQ ID NO: 4578 - DNA, 23 bp, Homo sapiens
tggtgatgaggtgccctcattgg

SEQ ID NO: 4579 - DNA, 23 bp, Homo sapiens
tcgaaacgtctcttcaacagagg

SEQ ID NO: 4580 - DNA, 23 bp, Homo sapiens
ggaagtttcagatcttgtagagg

SEQ ID NO: 4581 - DNA, 23 bp, Homo sapiens
gtgctctgtctctggactttagg

SEQ ID NO: 4582 - DNA, 23 bp, Homo sapiens
aaccccagagctgccgagcaagg

SEQ ID NO: 4583 - DNA, 23 bp, Homo sapiens
aagaaagggcatctatttcttgg

SEQ ID NO: 4584 - DNA, 23 bp, Homo sapiens
agcttttaatcagctactgttgg

SEQ ID NO: 4585 - DNA, 23 bp, Homo sapiens
ggggccgtggagcctagtgctgg

SEQ ID NO: 4586 - DNA, 23 bp, Homo sapiens
cgcaggatccagcagtgaacagg

SEQ ID NO: 4587 - DNA, 23 bp, Homo sapiens
gagtgaggtgtggactcacttgg

SEQ ID NO: 4588 - DNA, 23 bp, Homo sapiens
atggtggggagggcactagttgg

SEQ ID NO: 4589 - DNA, 23 bp, Homo sapiens
ccgcttccccagcagctgaaagg

SEQ ID NO: 4590 - DNA, 23 bp, Homo sapiens
tgttcaggtatataggaccatgg

SEQ ID NO: 4591 - DNA, 23 bp, Homo sapiens
gggaaaagtttcaaagcacgtgg

SEQ ID NO: 4592 - DNA, 23 bp, Homo sapiens
gggagaagaaacacagaaatggg

SEQ ID NO: 4593 - DNA, 23 bp, Homo sapiens
aggcacagcttagtacaaatcgg

SEQ ID NO: 4594 - DNA, 23 bp, Homo sapiens
tggctctcttagacgagtcatgg

SEQ ID NO: 4595 - DNA, 23 bp, Homo sapiens
aggctctttgcggagagtggtgg

SEQ ID NO: 4596 - DNA, 23 bp, Homo sapiens
atgccagagtgggctctctgagg

SEQ ID NO: 4597 - DNA, 23 bp, Homo sapiens
tcaatcggttccaggctcagagg

SEQ ID NO: 4598 - DNA, 23 bp, Homo sapiens
agtcttacagactttaaagccgg

SEQ ID NO: 4599 - DNA, 23 bp, Homo sapiens
catgtcattactccacaatgcgg

SEQ ID NO: 4600 - DNA, 23 bp, Homo sapiens
ctgcacttgactcttcaacttgg

SEQ ID NO: 4601 - DNA, 23 bp, Homo sapiens
atctatgattcctggtcatctgg

SEQ ID NO: 4602 - DNA, 23 bp, Homo sapiens
attcatggtagtggggctactgg

SEQ ID NO: 4603 - DNA, 23 bp, Homo sapiens
atttttctgaacagcttccatgg

SEQ ID NO: 4604 - DNA, 23 bp, Homo sapiens
agtttgtggactctaagtcaggg

SEQ ID NO: 4605 - DNA, 23 bp, Homo sapiens
gcaagacagagaaggctcacagg

SEQ ID NO: 4606 - DNA, 23 bp, Homo sapiens
aaggaagttccaggaacaaaagg

SEQ ID NO: 4607 - DNA, 23 bp, Homo sapiens
tggccaggtcgtgggctcctagg

SEQ ID NO: 4608 - DNA, 23 bp, Homo sapiens
gaaagaaagatccgtcaagctgg

SEQ ID NO: 4609 - DNA, 23 bp, Homo sapiens
agtttaaagcagtgtcacactgg

SEQ ID NO: 4610 - DNA, 23 bp, Homo sapiens
ggtggaactgccagtgtagaggg

SEQ ID NO: 4611 - DNA, 23 bp, Homo sapiens
aacaactatcagttctgctgagg

SEQ ID NO: 4612 - DNA, 23 bp, Homo sapiens
catctggccggtctcactcctgg

SEQ ID NO: 4613 - DNA, 23 bp, Homo sapiens
tctccgcctccgcgacacggggg

SEQ ID NO: 4614 - DNA, 23 bp, Homo sapiens
cggggtcttctccaaggttgggg

SEQ ID NO: 4615 - DNA, 23 bp, Homo sapiens
gtctcaggtaatttccttcacgg

SEQ ID NO: 4616 - DNA, 23 bp, Homo sapiens
ttcagtttgtctttgatctgtgg

SEQ ID NO: 4617 - DNA, 23 bp, Homo sapiens
gggtctcaacacacctccccagg

SEQ ID NO: 4618 - DNA, 23 bp, Homo sapiens
gggagggcttggctcagggctgg

SEQ ID NO: 4619 - DNA, 23 bp, Homo sapiens
gaggcgctggggagcttctaggg

SEQ ID NO: 4620 - DNA, 23 bp, Homo sapiens
aaacaagcacaaaaggccattgg

SEQ ID NO: 4621 - DNA, 23 bp, Homo sapiens
tcttctgtttctgtttgcgaagg

SEQ ID NO: 4622 - DNA, 23 bp, Homo sapiens
aggacaaacagtgaagctgttgg

SEQ ID NO: 4623 - DNA, 23 bp, Homo sapiens
cgttcagatttcctgaccattgg

SEQ ID NO: 4624 - DNA, 23 bp, Homo sapiens
ttttggcgagattttggctttgg

SEQ ID NO: 4625 - DNA, 23 bp, Homo sapiens
ggagggcagctgtggcttctagg

SEQ ID NO: 4626 - DNA, 23 bp, Homo sapiens
tggaaccccactggcttagaggg

SEQ ID NO: 4627 - DNA, 23 bp, Homo sapiens
agagggtagctgtggcttctagg

SEQ ID NO: 4628 - DNA, 23 bp, Homo sapiens
agggcagctgtggcttctagggg

SEQ ID NO: 4629 - DNA, 23 bp, Homo sapiens
aggcggaggccagccgtcacagg

SEQ ID NO: 4630 - DNA, 23 bp, Homo sapiens
tctgaacacagtctgtacagtgg

SEQ ID NO: 4631 - DNA, 23 bp, Homo sapiens
agacatcatggccagcgaggcgg

SEQ ID NO: 4632 - DNA, 23 bp, Homo sapiens
gtttgcacaatggtataacgagg

SEQ ID NO: 4633 - DNA, 23 bp, Homo sapiens
aaaataacgtcatgctacagtgg

SEQ ID NO: 4634 - DNA, 23 bp, Homo sapiens
acactaatggggttatgaactgg

SEQ ID NO: 4635 - DNA, 23 bp, Homo sapiens
ccttggtgtttttatgccgtagg

SEQ ID NO: 4636 - DNA, 23 bp, Homo sapiens
cagcaggcccaaacccccacagg

SEQ ID NO: 4637 - DNA, 23 bp, Homo sapiens
tttgtcagtttgcttgcctgtgg

SEQ ID NO: 4638 - DNA, 23 bp, Homo sapiens
tttcagtttgcttgcctgtctgg

SEQ ID NO: 4639 - DNA, 23 bp, Homo sapiens
gcaataaggagagttctcatcgg

SEQ ID NO: 4640 - DNA, 23 bp, Homo sapiens
agacgagcagctacttgccgtgg

SEQ ID NO: 4641 - DNA, 23 bp, Homo sapiens
tttgaccatctcgggaagtgagg

SEQ ID NO: 4642 - DNA, 23 bp, Homo sapiens
tgagctttgtgaccagtgccagg

SEQ ID NO: 4643 - DNA, 23 bp, Homo sapiens
tgggaggcactggtcacttgtgg

SEQ ID NO: 4644 - DNA, 23 bp, Homo sapiens
agcgcctgcagaggtggaggtgg

SEQ ID NO: 4645 - DNA, 23 bp, Homo sapiens
tctgtgtccagagtcatttgtgg

SEQ ID NO: 4646 - DNA, 23 bp, Homo sapiens
ccgctggcgctcagcagtaacgg

SEQ ID NO: 4647 - DNA, 23 bp, Homo sapiens
tgtgctttccagtggtctcacgg

SEQ ID NO: 4648 - DNA, 23 bp, Homo sapiens
atgcctgttccagctgccactgg

SEQ ID NO: 4649 - DNA, 23 bp, Homo sapiens
aatcagcgaatcgtcttgactgg

SEQ ID NO: 4650 - DNA, 23 bp, Homo sapiens
aatggccagtactgggtgtgagg

SEQ ID NO: 4651 - DNA, 23 bp, Homo sapiens
caaaggtgaccaggctgacttgg

SEQ ID NO: 4652 - DNA, 23 bp, Homo sapiens
tgactcctcctctttcaggcagg

SEQ ID NO: 4653 - DNA, 23 bp, Homo sapiens
cagggcctgtcgactgcacatgg

SEQ ID NO: 4654 - DNA, 23 bp, Homo sapiens
agacatcctggtcctcacaccgg

SEQ ID NO: 4655 - DNA, 23 bp, Homo sapiens
actccctctggcagtgtgacagg

SEQ ID NO: 4656 - DNA, 23 bp, Homo sapiens
aacagggactgtctcaaccacgg

SEQ ID NO: 4657 - DNA, 23 bp, Homo sapiens
gccttggtccactctgagtgagg

SEQ ID NO: 4658 - DNA, 23 bp, Homo sapiens
ttggtttgggggtctgcctgagg

SEQ ID NO: 4659 - DNA, 23 bp, Homo sapiens
gttcagggtttacatcttactgg

SEQ ID NO: 4660 - DNA, 23 bp, Homo sapiens
tggaggccttacacaacaagtgg

SEQ ID NO: 4661 - DNA, 23 bp, Homo sapiens
tccaggtgtcaagaatcctaggg

SEQ ID NO: 4662 - DNA, 23 bp, Homo sapiens
caaaagctgcagcagtgactagg

SEQ ID NO: 4663 - DNA, 23 bp, Homo sapiens
tccaggtgtcaagaagcctaggg

SEQ ID NO: 4664 - DNA, 23 bp, Homo sapiens
ccacctgtcaggacgcctagggg

SEQ ID NO: 4665 - DNA, 23 bp, Homo sapiens
ccaggtgtcaagaagcctagggg

SEQ ID NO: 4666 - DNA, 23 bp, Homo sapiens
acaagtgccggaaagtctagggg

SEQ ID NO: 4667 - DNA, 23 bp, Homo sapiens
tctgcacacagttgtgctttagg

SEQ ID NO: 4668 - DNA, 23 bp, Homo sapiens
gaggcgggggtcagtgacaacgg

SEQ ID NO: 4669 - DNA, 23 bp, Homo sapiens
gaatggtgaattcactgtgatgg

SEQ ID NO: 4670 - DNA, 23 bp, Homo sapiens
aagccattccgagggacaaaggg

SEQ ID NO: 4671 - DNA, 23 bp, Homo sapiens
tgtgagtgggtttcactcagtgg

SEQ ID NO: 4672 - DNA, 23 bp, Homo sapiens
aacaaggatgacgagctgacggg

SEQ ID NO: 4673 - DNA, 23 bp, Homo sapiens
ccaaagtcaggatcagaaatagg

SEQ ID NO: 4674 - DNA, 23 bp, Homo sapiens
ggagagggtggctcagtcagtgg

SEQ ID NO: 4675 - DNA, 23 bp, Homo sapiens
atccactggagcaccttgatagg

SEQ ID NO: 4676 - DNA, 23 bp, Homo sapiens
atccactggagcgtcttgaaagg

SEQ ID NO: 4677 - DNA, 23 bp, Homo sapiens
cagcagaagcggattcggtaggg

SEQ ID NO: 4678 - DNA, 23 bp, Homo sapiens
gaaactgtacattgaagcagagg

SEQ ID NO: 4679 - DNA, 23 bp, Homo sapiens
taaatcctccttgtcctaattgg

SEQ ID NO: 4680 - DNA, 23 bp, Homo sapiens
tgggcagaaacctcagatgaggg

SEQ ID NO: 4681 - DNA, 23 bp, Homo sapiens
tgcaaggacctactgcagtcagg

SEQ ID NO: 4682 - DNA, 23 bp, Homo sapiens
agagaaggatgcagaaaacaagg

SEQ ID NO: 4683 - DNA, 23 bp, Homo sapiens
agagaaggatgtggaaaacaagg

SEQ ID NO: 4684 - DNA, 23 bp, Homo sapiens
gacggcccaaaagggaacgtcgg

SEQ ID NO: 4685 - DNA, 23 bp, Homo sapiens
tgtcattacgatttatgcactgg

SEQ ID NO: 4686 - DNA, 23 bp, Homo sapiens
tctggtcagaggagataggaagg

SEQ ID NO: 4687 - DNA, 23 bp, Homo sapiens
acatcctgtacgcttttaggtgg

SEQ ID NO: 4688 - DNA, 23 bp, Homo sapiens
ctcagcctccctcagggcagagg

SEQ ID NO: 4689 - DNA, 23 bp, Homo sapiens
cagtcagtcggctaaatgtgagg

SEQ ID NO: 4690 - DNA, 23 bp, Homo sapiens
ctcaggctccctcagggcagagg

SEQ ID NO: 4691 - DNA, 23 bp, Homo sapiens
ccccagcccccacattctgaagg

SEQ ID NO: 4692 - DNA, 23 bp, Homo sapiens
accccaaccccgcattctgaagg

SEQ ID NO: 4693 - DNA, 23 bp, Homo sapiens
accccaaccccacattctgaagg

SEQ ID NO: 4694 - DNA, 23 bp, Homo sapiens
gccagtgaccagttgtagcccgg

SEQ ID NO: 4695 - DNA, 23 bp, Homo sapiens
cattctctgctattgctcgttgg

SEQ ID NO: 4696 - DNA, 23 bp, Homo sapiens
gttcatctctgtaacagctttgg

SEQ ID NO: 4697 - DNA, 23 bp, Homo sapiens
atccttgcagttcagttaacagg

SEQ ID NO: 4698 - DNA, 23 bp, Homo sapiens
gcacaaggctccgccatcaccgg

SEQ ID NO: 4699 - DNA, 23 bp, Homo sapiens
gaggtcaggagtgagagacatgg

SEQ ID NO: 4700 - DNA, 23 bp, Homo sapiens
aacacgatggataagtgagaggg

SEQ ID NO: 4701 - DNA, 23 bp, Homo sapiens
gagggagtaggcgcgtcacatgg

SEQ ID NO: 4702 - DNA, 23 bp, Homo sapiens
gctacagggacctctctgcaggg

SEQ ID NO: 4703 - DNA, 23 bp, Homo sapiens
gcttcatggcatcttagtagagg

SEQ ID NO: 4704 - DNA, 23 bp, Homo sapiens
tggcaaaggcttttcccgctggg

SEQ ID NO: 4705 - DNA, 23 bp, Homo sapiens
tgtcaggtgataaatgtttgtgg

SEQ ID NO: 4706 - DNA, 23 bp, Homo sapiens
accttcaccaacatcggctctgg

SEQ ID NO: 4707 - DNA, 23 bp, Homo sapiens
caagaggaagctgaatgaagagg

SEQ ID NO: 4708 - DNA, 23 bp, Homo sapiens
ccgctgcccgcgctcacatgagg

SEQ ID NO: 4709 - DNA, 23 bp, Homo sapiens
cttcattcagcttcctcttgtgg

SEQ ID NO: 4710 - DNA, 23 bp, Homo sapiens
ccacggccagggagctagtgagg

SEQ ID NO: 4711 - DNA, 23 bp, Homo sapiens
ttggaagcagggcaggctaaggg

SEQ ID NO: 4712 - DNA, 23 bp, Homo sapiens
tgctgcacagactctgcaatagg

SEQ ID NO: 4713 - DNA, 23 bp, Homo sapiens
agtctttgtacttaatctggggg

SEQ ID NO: 4714 - DNA, 23 bp, Homo sapiens
ccagctgctgcccgggggctcgg

SEQ ID NO: 4715 - DNA, 23 bp, Homo sapiens
caggaagatgtacggagacatgg

SEQ ID NO: 4716 - DNA, 23 bp, Homo sapiens
tactagctgtgacttccacttgg

SEQ ID NO: 4717 - DNA, 23 bp, Homo sapiens
aaggagatgcttctactggatgg

SEQ ID NO: 4718 - DNA, 23 bp, Homo sapiens
gctgtcaggctgtcagtttctgg

SEQ ID NO: 4719 - DNA, 23 bp, Homo sapiens
ttttcacattctggctctgttgg

SEQ ID NO: 4720 - DNA, 23 bp, Homo sapiens
cctcagcgagttcaaagctatgg

SEQ ID NO: 4721 - DNA, 23 bp, Homo sapiens
ggctgcctggatcagggacatgg

SEQ ID NO: 4722 - DNA, 23 bp, Homo sapiens
ttaaaacctatcgtcctagaagg

SEQ ID NO: 4723 - DNA, 23 bp, Homo sapiens
aattcactcatgacttgcaatgg

SEQ ID NO: 4724 - DNA, 23 bp, Homo sapiens
tggaggaatgcattattttctgg

SEQ ID NO: 4725 - DNA, 23 bp, Homo sapiens
atgggtctcagttacaaataagg

SEQ ID NO: 4726 - DNA, 23 bp, Homo sapiens
ttggactaagagagccatcatgg

SEQ ID NO: 4727 - DNA, 23 bp, Homo sapiens
ttacaggtcagtatcaaaccagg

SEQ ID NO: 4728 - DNA, 23 bp, Homo sapiens
gcctgtctcatcttctgaagagg

SEQ ID NO: 4729 - DNA, 23 bp, Homo sapiens
gcttgctggagaacttctagagg

SEQ ID NO: 4730 - DNA, 23 bp, Homo sapiens
gtgctaaatcttctgcatcaagg

SEQ ID NO: 4731 - DNA, 23 bp, Homo sapiens
ttggttttggatgatgagggggg

SEQ ID NO: 4732 - DNA, 23 bp, Homo sapiens
tcccccgactcctgggtgtgagg

SEQ ID NO: 4733 - DNA, 23 bp, Homo sapiens
gtttctgcaagcagcttgaaggg

SEQ ID NO: 4734 - DNA, 23 bp, Homo sapiens
tccctgggtgctagttcagctgg

SEQ ID NO: 4735 - DNA, 23 bp, Homo sapiens
agttcggtgatttcagagtcagg

SEQ ID NO: 4736 - DNA, 23 bp, Homo sapiens
agagccaaggatagctgagttgg

SEQ ID NO: 4737 - DNA, 23 bp, Homo sapiens
tgggtcagatgatagtgactagg

SEQ ID NO: 4738 - DNA, 23 bp, Homo sapiens
gagggagccgcgggctcagttgg

SEQ ID NO: 4739 - DNA, 23 bp, Homo sapiens
tgtgttccatgggtttactgagg

SEQ ID NO: 4740 - DNA, 23 bp, Homo sapiens
gcaggagctgcgggctcagttgg

SEQ ID NO: 4741 - DNA, 23 bp, Homo sapiens
gggtgtccgcctacatcgactgg

SEQ ID NO: 4742 - DNA, 23 bp, Homo sapiens
cctgtggtgagctcagttgtagg

SEQ ID NO: 4743 - DNA, 23 bp, Homo sapiens
ggttgctgtggtcatcagtatgg

SEQ ID NO: 4744 - DNA, 23 bp, Homo sapiens
tccacgcaccgatcagtactggg

SEQ ID NO: 4745 - DNA, 23 bp, Homo sapiens
gaaggcataccctacaatttagg

SEQ ID NO: 4746 - DNA, 23 bp, Homo sapiens
gccacatctgaggaacaaactgg

SEQ ID NO: 4747 - DNA, 23 bp, Homo sapiens
ttagccccaacgtctgttcatgg

SEQ ID NO: 4748 - DNA, 23 bp, Homo sapiens
gcggacgccttgggaactagagg

SEQ ID NO: 4749 - DNA, 23 bp, Homo sapiens
atattcaaggtctgtcagacagg

SEQ ID NO: 4750 - DNA, 23 bp, Homo sapiens
gccccagcagtcccctaaggagg

SEQ ID NO: 4751 - DNA, 23 bp, Homo sapiens
tcggcggtggtggactgaagagg

SEQ ID NO: 4752 - DNA, 23 bp, Homo sapiens
cgagaagaagagtcagtcacagg

SEQ ID NO: 4753 - DNA, 23 bp, Homo sapiens
gctgccacggctcacaccagagg

SEQ ID NO: 4754 - DNA, 23 bp, Homo sapiens
ggctggctggagtcacatcttgg

SEQ ID NO: 4755 - DNA, 23 bp, Homo sapiens
agctaccccactgtgtgagctgg

SEQ ID NO: 4756 - DNA, 23 bp, Homo sapiens
ggttatgcccatgtcaaaatggg

SEQ ID NO: 4757 - DNA, 23 bp, Homo sapiens
cctcttacccagaaatctagagg

SEQ ID NO: 4758 - DNA, 23 bp, Homo sapiens
ccatccatcagctcacacattgg

SEQ ID NO: 4759 - DNA, 23 bp, Homo sapiens
ggggccaggtgggttcagggagg

SEQ ID NO: 4760 - DNA, 23 bp, Homo sapiens
tttggggaccccatcgtttaagg

SEQ ID NO: 4761 - DNA, 23 bp, Homo sapiens
ggagcaaaaacacgcttcacggg

SEQ ID NO: 4762 - DNA, 23 bp, Homo sapiens
tatgtggagctgcggcagtaggg

SEQ ID NO: 4763 - DNA, 23 bp, Homo sapiens
tgtaggcaggcctatttgttagg

SEQ ID NO: 4764 - DNA, 23 bp, Homo sapiens
ccctcctagggactagctgctgg

SEQ ID NO: 4765 - DNA, 23 bp, Homo sapiens
ggaggcccgaagtcgctagaagg

SEQ ID NO: 4766 - DNA, 23 bp, Homo sapiens
cacgtcctcacgctcagctctgg

SEQ ID NO: 4767 - DNA, 23 bp, Homo sapiens
gatccgggactgtctgattgagg

SEQ ID NO: 4768 - DNA, 23 bp, Homo sapiens
cgactacgcgttggtgtgagggg

SEQ ID NO: 4769 - DNA, 23 bp, Homo sapiens
tagcatgccttcctctacatggg

SEQ ID NO: 4770 - DNA, 23 bp, Homo sapiens
gaccatgcccttgcttaggaggg

SEQ ID NO: 4771 - DNA, 23 bp, Homo sapiens
gtgtcttggcaggaaagagatgg

SEQ ID NO: 4772 - DNA, 23 bp, Homo sapiens
ttaacttgggacagctaagtggg

SEQ ID NO: 4773 - DNA, 23 bp, Homo sapiens
gtggaggaaggcctgcgagaagg

SEQ ID NO: 4774 - DNA, 23 bp, Homo sapiens
gagtccggcgagtgcctcaatgg

SEQ ID NO: 4775 - DNA, 23 bp, Homo sapiens
aaaggacacctacagttacttgg

SEQ ID NO: 4776 - DNA, 23 bp, Homo sapiens
tgtattcatctgccgacgcctgg

SEQ ID NO: 4777 - DNA, 23 bp, Homo sapiens
gtgtatactttgcgatcctcagg

SEQ ID NO: 4778 - DNA, 23 bp, Homo sapiens
agatgcgtcaggccacgtagtgg

SEQ ID NO: 4779 - DNA, 23 bp, Homo sapiens
tttaattgaccgggactacatgg

SEQ ID NO: 4780 - DNA, 23 bp, Homo sapiens
actacgaatactaagaacccagg

SEQ ID NO: 4781 - DNA, 23 bp, Homo sapiens
gaccccaagtctagggctaccgg

SEQ ID NO: 4782 - DNA, 23 bp, Homo sapiens
gatgaggcctatgactgaggggg

SEQ ID NO: 4783 - DNA, 23 bp, Homo sapiens
ggaacagggctcatcatggcagg

SEQ ID NO: 4784 - DNA, 23 bp, Homo sapiens
cagagaggtctggctacaccagg

SEQ ID NO: 4785 - DNA, 23 bp, Homo sapiens
gggctgcggctggtgacttgtgg

SEQ ID NO: 4786 - DNA, 23 bp, Homo sapiens
tatcgaatgggagttctgagggg

SEQ ID NO: 4787 - DNA, 23 bp, Homo sapiens
ccctggagtgggagttctgaagg

SEQ ID NO: 4788 - DNA, 23 bp, Homo sapiens
gttaatagttctgcagcttctgg

SEQ ID NO: 4789 - DNA, 23 bp, Homo sapiens
gtcttcaagaactgtgcaaaagg

SEQ ID NO: 4790 - DNA, 23 bp, Homo sapiens
ctggagacttttctcttcgccgg

SEQ ID NO: 4791 - DNA, 23 bp, Homo sapiens
acagagaacttcggtagctctgg

SEQ ID NO: 4792 - DNA, 23 bp, Homo sapiens
gtcacatgtacttcagtttgagg

SEQ ID NO: 4793 - DNA, 23 bp, Homo sapiens
tcataaaaaaacaagcagccagg

SEQ ID NO: 4794 - DNA, 23 bp, Homo sapiens
tccagtgaataaaagaaggaggg

SEQ ID NO: 4795 - DNA, 23 bp, Homo sapiens
tgctatttgagatctgcagttgg

SEQ ID NO: 4796 - DNA, 23 bp, Homo sapiens
tgagccctatgactttactctgg

SEQ ID NO: 4797 - DNA, 23 bp, Homo sapiens
cactgcagtttgctcagtggtgg

SEQ ID NO: 4798 - DNA, 23 bp, Homo sapiens
agatttggatcctacaaagaagg

SEQ ID NO: 4799 - DNA, 23 bp, Homo sapiens
acaggccagaggagttcacacgg

SEQ ID NO: 4800 - DNA, 23 bp, Homo sapiens
tgcattgctccttctctgaaggg

SEQ ID NO: 4801 - DNA, 23 bp, Homo sapiens
ttccagcacagagcaaggatggg

SEQ ID NO: 4802 - DNA, 23 bp, Homo sapiens
tccactgccagaagctacatcgg

SEQ ID NO: 4803 - DNA, 23 bp, Homo sapiens
aagtacccttacaagactgatgg

SEQ ID NO: 4804 - DNA, 23 bp, Homo sapiens
ttaggggcagctaccttagcagg

SEQ ID NO: 4805 - DNA, 23 bp, Homo sapiens
cctcctcccttctggtcagttgg

SEQ ID NO: 4806 - DNA, 23 bp, Homo sapiens
tgaaagcagttagcaaggaaagg

SEQ ID NO: 4807 - DNA, 23 bp, Homo sapiens
atcccaaatcgaagcaagcaagg

SEQ ID NO: 4808 - DNA, 23 bp, Homo sapiens
tttttcagatgctcttttccagg

SEQ ID NO: 4809 - DNA, 23 bp, Homo sapiens
cctctcctggggatgtgtaatgg

SEQ ID NO: 4810 - DNA, 23 bp, Homo sapiens
aaagtggattcaggagtacctgg

SEQ ID NO: 4811 - DNA, 23 bp, Homo sapiens
acttgtttaaagctttctccagg

SEQ ID NO: 4812 - DNA, 23 bp, Homo sapiens
agagaaaggctgcccagaaaagg

SEQ ID NO: 4813 - DNA, 23 bp, Homo sapiens
gccttcactaggctttgcccagg

SEQ ID NO: 4814 - DNA, 23 bp, Homo sapiens
tttctcttaaacactggaactgg

SEQ ID NO: 4815 - DNA, 23 bp, Homo sapiens
acgcctggaacgagaagcgcagg

SEQ ID NO: 4816 - DNA, 23 bp, Homo sapiens
ttggctcaggtattagagtcagg

SEQ ID NO: 4817 - DNA, 23 bp, Homo sapiens
ggcgctcagagctcctacaaagg

SEQ ID NO: 4818 - DNA, 23 bp, Homo sapiens
cctccttccttctggtcagttgg

SEQ ID NO: 4819 - DNA, 23 bp, Homo sapiens
cttacttctctcctgtcagttgg

SEQ ID NO: 4820 - DNA, 23 bp, Homo sapiens
ttctttagaaaaggggcttctgg

SEQ ID NO: 4821 - DNA, 23 bp, Homo sapiens
ttgtggagaagtttttgaagagg

SEQ ID NO: 4822 - DNA, 23 bp, Homo sapiens
cccagattcagcagatgtgaagg

SEQ ID NO: 4823 - DNA, 23 bp, Homo sapiens
ccttcatcgatggttttcagagg

SEQ ID NO: 4824 - DNA, 23 bp, Homo sapiens
caggaggtcttagagagtagtgg

SEQ ID NO: 4825 - DNA, 23 bp, Homo sapiens
gcctcctactcgggcttgtgagg

SEQ ID NO: 4826 - DNA, 23 bp, Homo sapiens
tcttttacatctgtgttagctgg

SEQ ID NO: 4827 - DNA, 23 bp, Homo sapiens
cacctctctcaccacgttctagg

SEQ ID NO: 4828 - DNA, 23 bp, Homo sapiens
accctggcaaggcctataactgg

SEQ ID NO: 4829 - DNA, 23 bp, Homo sapiens
agcaatgtaaatccatagagagg

SEQ ID NO: 4830 - DNA, 23 bp, Homo sapiens
ggtgttatctcagcatacacagg

SEQ ID NO: 4831 - DNA, 23 bp, Homo sapiens
tttgcaatctgggtaacgatagg

SEQ ID NO: 4832 - DNA, 23 bp, Homo sapiens
acacctgacaggaaggcctgagg

SEQ ID NO: 4833 - DNA, 23 bp, Homo sapiens
gagacaaacacctgacaggaagg

SEQ ID NO: 4834 - DNA, 23 bp, Homo sapiens
catacctaggaaaggaggcaagg

SEQ ID NO: 4835 - DNA, 23 bp, Homo sapiens
tgtcacacttcatgccccaaagg

SEQ ID NO: 4836 - DNA, 23 bp, Homo sapiens
tttggtcgaggagtgatagcggg

SEQ ID NO: 4837 - DNA, 23 bp, Homo sapiens
gttcctcactgacaagttccagg

SEQ ID NO: 4838 - DNA, 23 bp, Homo sapiens
ctagagacatcacagaactgagg

SEQ ID NO: 4839 - DNA, 23 bp, Homo sapiens
gacaaccagttcaaataaccagg

SEQ ID NO: 4840 - DNA, 23 bp, Homo sapiens
agtgcatatcgtcggtatcttgg

SEQ ID NO: 4841 - DNA, 23 bp, Homo sapiens
cacaatgtcaaaagatggagtgg

SEQ ID NO: 4842 - DNA, 23 bp, Homo sapiens
gcttggtggttttattgagttgg

SEQ ID NO: 4843 - DNA, 23 bp, Homo sapiens
tgttgagctcctaatcatttagg

SEQ ID NO: 4844 - DNA, 23 bp, Homo sapiens
cttatagagggtcacggctcagg

SEQ ID NO: 4845 - DNA, 23 bp, Homo sapiens
gtccgggccaggaggctcagcgg

SEQ ID NO: 4846 - DNA, 23 bp, Homo sapiens
ccagcgctgaagcattccgatgg

SEQ ID NO: 4847 - DNA, 23 bp, Homo sapiens
ccttccggtggtttcagtgacgg

SEQ ID NO: 4848 - DNA, 23 bp, Homo sapiens
gggccggccgggcgcatcactgg

SEQ ID NO: 4849 - DNA, 23 bp, Homo sapiens
tcttgggagagcaggtcaccagg

SEQ ID NO: 4850 - DNA, 23 bp, Homo sapiens
ttcactccccatcatgcagcagg

SEQ ID NO: 4851 - DNA, 23 bp, Homo sapiens
ctacttgccgaggaagaaaatgg

SEQ ID NO: 4852 - DNA, 23 bp, Homo sapiens
ggctgggaagagctcatggttgg

SEQ ID NO: 4853 - DNA, 23 bp, Homo sapiens
gtatcgcctatacatggcagagg

SEQ ID NO: 4854 - DNA, 23 bp, Homo sapiens
accaaagttaaacaagcctccgg

SEQ ID NO: 4855 - DNA, 23 bp, Homo sapiens
gaaagcaaatcctcctgaggagg

SEQ ID NO: 4856 - DNA, 23 bp, Homo sapiens
gctacacgtggaaatatgaaggg

SEQ ID NO: 4857 - DNA, 23 bp, Homo sapiens
tgatgatctcacggagttgtagg

SEQ ID NO: 4858 - DNA, 23 bp, Homo sapiens
gaagaggctacggcttagagtgg

SEQ ID NO: 4859 - DNA, 23 bp, Homo sapiens
gaagctggaggatgctcagtagg

SEQ ID NO: 4860 - DNA, 23 bp, Homo sapiens
gagcacgtggaggtgttagtagg

SEQ ID NO: 4861 - DNA, 23 bp, Homo sapiens
aaggtgctccttgatcatgtcgg

SEQ ID NO: 4862 - DNA, 23 bp, Homo sapiens
agcgctgcttcgtcttctgaggg

SEQ ID NO: 4863 - DNA, 23 bp, Homo sapiens
ccagtgccatttacagaacaagg

SEQ ID NO: 4864 - DNA, 23 bp, Homo sapiens
agagaggccagggctagaagagg

SEQ ID NO: 4865 - DNA, 23 bp, Homo sapiens
ctttgctatttgctagctgctgg

SEQ ID NO: 4866 - DNA, 23 bp, Homo sapiens
gcgaggtcacacgacctcgtcgg

SEQ ID NO: 4867 - DNA, 23 bp, Homo sapiens
aaaatgaaatgcactccccgagg

SEQ ID NO: 4868 - DNA, 23 bp, Homo sapiens
accgcaatggaaacgtcctaagg

SEQ ID NO: 4869 - DNA, 23 bp, Homo sapiens
acttagctctggatgaggctggg

SEQ ID NO: 4870 - DNA, 23 bp, Homo sapiens
agacactggacagggtcacttgg

SEQ ID NO: 4871 - DNA, 23 bp, Homo sapiens
ctttgtcggcattaagaagaagg

SEQ ID NO: 4872 - DNA, 23 bp, Homo sapiens
agtccctcgccagcagctgaggg

SEQ ID NO: 4873 - DNA, 23 bp, Homo sapiens
aggatcttctgcttagcaagtgg

SEQ ID NO: 4874 - DNA, 23 bp, Homo sapiens
actgccctcttcggggccgtagg

SEQ ID NO: 4875 - DNA, 23 bp, Homo sapiens
tatccaactgtcactcccactgg

SEQ ID NO: 4876 - DNA, 23 bp, Homo sapiens
ttccagatacagaagtagggcgg

SEQ ID NO: 4877 - DNA, 23 bp, Homo sapiens
taaagcagcttatgaatccacgg

SEQ ID NO: 4878 - DNA, 23 bp, Homo sapiens
tgcaaagaagaagggcaagtagg

SEQ ID NO: 4879 - DNA, 23 bp, Homo sapiens
acaaactcattgttggactctgg

SEQ ID NO: 4880 - DNA, 23 bp, Homo sapiens
ccatcctctctgatcactgctgg

SEQ ID NO: 4881 - DNA, 23 bp, Homo sapiens
gcagagacgtgattagttgatgg

SEQ ID NO: 4882 - DNA, 23 bp, Homo sapiens
agttaatcgctctgaaagtgagg

SEQ ID NO: 4883 - DNA, 23 bp, Homo sapiens
aggctgagggtagcacctaaagg

SEQ ID NO: 4884 - DNA, 23 bp, Homo sapiens
aagaaactcagacaggtgtctgg

SEQ ID NO: 4885 - DNA, 23 bp, Homo sapiens
ccaaatgcagctgcgctcttagg

SEQ ID NO: 4886 - DNA, 23 bp, Homo sapiens
gtggtgtcttcttcaattgatgg

SEQ ID NO: 4887 - DNA, 23 bp, Homo sapiens
gcttgcctcttgcttcttattgg

SEQ ID NO: 4888 - DNA, 23 bp, Homo sapiens
catcatcaagggaagaagcttgg

SEQ ID NO: 4889 - DNA, 23 bp, Homo sapiens
ccgggccagagccagtgatgggg

SEQ ID NO: 4890 - DNA, 23 bp, Homo sapiens
ttatcgctggcaaaacgcgatgg

SEQ ID NO: 4891 - DNA, 23 bp, Homo sapiens
aagctcatcagatttccccatgg

SEQ ID NO: 4892 - DNA, 23 bp, Homo sapiens
gtgggtcttgggttagactgtgg

SEQ ID NO: 4893 - DNA, 23 bp, Homo sapiens
cgccttcggttgcggggaatggg

SEQ ID NO: 4894 - DNA, 23 bp, Homo sapiens
cagctcagcactgtctctgcagg

SEQ ID NO: 4895 - DNA, 23 bp, Homo sapiens
gagcatcaacctacagtttttgg

SEQ ID NO: 4896 - DNA, 23 bp, Homo sapiens
ttctgttaacaaatcgcacgtgg

SEQ ID NO: 4897 - DNA, 23 bp, Homo sapiens
ccagcacagccctcgctcagcgg

SEQ ID NO: 4898 - DNA, 23 bp, Homo sapiens
ccggcacagccctcgctcagcgg

SEQ ID NO: 4899 - DNA, 23 bp, Homo sapiens
cgcttcctgccccgctgaagggg

SEQ ID NO: 4900 - DNA, 23 bp, Homo sapiens
ctatctgcccttcttcagacagg

SEQ ID NO: 4901 - DNA, 23 bp, Homo sapiens
ccatctgtgcttcttcagacagg

SEQ ID NO: 4902 - DNA, 23 bp, Homo sapiens
tgggctagcattcttcagacagg

SEQ ID NO: 4903 - DNA, 23 bp, Homo sapiens
ccatctgctcttcttcagacagg

SEQ ID NO: 4904 - DNA, 23 bp, Homo sapiens
tgtgctgtgccccgctagaatgg

SEQ ID NO: 4905 - DNA, 23 bp, Homo sapiens
gtcctccacacactcatgagcgg

SEQ ID NO: 4906 - DNA, 23 bp, Homo sapiens
gaagggccggggcgttagcgcgg

SEQ ID NO: 4907 - DNA, 23 bp, Homo sapiens
ccgcctctgcgctgttcctcagg

SEQ ID NO: 4908 - DNA, 23 bp, Homo sapiens
agcgtctttcagcacagatgagg

SEQ ID NO: 4909 - DNA, 23 bp, Homo sapiens
ccaagttgccttccttcatctgg

SEQ ID NO: 4910 - DNA, 23 bp, Homo sapiens
cccctcctgactggaagatttgg

SEQ ID NO: 4911 - DNA, 23 bp, Homo sapiens
gtgtgcggtgcccaggccctagg

SEQ ID NO: 4912 - DNA, 23 bp, Homo sapiens
tcaattcggcattgcccttccgg

SEQ ID NO: 4913 - DNA, 23 bp, Homo sapiens
gaaaattcaggctccacttacgg

SEQ ID NO: 4914 - DNA, 23 bp, Homo sapiens
ctttcagggcagaacttctcagg

SEQ ID NO: 4915 - DNA, 23 bp, Homo sapiens
ttaagagatgggattacaagtgg

SEQ ID NO: 4916 - DNA, 23 bp, Homo sapiens
agtttgtctttttctctgacagg

SEQ ID NO: 4917 - DNA, 23 bp, Homo sapiens
tcaagagatggaaccctaagtgg

SEQ ID NO: 4918 - DNA, 23 bp, Homo sapiens
gggaaatcaggctccacttacgg

SEQ ID NO: 4919 - DNA, 23 bp, Homo sapiens
cctcctaagcgtaatttcagcgg

SEQ ID NO: 4920 - DNA, 23 bp, Homo sapiens
ccaccacccccctgctgaggggg

SEQ ID NO: 4921 - DNA, 23 bp, Homo sapiens
aagacaaggaccagctttgaggg

SEQ ID NO: 4922 - DNA, 23 bp, Homo sapiens
tgcccttctcaggaggatcaagg

SEQ ID NO: 4923 - DNA, 23 bp, Homo sapiens
agccactgggccctgggtctggg

SEQ ID NO: 4924 - DNA, 23 bp, Homo sapiens
gtcactgtgagttcgcacccagg

SEQ ID NO: 4925 - DNA, 23 bp, Homo sapiens
gtcactgcaagcttacattcagg

SEQ ID NO: 4926 - DNA, 23 bp, Homo sapiens
gtctctgcagaactcagctcagg

SEQ ID NO: 4927 - DNA, 23 bp, Homo sapiens
cgcgcccacgctcaggcccgcgg

SEQ ID NO: 4928 - DNA, 23 bp, Homo sapiens
cgagtagaacccctgggctgagg

SEQ ID NO: 4929 - DNA, 23 bp, Homo sapiens
gcatctggatcaagttgaagagg

SEQ ID NO: 4930 - DNA, 23 bp, Homo sapiens
aacattcagagagtttcttcagg

SEQ ID NO: 4931 - DNA, 23 bp, Homo sapiens
aaacacatggattccattcttgg

SEQ ID NO: 4932 - DNA, 23 bp, Homo sapiens
cttcgtttgtaacggataactgg

SEQ ID NO: 4933 - DNA, 23 bp, Homo sapiens
gaccagtcccgggcaggcttggg

SEQ ID NO: 4934 - DNA, 23 bp, Homo sapiens
aaaagtggagaagagaaagaagg

SEQ ID NO: 4935 - DNA, 23 bp, Homo sapiens
aactacagccgcttgttgtttgg

SEQ ID NO: 4936 - DNA, 23 bp, Homo sapiens
cttggccaagctcactctgtagg

SEQ ID NO: 4937 - DNA, 23 bp, Homo sapiens
gtcattgaacagcctgtagaagg

SEQ ID NO: 4938 - DNA, 23 bp, Homo sapiens
gtggagcatgctgtcctcagcgg

SEQ ID NO: 4939 - DNA, 23 bp, Homo sapiens
aaggcctctttgccagaaaaagg

SEQ ID NO: 4940 - DNA, 23 bp, Homo sapiens
tgttagtgtgtggttgagaaagg

SEQ ID NO: 4941 - DNA, 23 bp, Homo sapiens
tgacacagcagcagcagctgtgg

SEQ ID NO: 4942 - DNA, 23 bp, Homo sapiens
tctctgttgctgctgtctctggg

SEQ ID NO: 4943 - DNA, 23 bp, Homo sapiens
gcacgctcagtgtcgcttcgtgg

SEQ ID NO: 4944 - DNA, 23 bp, Homo sapiens
gatttcagtcaagaagaagcagg

SEQ ID NO: 4945 - DNA, 23 bp, Homo sapiens
tgttggcaacgaggaaacgaagg

SEQ ID NO: 4946 - DNA, 23 bp, Homo sapiens
ccaggaatctcactgcttgctgg

SEQ ID NO: 4947 - DNA, 23 bp, Homo sapiens
aggaagaaagtcgcttttgacgg

SEQ ID NO: 4948 - DNA, 23 bp, Homo sapiens
tgccagatcgtcagcgctaaggg

SEQ ID NO: 4949 - DNA, 23 bp, Homo sapiens
ctccttatcctggaaacgcaagg

SEQ ID NO: 4950 - DNA, 23 bp, Homo sapiens
cgctgcccagccaggcctgacgg

SEQ ID NO: 4951 - DNA, 23 bp, Homo sapiens
ctctgctgctgtcagtcatctgg

SEQ ID NO: 4952 - DNA, 23 bp, Homo sapiens
aaccggctaaattattgacctgg

SEQ ID NO: 4953 - DNA, 23 bp, Homo sapiens
gatgagtcgagagggctgagcgg

SEQ ID NO: 4954 - DNA, 23 bp, Homo sapiens
gacctgcgctatctagctaccgg

SEQ ID NO: 4955 - DNA, 23 bp, Homo sapiens
taggcaaaaggatttccaaatgg

SEQ ID NO: 4956 - DNA, 23 bp, Homo sapiens
gctgggtcagggcactcatgagg

SEQ ID NO: 4957 - DNA, 23 bp, Homo sapiens
ctcagtaatctgcaatttggtgg

SEQ ID NO: 4958 - DNA, 23 bp, Homo sapiens
gcggcagaacagatgctgaaagg

SEQ ID NO: 4959 - DNA, 23 bp, Homo sapiens
acagttgtattcagcctgaaagg

SEQ ID NO: 4960 - DNA, 23 bp, Homo sapiens
tgcatagcagcactatcatgagg

SEQ ID NO: 4961 - DNA, 23 bp, Homo sapiens
ctctttgaaactgatgacgacgg

SEQ ID NO: 4962 - DNA, 23 bp, Homo sapiens
aagggagctgacagccacagagg

SEQ ID NO: 4963 - DNA, 23 bp, Homo sapiens
aaggtcatgaccatggtgtgagg

SEQ ID NO: 4964 - DNA, 23 bp, Homo sapiens
tttccgttcgggttctctcaagg

SEQ ID NO: 4965 - DNA, 23 bp, Homo sapiens
agttcatgacaacaaggtgcagg

SEQ ID NO: 4966 - DNA, 23 bp, Homo sapiens
caggcgcttgcgggttaaggtgg

SEQ ID NO: 4967 - DNA, 23 bp, Homo sapiens
ccccgccaagcaagatgagctgg

SEQ ID NO: 4968 - DNA, 23 bp, Homo sapiens
agtgtggacgtggcctgaccagg

SEQ ID NO: 4969 - DNA, 23 bp, Homo sapiens
cctccactgagccacatttaagg

SEQ ID NO: 4970 - DNA, 23 bp, Homo sapiens
gcttctgagagctgtgcgtgagg

SEQ ID NO: 4971 - DNA, 23 bp, Homo sapiens
cgatgctcagttcatgcttttgg

SEQ ID NO: 4972 - DNA, 23 bp, Homo sapiens
gcagtcactggagtcttcagagg

SEQ ID NO: 4973 - DNA, 23 bp, Homo sapiens
cttccaaactcattcagctttgg

SEQ ID NO: 4974 - DNA, 23 bp, Homo sapiens
tcacctgacgtccttgtctatgg

SEQ ID NO: 4975 - DNA, 23 bp, Homo sapiens
atgctgtgatcttggcttagagg

SEQ ID NO: 4976 - DNA, 23 bp, Homo sapiens
aagccagaggctgccctcaccgg

SEQ ID NO: 4977 - DNA, 23 bp, Homo sapiens
gaggagcagcacctcctaactgg

SEQ ID NO: 4978 - DNA, 23 bp, Homo sapiens
cgtggagtgcgggctgcgctagg

SEQ ID NO: 4979 - DNA, 23 bp, Homo sapiens
atccaggcttaacattttcgagg

SEQ ID NO: 4980 - DNA, 23 bp, Homo sapiens
agtggatcaagatattacgctgg

SEQ ID NO: 4981 - DNA, 23 bp, Homo sapiens
taaagatgaacgaccgagatcgg

SEQ ID NO: 4982 - DNA, 23 bp, Homo sapiens
aatttaaggagtgagtcgtttgg

SEQ ID NO: 4983 - DNA, 23 bp, Homo sapiens
tcaatgagctctttctgctttgg

SEQ ID NO: 4984 - DNA, 23 bp, Homo sapiens
aggataatacctgtaggatatgg

SEQ ID NO: 4985 - DNA, 23 bp, Homo sapiens
gagagcacgatgatctcttctgg

SEQ ID NO: 4986 - DNA, 23 bp, Homo sapiens
ggaccgaagcatacaaatggtgg

SEQ ID NO: 4987 - DNA, 23 bp, Homo sapiens
ggtcaggctgagcagtgatgtgg

SEQ ID NO: 4988 - DNA, 23 bp, Homo sapiens
gcggcgccgcgggctagcgtcgg

SEQ ID NO: 4989 - DNA, 23 bp, Homo sapiens
ataacaacttggaaaggagaggg

SEQ ID NO: 4990 - DNA, 23 bp, Homo sapiens
ggtggctacaccatctggtgagg

SEQ ID NO: 4991 - DNA, 23 bp, Homo sapiens
tacctcaaaatgctttagggagg

SEQ ID NO: 4992 - DNA, 23 bp, Homo sapiens
gcatcactttagaagaagtcggg

SEQ ID NO: 4993 - DNA, 23 bp, Homo sapiens
acaagctacacagaaaagagtgg

SEQ ID NO: 4994 - DNA, 23 bp, Homo sapiens
cggagctgactcagggcagacgg

SEQ ID NO: 4995 - DNA, 23 bp, Homo sapiens
tggctgtagactcaggttagagg

SEQ ID NO: 4996 - DNA, 23 bp, Homo sapiens
ggtgggggcaaaggctgaggggg

SEQ ID NO: 4997 - DNA, 23 bp, Homo sapiens
agctttcatggcatcttccttgg

SEQ ID NO: 4998 - DNA, 23 bp, Homo sapiens
cactacaaacaagcaactgtggg

SEQ ID NO: 4999 - DNA, 23 bp, Homo sapiens
gcttcgagggtggtgattagcgg

SEQ ID NO: 5000 - DNA, 23 bp, Homo sapiens
ggcagcgggtggctcagaagtgg

SEQ ID NO: 5001 - DNA, 23 bp, Homo sapiens
tggagatggtctagtcctcctgg

SEQ ID NO: 5002 - DNA, 23 bp, Homo sapiens
aggggcccactgctagctgcagg

SEQ ID NO: 5003 - DNA, 23 bp, Homo sapiens
gtcagccagagccggatgtcagg

SEQ ID NO: 5004 - DNA, 23 bp, Homo sapiens
tacgtggagctcattgagtgagg

SEQ ID NO: 5005 - DNA, 23 bp, Homo sapiens
gggatgtggggcagcctcacagg

SEQ ID NO: 5006 - DNA, 23 bp, Homo sapiens
tcaagccatttacgctgcagtgg

SEQ ID NO: 5007 - DNA, 23 bp, Homo sapiens
agatctagtagcataaaagctgg

SEQ ID NO: 5008 - DNA, 23 bp, Homo sapiens
tgcgagcggcttctaggacacgg

SEQ ID NO: 5009 - DNA, 23 bp, Homo sapiens
acttactggggctgtctgaatgg

SEQ ID NO: 5010 - DNA, 23 bp, Homo sapiens
atcttatctctgaatgagtgagg

SEQ ID NO: 5011 - DNA, 23 bp, Homo sapiens
ctcagggtgccttagtggacggg

SEQ ID NO: 5012 - DNA, 23 bp, Homo sapiens
gggctggaggttggatctactgg

SEQ ID NO: 5013 - DNA, 23 bp, Homo sapiens
atggaaactatgctgggctctgg

SEQ ID NO: 5014 - DNA, 23 bp, Homo sapiens
tatgcaggcctctggagctaagg

SEQ ID NO: 5015 - DNA, 23 bp, Homo sapiens
tacgcaggcctctggagttaagg

SEQ ID NO: 5016 - DNA, 23 bp, Homo sapiens
agagaagaagaaacacgtagtgg

SEQ ID NO: 5017 - DNA, 23 bp, Homo sapiens
atacgtggatcgtgctgtgaggg

SEQ ID NO: 5018 - DNA, 23 bp, Homo sapiens
atctttacagtgatgcagttagg

SEQ ID NO: 5019 - DNA, 23 bp, Homo sapiens
ccagatgatatgtgacactgggg

SEQ ID NO: 5020 - DNA, 23 bp, Homo sapiens
atggcccaggaaccatcatgagg

SEQ ID NO: 5021 - DNA, 23 bp, Homo sapiens
tgccctgcagaattagctgtagg

SEQ ID NO: 5022 - DNA, 23 bp, Homo sapiens
ccacctgcagaattagctgaagg

SEQ ID NO: 5023 - DNA, 23 bp, Homo sapiens
catcctgaagaattaaccgtagg

SEQ ID NO: 5024 - DNA, 23 bp, Homo sapiens
attcaattcgttgccttttgagg

SEQ ID NO: 5025 - DNA, 23 bp, Homo sapiens
tgctgatgttgacttaaagctgg

SEQ ID NO: 5026 - DNA, 23 bp, Homo sapiens
agagaatgaaaatgaggatgagg

SEQ ID NO: 5027 - DNA, 23 bp, Homo sapiens
actacactctgagtatctccagg

SEQ ID NO: 5028 - DNA, 23 bp, Homo sapiens
ctaggtatgaggcctcaagatgg

SEQ ID NO: 5029 - DNA, 23 bp, Homo sapiens
tgcagtgcataccatcctgaagg

SEQ ID NO: 5030 - DNA, 23 bp, Homo sapiens
tgcagtgcatgccatcctgaagg

SEQ ID NO: 5031 - DNA, 23 bp, Homo sapiens
cttctgccttacgcctagtgggg

SEQ ID NO: 5032 - DNA, 23 bp, Homo sapiens
acacgcacacatgttcactcagg

SEQ ID NO: 5033 - DNA, 23 bp, Homo sapiens
ctcatcacaagtgatatggcagg

SEQ ID NO: 5034 - DNA, 23 bp, Homo sapiens
aaaagcagcatcatcttcaaagg

SEQ ID NO: 5035 - DNA, 23 bp, Homo sapiens
ttaaaaggctgagcctgtgatgg

SEQ ID NO: 5036 - DNA, 23 bp, Homo sapiens
acagctatagtactgagtcaagg

SEQ ID NO: 5037 - DNA, 23 bp, Homo sapiens
gacgtctttaacgtcatggacgg

SEQ ID NO: 5038 - DNA, 23 bp, Homo sapiens
atccacgaagctgctgtctctgg

SEQ ID NO: 5039 - DNA, 23 bp, Homo sapiens
gatgggcatgagattacagtggg

SEQ ID NO: 5040 - DNA, 23 bp, Homo sapiens
aaacaaggactatgctgccgtgg

SEQ ID NO: 5041 - DNA, 23 bp, Homo sapiens
ggagctgctggctctcaagatgg

SEQ ID NO: 5042 - DNA, 23 bp, Homo sapiens
aggtggttttgttaatctacagg

SEQ ID NO: 5043 - DNA, 23 bp, Homo sapiens
cctggagccacctgatgacacgg

SEQ ID NO: 5044 - DNA, 23 bp, Homo sapiens
gaactgaccagattcaggtcagg

SEQ ID NO: 5045 - DNA, 23 bp, Homo sapiens
ttattaggaacacacatcagtgg

SEQ ID NO: 5046 - DNA, 23 bp, Homo sapiens
agaggtgcctatcttaacactgg

SEQ ID NO: 5047 - DNA, 23 bp, Homo sapiens
cacaaatagagatgctagcaagg

SEQ ID NO: 5048 - DNA, 23 bp, Homo sapiens
gaagacgcaaccaggatgtgagg

SEQ ID NO: 5049 - DNA, 23 bp, Homo sapiens
tcttattaaaagggcgagttagg

SEQ ID NO: 5050 - DNA, 23 bp, Homo sapiens
gtctgcaggaggctcagtctcgg

SEQ ID NO: 5051 - DNA, 23 bp, Homo sapiens
gcacaagagggttgtggagcagg

SEQ ID NO: 5052 - DNA, 23 bp, Homo sapiens
agagagtggaaattggaagctgg

SEQ ID NO: 5053 - DNA, 23 bp, Homo sapiens
tgtactctcctgtcttcagcagg

SEQ ID NO: 5054 - DNA, 23 bp, Homo sapiens
cgcttgatcccaggagttaaagg

SEQ ID NO: 5055 - DNA, 23 bp, Homo sapiens
ttatatgagaagctggcaactgg

SEQ ID NO: 5056 - DNA, 23 bp, Homo sapiens
actgtaagtaaatcatccccagg

SEQ ID NO: 5057 - DNA, 23 bp, Homo sapiens
gtgcgctctgccattcaactcgg

SEQ ID NO: 5058 - DNA, 23 bp, Homo sapiens
acttattctgctccagtcatagg

SEQ ID NO: 5059 - DNA, 23 bp, Homo sapiens
ttgagtcatgctgaagagatagg

SEQ ID NO: 5060 - DNA, 23 bp, Homo sapiens
ttggtatcagtggctatgggggg

SEQ ID NO: 5061 - DNA, 23 bp, Homo sapiens
aatacatgtgctgctatcaaagg

SEQ ID NO: 5062 - DNA, 23 bp, Homo sapiens
cctgctcaagctcttgcaggagg

SEQ ID NO: 5063 - DNA, 23 bp, Homo sapiens
actgcctacgcggggtgaagagg

SEQ ID NO: 5064 - DNA, 23 bp, Homo sapiens
tccacttttggtttatttggggg

SEQ ID NO: 5065 - DNA, 23 bp, Homo sapiens
taggaagaagcaaatggacatgg

SEQ ID NO: 5066 - DNA, 23 bp, Homo sapiens
ttcctaatcattttcaggactgg

SEQ ID NO: 5067 - DNA, 23 bp, Homo sapiens
agatacacagaagaagcctaggg

SEQ ID NO: 5068 - DNA, 23 bp, Homo sapiens
actcactgaagcttttgactcgg

SEQ ID NO: 5069 - DNA, 23 bp, Homo sapiens
aaaggagtgcttaggagatgagg

SEQ ID NO: 5070 - DNA, 23 bp, Homo sapiens
gatgaacggatgaagaagctggg

SEQ ID NO: 5071 - DNA, 23 bp, Homo sapiens
agcagctatcactcctctgctgg

SEQ ID NO: 5072 - DNA, 23 bp, Homo sapiens
ccagtgtgtggaaatcactgagg

SEQ ID NO: 5073 - DNA, 23 bp, Homo sapiens
gggcccacttcttccttaaaagg

SEQ ID NO: 5074 - DNA, 23 bp, Homo sapiens
ccaccattcactgtcttctcagg

SEQ ID NO: 5075 - DNA, 23 bp, Homo sapiens
agagatgctagacttgcgtcagg

SEQ ID NO: 5076 - DNA, 23 bp, Homo sapiens
agtggtggggcctggtgaattgg

SEQ ID NO: 5077 - DNA, 23 bp, Homo sapiens
tcatagtcttctttaggtggtgg

SEQ ID NO: 5078 - DNA, 23 bp, Homo sapiens
gtggccatctttctaggttgagg

SEQ ID NO: 5079 - DNA, 23 bp, Homo sapiens
ttgcacgccctcaaattgctggg

SEQ ID NO: 5080 - DNA, 23 bp, Homo sapiens
cttaacttgctgcctagaaaagg

SEQ ID NO: 5081 - DNA, 23 bp, Homo sapiens
gtcccgaggagcagacttagtgg

SEQ ID NO: 5082 - DNA, 23 bp, Homo sapiens
taaagacaaacagatgtcctagg

SEQ ID NO: 5083 - DNA, 23 bp, Homo sapiens
gttcttgctatgatgtctgacgg

SEQ ID NO: 5084 - DNA, 23 bp, Homo sapiens
gcactctcccctcctttacatgg

SEQ ID NO: 5085 - DNA, 23 bp, Homo sapiens
gtgtgtggagggagctcagcagg

SEQ ID NO: 5086 - DNA, 23 bp, Homo sapiens
tgggtggctggggcctaggttgg

SEQ ID NO: 5087 - DNA, 23 bp, Homo sapiens
ctgaactggaaaaggtggatggg

SEQ ID NO: 5088 - DNA, 23 bp, Homo sapiens
gcacacgcccccacagctgaggg

SEQ ID NO: 5089 - DNA, 23 bp, Homo sapiens
ggccccctgcccttggctaatgg

SEQ ID NO: 5090 - DNA, 23 bp, Homo sapiens
tgtctctcacttccgtgtcctgg

SEQ ID NO: 5091 - DNA, 23 bp, Homo sapiens
gctgcgagcagagagggagtagg

SEQ ID NO: 5092 - DNA, 23 bp, Homo sapiens
tagtcagtgcggtggtgagaagg

SEQ ID NO: 5093 - DNA, 23 bp, Homo sapiens
tccttcaagagagttcagattgg

SEQ ID NO: 5094 - DNA, 23 bp, Homo sapiens
atctctgttgacattcattgtgg

SEQ ID NO: 5095 - DNA, 23 bp, Homo sapiens
tttactgtaaaggctgatcaagg

SEQ ID NO: 5096 - DNA, 23 bp, Homo sapiens
acacattcagtcatggattcagg

SEQ ID NO: 5097 - DNA, 23 bp, Homo sapiens
agcccttcaaaaatcagcagagg

SEQ ID NO: 5098 - DNA, 23 bp, Homo sapiens
tgtgtgaaactcgaagtgcttgg

SEQ ID NO: 5099 - DNA, 23 bp, Homo sapiens
tgctcccaattgttcatgcttgg

SEQ ID NO: 5100 - DNA, 23 bp, Homo sapiens
ctcggaacagctgctcattgagg

SEQ ID NO: 5101 - DNA, 23 bp, Homo sapiens
gtgattgaagggtcctaaaaagg

SEQ ID NO: 5102 - DNA, 23 bp, Homo sapiens
aaataggaagaggcagtgagagg

SEQ ID NO: 5103 - DNA, 23 bp, Homo sapiens
tgtcatctacaggtttgacttgg

SEQ ID NO: 5104 - DNA, 23 bp, Homo sapiens
gaaggagaagtccgactgagggg

SEQ ID NO: 5105 - DNA, 23 bp, Homo sapiens
ggcagaggatgcactcaacacgg

SEQ ID NO: 5106 - DNA, 23 bp, Homo sapiens
gagggctgtcgacctcacacagg

SEQ ID NO: 5107 - DNA, 23 bp, Homo sapiens
caccttctgctccttcaacaagg

SEQ ID NO: 5108 - DNA, 23 bp, Homo sapiens
gggaaggactggggtcaggctgg

SEQ ID NO: 5109 - DNA, 23 bp, Homo sapiens
gcagattggcaagatagggacgg

SEQ ID NO: 5110 - DNA, 23 bp, Homo sapiens
tgcccaggagagataatagaagg

SEQ ID NO: 5111 - DNA, 23 bp, Homo sapiens
atcagaaggttctgaacagctgg

SEQ ID NO: 5112 - DNA, 23 bp, Homo sapiens
tttagcagaggatgaagagctgg

SEQ ID NO: 5113 - DNA, 23 bp, Homo sapiens
ccaggacccactgttcattcagg

SEQ ID NO: 5114 - DNA, 23 bp, Homo sapiens
gaagtcggcctcttcctgatggg

SEQ ID NO: 5115 - DNA, 23 bp, Homo sapiens
gagtggtttcatttacgtgaagg

SEQ ID NO: 5116 - DNA, 23 bp, Homo sapiens
gcaagaaatcatctgacagcagg

SEQ ID NO: 5117 - DNA, 23 bp, Homo sapiens
ggctggtggagcttctcagttgg

SEQ ID NO: 5118 - DNA, 23 bp, Homo sapiens
tcagagacatccaagttggatgg

SEQ ID NO: 5119 - DNA, 23 bp, Homo sapiens
cggagtttcagtaaagcatttgg

SEQ ID NO: 5120 - DNA, 23 bp, Homo sapiens
agtgctgtgtcaggcaaagatgg

SEQ ID NO: 5121 - DNA, 23 bp, Homo sapiens
tttgcacttgtacttggctgtgg

SEQ ID NO: 5122 - DNA, 23 bp, Homo sapiens
gcaactcaacgctgaagacatgg

SEQ ID NO: 5123 - DNA, 23 bp, Homo sapiens
ttgccccaccagagacgaggagg

SEQ ID NO: 5124 - DNA, 23 bp, Homo sapiens
tttgtcaaaatcaggttgcttgg

SEQ ID NO: 5125 - DNA, 23 bp, Homo sapiens
aacccaaaaaggtgtacagcggg

SEQ ID NO: 5126 - DNA, 23 bp, Homo sapiens
acgaagaagaacagaggcttagg

SEQ ID NO: 5127 - DNA, 23 bp, Homo sapiens
gcaaagaaggacgcctcttctgg

SEQ ID NO: 5128 - DNA, 23 bp, Homo sapiens
ctctggcacgtggtggttaccgg

SEQ ID NO: 5129 - DNA, 23 bp, Homo sapiens
gaggagatgtctatctcatcagg

SEQ ID NO: 5130 - DNA, 23 bp, Homo sapiens
tcccagggggttgactggtgggg

SEQ ID NO: 5131 - DNA, 23 bp, Homo sapiens
tccagtagatgatgagtcatggg

SEQ ID NO: 5132 - DNA, 23 bp, Homo sapiens
actgtcggctcagaagtccatgg

SEQ ID NO: 5133 - DNA, 23 bp, Homo sapiens
agtcgatgggacagttagagggg

SEQ ID NO: 5134 - DNA, 23 bp, Homo sapiens
aaatggaaagacctcaaggaagg

SEQ ID NO: 5135 - DNA, 23 bp, Homo sapiens
tcataaaagaagagctgatccgg

SEQ ID NO: 5136 - DNA, 23 bp, Homo sapiens
ggaaaaatgaagaagcggaaagg

SEQ ID NO: 5137 - DNA, 23 bp, Homo sapiens
ggccgtgtggggctcagaccagg

SEQ ID NO: 5138 - DNA, 23 bp, Homo sapiens
tcttattgggaatatcctgttgg

SEQ ID NO: 5139 - DNA, 23 bp, Homo sapiens
ctcagtcaaaactccgtttgtgg

SEQ ID NO: 5140 - DNA, 23 bp, Homo sapiens
aagcagagggcggcctaggctgg

SEQ ID NO: 5141 - DNA, 23 bp, Homo sapiens
ctaatgctctccctttccaatgg

SEQ ID NO: 5142 - DNA, 23 bp, Homo sapiens
aaaacctggacaaagacgcaagg

SEQ ID NO: 5143 - DNA, 23 bp, Homo sapiens
aagatgcggaagaggatgtgagg

SEQ ID NO: 5144 - DNA, 23 bp, Homo sapiens
ggatttagggatctcagatttgg

SEQ ID NO: 5145 - DNA, 23 bp, Homo sapiens
agaggcccaacaacctcaggagg

SEQ ID NO: 5146 - DNA, 23 bp, Homo sapiens
attgaggacctgatatcatttgg

SEQ ID NO: 5147 - DNA, 23 bp, Homo sapiens
ggctgccaggaaagtcaccttgg

SEQ ID NO: 5148 - DNA, 23 bp, Homo sapiens
ggtgagtagactgtataacaagg

SEQ ID NO: 5149 - DNA, 23 bp, Homo sapiens
ggttacaggagctaatcttatgg

SEQ ID NO: 5150 - DNA, 23 bp, Homo sapiens
taaggtttctcatcttctacagg

SEQ ID NO: 5151 - DNA, 23 bp, Homo sapiens
agttgtactcagttgttcaaagg

SEQ ID NO: 5152 - DNA, 23 bp, Homo sapiens
taagcgtgacaatgtagtcctgg

SEQ ID NO: 5153 - DNA, 23 bp, Homo sapiens
tgcccaagactcagtctatctgg

SEQ ID NO: 5154 - DNA, 23 bp, Homo sapiens
gcggccgatggagcctcacacgg

SEQ ID NO: 5155 - DNA, 23 bp, Homo sapiens
gccaggcccaaggctgcagaggg

SEQ ID NO: 5156 - DNA, 23 bp, Homo sapiens
gaactcatcaggaagacaaaagg

SEQ ID NO: 5157 - DNA, 23 bp, Homo sapiens
atccttctctgctaagctctagg

SEQ ID NO: 5158 - DNA, 23 bp, Homo sapiens
cttgcagcatcaagttcctcagg

SEQ ID NO: 5159 - DNA, 23 bp, Homo sapiens
cctgccagtcctggatcaggagg

SEQ ID NO: 5160 - DNA, 23 bp, Homo sapiens
gctaagagaggctaattttctgg

SEQ ID NO: 5161 - DNA, 23 bp, Homo sapiens
acatctgaatgtgagcccagcgg

SEQ ID NO: 5162 - DNA, 23 bp, Homo sapiens
ggagccaggtcccgatgtggagg

SEQ ID NO: 5163 - DNA, 23 bp, Homo sapiens
catctaccagggaagactctggg

SEQ ID NO: 5164 - DNA, 23 bp, Homo sapiens
gttgggaactgcctcattggtgg

SEQ ID NO: 5165 - DNA, 23 bp, Homo sapiens
agcgacagcagagtctgtagagg

SEQ ID NO: 5166 - DNA, 23 bp, Homo sapiens
tctctgttctcatccctcagagg

SEQ ID NO: 5167 - DNA, 23 bp, Homo sapiens
gccaagtgctgcaagtgagctgg

SEQ ID NO: 5168 - DNA, 23 bp, Homo sapiens
tctttcttcggcagcattttcgg

SEQ ID NO: 5169 - DNA, 23 bp, Homo sapiens
tgcatgctgtttgagaaaatggg

SEQ ID NO: 5170 - DNA, 23 bp, Homo sapiens
actttctctgctgcagacagagg

SEQ ID NO: 5171 - DNA, 23 bp, Homo sapiens
taatctataatgctcccacatgg

SEQ ID NO: 5172 - DNA, 23 bp, Homo sapiens
acctttgaagtaaagattggggg

SEQ ID NO: 5173 - DNA, 23 bp, Homo sapiens
tgagagcactacacccaaaaagg

SEQ ID NO: 5174 - DNA, 23 bp, Homo sapiens
gaaagatgcgaaaaagtgagagg

SEQ ID NO: 5175 - DNA, 23 bp, Homo sapiens
tgcaagcagcaatgagttccagg

SEQ ID NO: 5176 - DNA, 23 bp, Homo sapiens
actcagtagggactcaagaatgg

SEQ ID NO: 5177 - DNA, 23 bp, Homo sapiens
taacccctgctgtgcggtatggg

SEQ ID NO: 5178 - DNA, 23 bp, Homo sapiens
tcagtgcagcaaatttttcttgg

SEQ ID NO: 5179 - DNA, 23 bp, Homo sapiens
atagctcacttgtctctttttgg

SEQ ID NO: 5180 - DNA, 23 bp, Homo sapiens
actgtttgtaactgacaagttgg

SEQ ID NO: 5181 - DNA, 23 bp, Homo sapiens
cgagaggaagtcatgagctatgg

SEQ ID NO: 5182 - DNA, 23 bp, Homo sapiens
accagcactcaaggtagtcttgg

SEQ ID NO: 5183 - DNA, 23 bp, Homo sapiens
cttcatttttggagctgttgtgg

SEQ ID NO: 5184 - DNA, 23 bp, Homo sapiens
agactgcagaagttgattccagg

SEQ ID NO: 5185 - DNA, 23 bp, Homo sapiens
aggcttcaaagcagttaaaatgg

SEQ ID NO: 5186 - DNA, 23 bp, Homo sapiens
tcatattcatgcttggggaccgg

SEQ ID NO: 5187 - DNA, 23 bp, Homo sapiens
tgagtaagagctgtctgagaagg

SEQ ID NO: 5188 - DNA, 23 bp, Homo sapiens
aggctggaatgttcaaccagtgg

SEQ ID NO: 5189 - DNA, 23 bp, Homo sapiens
tttatgtagactgtgtcttcagg

SEQ ID NO: 5190 - DNA, 23 bp, Homo sapiens
ttagactgtgaaaatggtgatgg

SEQ ID NO: 5191 - DNA, 23 bp, Homo sapiens
gaagcagaagagcagtaatgtgg

SEQ ID NO: 5192 - DNA, 23 bp, Homo sapiens
tatccaactccggttcccaaagg

SEQ ID NO: 5193 - DNA, 23 bp, Homo sapiens
aaattgacggacaaaagaagtgg

SEQ ID NO: 5194 - DNA, 23 bp, Homo sapiens
atcattagaagtgaagcttctgg

SEQ ID NO: 5195 - DNA, 23 bp, Homo sapiens
caaggagaagaaacacacaaagg

SEQ ID NO: 5196 - DNA, 23 bp, Homo sapiens
agttttgtgcagaaaccaattgg

SEQ ID NO: 5197 - DNA, 23 bp, Homo sapiens
ggtttcttatgtcagggtgcagg

SEQ ID NO: 5198 - DNA, 23 bp, Homo sapiens
ggcgactgcaaggtacttgccgg

SEQ ID NO: 5199 - DNA, 23 bp, Homo sapiens
cccgcaagccaaagatccatggg

SEQ ID NO: 5200 - DNA, 23 bp, Homo sapiens
tgctgcaaaaagccatgaggagg

SEQ ID NO: 5201 - DNA, 23 bp, Homo sapiens
ccaaaaaggagagatggtgctgg

SEQ ID NO: 5202 - DNA, 23 bp, Homo sapiens
agtttcctggatgggtgcagtgg

SEQ ID NO: 5203 - DNA, 23 bp, Homo sapiens
gtgtacaggctggcaaaagatgg

SEQ ID NO: 5204 - DNA, 23 bp, Homo sapiens
attactggccagtgctaacttgg

SEQ ID NO: 5205 - DNA, 23 bp, Homo sapiens
aatcacagtccactttggacagg

SEQ ID NO: 5206 - DNA, 23 bp, Homo sapiens
cgtaagtcaatgtgatgaagagg

SEQ ID NO: 5207 - DNA, 23 bp, Homo sapiens
tgggagaccttcgagtgagccgg

SEQ ID NO: 5208 - DNA, 23 bp, Homo sapiens
acttcaggtggcttttgtggagg

SEQ ID NO: 5209 - DNA, 23 bp, Homo sapiens
gccatgaaggtcgagctatgcgg

SEQ ID NO: 5210 - DNA, 23 bp, Homo sapiens
ttgttccttgggagaaagaaggg

SEQ ID NO: 5211 - DNA, 23 bp, Homo sapiens
tgatcttaagaagtgctttgagg

SEQ ID NO: 5212 - DNA, 23 bp, Homo sapiens
aataagttcctgaagggactagg

SEQ ID NO: 5213 - DNA, 23 bp, Homo sapiens
tcacctgctctacagactagagg

SEQ ID NO: 5214 - DNA, 23 bp, Homo sapiens
aatagaattttgcggagtcttgg

SEQ ID NO: 5215 - DNA, 23 bp, Homo sapiens
agaagaaacagaagaaaccaagg

SEQ ID NO: 5216 - DNA, 23 bp, Homo sapiens
gggaaagtcgccatttggaaagg

SEQ ID NO: 5217 - DNA, 23 bp, Homo sapiens
gttgttaactgctttctcctcgg

SEQ ID NO: 5218 - DNA, 23 bp, Homo sapiens
atggaatgtcgaaaaacctttgg

SEQ ID NO: 5219 - DNA, 23 bp, Homo sapiens
gcttaaggtctctagcattctgg

SEQ ID NO: 5220 - DNA, 23 bp, Homo sapiens
gagtggtgcaggaagtgttttgg

SEQ ID NO: 5221 - DNA, 23 bp, Homo sapiens
ctggagacgtcccttgtcaaggg

SEQ ID NO: 5222 - DNA, 23 bp, Homo sapiens
tgcacacatgtatgaggatgtgg

SEQ ID NO: 5223 - DNA, 23 bp, Homo sapiens
aggatcactcatcaaaggagtgg

SEQ ID NO: 5224 - DNA, 23 bp, Homo sapiens
caaggcatactgctcaaaacggg

SEQ ID NO: 5225 - DNA, 23 bp, Homo sapiens
cccttggctttgttctagggagg

SEQ ID NO: 5226 - DNA, 23 bp, Homo sapiens
gatgacagcatcgaagatcttgg

SEQ ID NO: 5227 - DNA, 23 bp, Homo sapiens
tatcttagactacggaactttgg

SEQ ID NO: 5228 - DNA, 23 bp, Homo sapiens
gaaaccacagctgctaatgtggg

SEQ ID NO: 5229 - DNA, 23 bp, Homo sapiens
cagctacacatctacagcttagg

SEQ ID NO: 5230 - DNA, 23 bp, Homo sapiens
tactcaggtagacataagcttgg

SEQ ID NO: 5231 - DNA, 23 bp, Homo sapiens
ttggaataagttctctgtctagg

SEQ ID NO: 5232 - DNA, 23 bp, Homo sapiens
caggtgcagcctggcctcacggg

SEQ ID NO: 5233 - DNA, 23 bp, Homo sapiens
gcatcactgcactttatcctagg

SEQ ID NO: 5234 - DNA, 23 bp, Homo sapiens
ggttgtcttctctgtattgttgg

SEQ ID NO: 5235 - DNA, 23 bp, Homo sapiens
gattgtcatggaagtcatggagg

SEQ ID NO: 5236 - DNA, 23 bp, Homo sapiens
tggtgactgatttaagacattgg

SEQ ID NO: 5237 - DNA, 23 bp, Homo sapiens
cgacttggagaccagtgaagggg

SEQ ID NO: 5238 - DNA, 23 bp, Homo sapiens
ggtgagggccagcggcttggagg

SEQ ID NO: 5239 - DNA, 23 bp, Homo sapiens
tccagaagcactttatgaaatgg

SEQ ID NO: 5240 - DNA, 23 bp, Homo sapiens
ccccttgcttggcctcaggaagg

SEQ ID NO: 5241 - DNA, 23 bp, Homo sapiens
ctgggtgggggtcactgctgcgg

SEQ ID NO: 5242 - DNA, 23 bp, Homo sapiens
ggagggctctcaacactcacagg

SEQ ID NO: 5243 - DNA, 23 bp, Homo sapiens
cacttcatgctgctgctgtgtgg

SEQ ID NO: 5244 - DNA, 23 bp, Homo sapiens
acccaacggccagagctaacagg

SEQ ID NO: 5245 - DNA, 23 bp, Homo sapiens
ttatagtttagtgtggcgcccgg

SEQ ID NO: 5246 - DNA, 23 bp, Homo sapiens
tatgcgacactgctgcacgtagg

SEQ ID NO: 5247 - DNA, 23 bp, Homo sapiens
ctcgtttctcttcttccagaagg

SEQ ID NO: 5248 - DNA, 23 bp, Homo sapiens
aaggctcaactcacatcaaacgg

SEQ ID NO: 5249 - DNA, 23 bp, Homo sapiens
cacttcccgctgctgctatgtgg

SEQ ID NO: 5250 - DNA, 23 bp, Homo sapiens
cctctgtagctcagtgaccctgg

SEQ ID NO: 5251 - DNA, 23 bp, Homo sapiens
acgtggtgtgtacgtgtcactgg

SEQ ID NO: 5252 - DNA, 23 bp, Homo sapiens
ctgaatggactctgtgctttagg

SEQ ID NO: 5253 - DNA, 23 bp, Homo sapiens
ctatgaggccccagcggcagagg

SEQ ID NO: 5254 - DNA, 23 bp, Homo sapiens
ggctggctcagttcacctccagg

SEQ ID NO: 5255 - DNA, 23 bp, Homo sapiens
agagctgacaattacataacagg

SEQ ID NO: 5256 - DNA, 23 bp, Homo sapiens
cctcaatactgtggtgtagacgg

SEQ ID NO: 5257 - DNA, 23 bp, Homo sapiens
tctgctgcctgtggctatggtgg

SEQ ID NO: 5258 - DNA, 23 bp, Homo sapiens
tgtgcaccgtggacgtgtgaggg

SEQ ID NO: 5259 - DNA, 23 bp, Homo sapiens
tttggcttcttgagctaaggggg

SEQ ID NO: 5260 - DNA, 23 bp, Homo sapiens
cacaggattattccttgcttcgg

SEQ ID NO: 5261 - DNA, 23 bp, Homo sapiens
tactctgtactcactgtgcatgg

SEQ ID NO: 5262 - DNA, 23 bp, Homo sapiens
ggacagaggctaggcctcgacgg

SEQ ID NO: 5263 - DNA, 23 bp, Homo sapiens
tataaaggcgactgaatagatgg

SEQ ID NO: 5264 - DNA, 23 bp, Homo sapiens
gcagcttcttctcgttgagaagg

SEQ ID NO: 5265 - DNA, 23 bp, Homo sapiens
aaggagcactccacagtcggagg

SEQ ID NO: 5266 - DNA, 23 bp, Homo sapiens
ttccaagctctttaattccctgg

SEQ ID NO: 5267 - DNA, 23 bp, Homo sapiens
agggtcaaacagcagtttccagg

SEQ ID NO: 5268 - DNA, 23 bp, Homo sapiens
ggctacagttgagatctcgatgg

SEQ ID NO: 5269 - DNA, 23 bp, Homo sapiens
ctgagagcgatcctaggtagggg

SEQ ID NO: 5270 - DNA, 23 bp, Homo sapiens
ccaggagacggctgtgtagcggg

SEQ ID NO: 5271 - DNA, 23 bp, Homo sapiens
ggtggacgtcaccacggcacagg

SEQ ID NO: 5272 - DNA, 23 bp, Homo sapiens
agccagaaacccgcctgtacagg

SEQ ID NO: 5273 - DNA, 23 bp, Homo sapiens
acaagaagacctcatgagagagg

SEQ ID NO: 5274 - DNA, 23 bp, Homo sapiens
aaggccgccaggcactgagctgg

SEQ ID NO: 5275 - DNA, 23 bp, Homo sapiens
tgctgcctggaatcttctaaggg

SEQ ID NO: 5276 - DNA, 23 bp, Homo sapiens
aggctgatgcagtgcccagacgg

SEQ ID NO: 5277 - DNA, 23 bp, Homo sapiens
ggatacatcagcgtttgtcttgg

SEQ ID NO: 5278 - DNA, 23 bp, Homo sapiens
acctgccctggccaccgctcagg

SEQ ID NO: 5279 - DNA, 23 bp, Homo sapiens
tctgatgtccaggaggagaaagg

SEQ ID NO: 5280 - DNA, 23 bp, Homo sapiens
tggacatcagagagaacacctgg

SEQ ID NO: 5281 - DNA, 23 bp, Homo sapiens
acttgatgtgtttcccctcctgg

SEQ ID NO: 5282 - DNA, 23 bp, Homo sapiens
cgcttagcggaggagctactggg

SEQ ID NO: 5283 - DNA, 23 bp, Homo sapiens
ggagcagatcatcggaggtgagg

SEQ ID NO: 5284 - DNA, 23 bp, Homo sapiens
tgagaagaacgaggactgagcgg

SEQ ID NO: 5285 - DNA, 23 bp, Homo sapiens
gttagaacttgctagtgtagagg

SEQ ID NO: 5286 - DNA, 23 bp, Homo sapiens
ccagatgaggcccacggagcagg

SEQ ID NO: 5287 - DNA, 23 bp, Homo sapiens
gctggctcagacatttaaatagg

SEQ ID NO: 5288 - DNA, 23 bp, Homo sapiens
ctttcctcctctacaaacaaggg

SEQ ID NO: 5289 - DNA, 23 bp, Homo sapiens
gacttcctccctggctgtgaagg

SEQ ID NO: 5290 - DNA, 23 bp, Homo sapiens
ggcctgagggttaggagagctgg

SEQ ID NO: 5291 - DNA, 23 bp, Homo sapiens
agtggtccagatgtcagaagtgg

SEQ ID NO: 5292 - DNA, 23 bp, Homo sapiens
ccaggcccaggagcctgaggggg

SEQ ID NO: 5293 - DNA, 23 bp, Homo sapiens
ctactccactcggctctgagagg

SEQ ID NO: 5294 - DNA, 23 bp, Homo sapiens
gcatgaacactttcaaagggcgg

SEQ ID NO: 5295 - DNA, 23 bp, Homo sapiens
agctggcatcttcagagcacagg

SEQ ID NO: 5296 - DNA, 23 bp, Homo sapiens
ggctgtctcccggtcctcagagg

SEQ ID NO: 5297 - DNA, 23 bp, Homo sapiens
ggctgtctccgggtcctcagagg

SEQ ID NO: 5298 - DNA, 23 bp, Homo sapiens
ctggatggacaaggaaaaagagg

SEQ ID NO: 5299 - DNA, 23 bp, Homo sapiens
cgctggagctggagcttgacagg

SEQ ID NO: 5300 - DNA, 23 bp, Homo sapiens
tgagaactttaagagtggtgtgg

SEQ ID NO: 5301 - DNA, 23 bp, Homo sapiens
gtcagagtactaggagttcttgg

SEQ ID NO: 5302 - DNA, 23 bp, Homo sapiens
agctcaatgtcccggaggagggg

SEQ ID NO: 5303 - DNA, 23 bp, Homo sapiens
ttagctgagtcacactgccttgg

SEQ ID NO: 5304 - DNA, 23 bp, Homo sapiens
atcctgagacaggatatcacagg

SEQ ID NO: 5305 - DNA, 23 bp, Homo sapiens
caaaagtcatcatcaagcgaagg

SEQ ID NO: 5306 - DNA, 23 bp, Homo sapiens
tcagtactgtgaatattccttgg

SEQ ID NO: 5307 - DNA, 23 bp, Homo sapiens
gcaaaacacgagaagagctaggg

SEQ ID NO: 5308 - DNA, 23 bp, Homo sapiens
aatgacagctatctttacagggg

SEQ ID NO: 5309 - DNA, 23 bp, Homo sapiens
gcgcacatcaaagctgccacagg

SEQ ID NO: 5310 - DNA, 23 bp, Homo sapiens
tgtgtttgctggggagtcactgg

SEQ ID NO: 5311 - DNA, 23 bp, Homo sapiens
tcctggggcggctcagtttctgg

SEQ ID NO: 5312 - DNA, 23 bp, Homo sapiens
cggaagcagcacgtgtgagctgg

SEQ ID NO: 5313 - DNA, 23 bp, Homo sapiens
tagctgtgggctcctctcacggg

SEQ ID NO: 5314 - DNA, 23 bp, Homo sapiens
gtcagctgtaatatccatcctgg

SEQ ID NO: 5315 - DNA, 23 bp, Homo sapiens
gcagccaggtttctggtcagtgg

SEQ ID NO: 5316 - DNA, 23 bp, Homo sapiens
cctcagctcacagaccaaagcgg

SEQ ID NO: 5317 - DNA, 23 bp, Homo sapiens
cgaaaggaaacaggctaaggtgg

SEQ ID NO: 5318 - DNA, 23 bp, Homo sapiens
tcacaattgtgctgatgatccgg

SEQ ID NO: 5319 - DNA, 23 bp, Homo sapiens
agcaatgaggtggtcagtccagg

SEQ ID NO: 5320 - DNA, 23 bp, Homo sapiens
acaaactgctcatcactgtctgg

SEQ ID NO: 5321 - DNA, 23 bp, Homo sapiens
agctttccgacggcgctgaaagg

SEQ ID NO: 5322 - DNA, 23 bp, Homo sapiens
cctgggctgtcactcaatcttgg

SEQ ID NO: 5323 - DNA, 23 bp, Homo sapiens
tttgaacaaagaactgggactgg

SEQ ID NO: 5324 - DNA, 23 bp, Homo sapiens
ggacagggaagaggaggtggcgg

SEQ ID NO: 5325 - DNA, 23 bp, Homo sapiens
cctacctgcgtgaggattgaggg

SEQ ID NO: 5326 - DNA, 23 bp, Homo sapiens
cagagatgtgactgcacacccgg

SEQ ID NO: 5327 - DNA, 23 bp, Homo sapiens
gttggccgtgcaagctaatgtgg

SEQ ID NO: 5328 - DNA, 23 bp, Homo sapiens
tagatgagatagctccattgtgg

SEQ ID NO: 5329 - DNA, 23 bp, Homo sapiens
tccaagatcagctacataaacgg

SEQ ID NO: 5330 - DNA, 23 bp, Homo sapiens
aagctcgtaatcttgccagcagg

SEQ ID NO: 5331 - DNA, 23 bp, Homo sapiens
atgaaaacactgtgagaaagtgg

SEQ ID NO: 5332 - DNA, 23 bp, Homo sapiens
tggttacaaactttcagaacagg

SEQ ID NO: 5333 - DNA, 23 bp, Homo sapiens
agagtcactgtggaagtagtagg

SEQ ID NO: 5334 - DNA, 23 bp, Homo sapiens
taaaaagcggtttcagctattgg

SEQ ID NO: 5335 - DNA, 23 bp, Homo sapiens
aaagctgcaactcccagtcctgg

SEQ ID NO: 5336 - DNA, 23 bp, Homo sapiens
ccggggcgtctaggcctgcgagg

SEQ ID NO: 5337 - DNA, 23 bp, Homo sapiens
cggctttctgggtggaggtgagg

SEQ ID NO: 5338 - DNA, 23 bp, Homo sapiens
aatgtccacctcttcattactgg

SEQ ID NO: 5339 - DNA, 23 bp, Homo sapiens
ctacatggattcaacgcagaagg

SEQ ID NO: 5340 - DNA, 23 bp, Homo sapiens
gttgctcatatctgtttcacagg

SEQ ID NO: 5341 - DNA, 23 bp, Homo sapiens
aggccactggtgctgaattttgg

SEQ ID NO: 5342 - DNA, 23 bp, Homo sapiens
aacatttgggagtttatgcaagg

SEQ ID NO: 5343 - DNA, 23 bp, Homo sapiens
gaaaagctccacagttaatctgg

SEQ ID NO: 5344 - DNA, 23 bp, Homo sapiens
gcccatgtcactggtcagcgtgg

SEQ ID NO: 5345 - DNA, 23 bp, Homo sapiens
cgcccgctggttctcaatttcgg

SEQ ID NO: 5346 - DNA, 23 bp, Homo sapiens
tggcagtcagagaaggtaggggg

SEQ ID NO: 5347 - DNA, 23 bp, Homo sapiens
ccccggcacggcctatggttcgg

SEQ ID NO: 5348 - DNA, 23 bp, Homo sapiens
gtgctgcgctcacatgttgtagg

SEQ ID NO: 5349 - DNA, 23 bp, Homo sapiens
tgaagtttgtctacagaggcagg

SEQ ID NO: 5350 - DNA, 23 bp, Homo sapiens
ccagttagaccccatctacgtgg

SEQ ID NO: 5351 - DNA, 23 bp, Homo sapiens
gagacgagactacatgttgtagg

SEQ ID NO: 5352 - DNA, 23 bp, Homo sapiens
gggcgttccgggctcacatgagg

SEQ ID NO: 5353 - DNA, 23 bp, Homo sapiens
gcaagtgcgtgatcatgtgaagg

SEQ ID NO: 5354 - DNA, 23 bp, Homo sapiens
cttgtcaagcagcttctcagtgg

SEQ ID NO: 5355 - DNA, 23 bp, Homo sapiens
cagggcattgtaattaggtaagg

SEQ ID NO: 5356 - DNA, 23 bp, Homo sapiens
tgacagactctatcttgatgtgg

SEQ ID NO: 5357 - DNA, 23 bp, Homo sapiens
acttcaaacatggaccttaatgg

SEQ ID NO: 5358 - DNA, 23 bp, Homo sapiens
gatacgggacctagctctcctgg

SEQ ID NO: 5359 - DNA, 23 bp, Homo sapiens
ggcggctggtggagctcagctgg

SEQ ID NO: 5360 - DNA, 23 bp, Homo sapiens
tagctcaggtgaaagccatttgg

SEQ ID NO: 5361 - DNA, 23 bp, Homo sapiens
tgcttcttcaaatctgcaactgg

SEQ ID NO: 5362 - DNA, 23 bp, Homo sapiens
gagaaaccggaggcagatggagg

SEQ ID NO: 5363 - DNA, 23 bp, Homo sapiens
gtccacgaagcacaagcctgagg

SEQ ID NO: 5364 - DNA, 23 bp, Homo sapiens
agaagtcagcaacttgcctgagg

SEQ ID NO: 5365 - DNA, 23 bp, Homo sapiens
ggtatgcaaagtgagatgactgg

SEQ ID NO: 5366 - DNA, 23 bp, Homo sapiens
atgatctaatctcctcggtgagg

SEQ ID NO: 5367 - DNA, 23 bp, Homo sapiens
aaagaattattgtaggggccagg

SEQ ID NO: 5368 - DNA, 23 bp, Homo sapiens
aaatcagcagtacctccttatgg

SEQ ID NO: 5369 - DNA, 23 bp, Homo sapiens
aacaagtactcactgctgagtgg

SEQ ID NO: 5370 - DNA, 23 bp, Homo sapiens
aagaataaactgtgcaggtaagg

SEQ ID NO: 5371 - DNA, 23 bp, Homo sapiens
agttgtgcactacctaccatagg

SEQ ID NO: 5372 - DNA, 23 bp, Homo sapiens
cagagccaccggaaaccataagg

SEQ ID NO: 5373 - DNA, 23 bp, Homo sapiens
gagtttggttcaggatgtcgagg

SEQ ID NO: 5374 - DNA, 23 bp, Homo sapiens
gcctctcatcttctacagacagg

SEQ ID NO: 5375 - DNA, 23 bp, Homo sapiens
gctgagaaaccggaggcagatgg

SEQ ID NO: 5376 - DNA, 23 bp, Homo sapiens
ggtctttagccgtccagaaatgg

SEQ ID NO: 5377 - DNA, 23 bp, Homo sapiens
tttgggaccatgctccaaatggg

SEQ ID NO: 5378 - DNA, 23 bp, Homo sapiens
ttaacacactcggaactttctgg

SEQ ID NO: 5379 - DNA, 23 bp, Homo sapiens
tcaggctatagcagctgaggggg

SEQ ID NO: 5380 - DNA, 23 bp, Homo sapiens
gcaggggcctccctatagcccgg

SEQ ID NO: 5381 - DNA, 23 bp, Homo sapiens
cttggcattaattctctccatgg

SEQ ID NO: 5382 - DNA, 23 bp, Homo sapiens
tttcagaggccacagttacctgg

SEQ ID NO: 5383 - DNA, 23 bp, Homo sapiens
agtatgttgactacaggtgaggg

SEQ ID NO: 5384 - DNA, 23 bp, Homo sapiens
cttcttcttcttcttcttggtgg

SEQ ID NO: 5385 - DNA, 23 bp, Homo sapiens
atcaagccagtaattcttctagg

SEQ ID NO: 5386 - DNA, 23 bp, Homo sapiens
tttctgacacacatggagtctgg

SEQ ID NO: 5387 - DNA, 23 bp, Homo sapiens
cgccgctgcactgctgggagggg

SEQ ID NO: 5388 - DNA, 23 bp, Homo sapiens
tcgagcatgctgccgattgctgg

SEQ ID NO: 5389 - DNA, 23 bp, Homo sapiens
ggccctctcggcagctgtagggg

SEQ ID NO: 5390 - DNA, 23 bp, Homo sapiens
ttctaaactcagcaagccactgg

SEQ ID NO: 5391 - DNA, 23 bp, Homo sapiens
aggctggtaagttgacattttgg

SEQ ID NO: 5392 - DNA, 23 bp, Homo sapiens
cttcagtgatcacctagatttgg

SEQ ID NO: 5393 - DNA, 23 bp, Homo sapiens
gcaaatcttgctgcgtcatttgg

SEQ ID NO: 5394 - DNA, 23 bp, Homo sapiens
atgttgcctcaccagccctgagg

SEQ ID NO: 5395 - DNA, 23 bp, Homo sapiens
tgtcctcagagctaacataaagg

SEQ ID NO: 5396 - DNA, 23 bp, Homo sapiens
accttcttcactcattagccagg

SEQ ID NO: 5397 - DNA, 23 bp, Homo sapiens
gcctttaacactcatatgtctgg

SEQ ID NO: 5398 - DNA, 23 bp, Homo sapiens
tggttcttacatctgggttccgg

SEQ ID NO: 5399 - DNA, 23 bp, Homo sapiens
tttcatctggattccctcaaagg

SEQ ID NO: 5400 - DNA, 23 bp, Homo sapiens
gggattcttcagagtttttcagg

SEQ ID NO: 5401 - DNA, 23 bp, Homo sapiens
gcaggaatcagagtctctctcgg

SEQ ID NO: 5402 - DNA, 23 bp, Homo sapiens
agcacagcattctcctagagcgg

SEQ ID NO: 5403 - DNA, 23 bp, Homo sapiens
ggctgcggggcgctcagagccgg

SEQ ID NO: 5404 - DNA, 23 bp, Homo sapiens
aaacactggacagtctaaatagg

SEQ ID NO: 5405 - DNA, 23 bp, Homo sapiens
aggcccagacccggctctgaggg

SEQ ID NO: 5406 - DNA, 23 bp, Homo sapiens
ggcccagaccaggctgtgaccgg

SEQ ID NO: 5407 - DNA, 23 bp, Homo sapiens
tcctgcatggtctcagagcctgg

SEQ ID NO: 5408 - DNA, 23 bp, Homo sapiens
ggattactgcagtttagacctgg

SEQ ID NO: 5409 - DNA, 23 bp, Homo sapiens
actttttcacctctacaaccagg

SEQ ID NO: 5410 - DNA, 23 bp, Homo sapiens
cagcaaggaggccggcgacgagg

SEQ ID NO: 5411 - DNA, 23 bp, Homo sapiens
gaaagaccacagcactgtgatgg

SEQ ID NO: 5412 - DNA, 23 bp, Homo sapiens
tgagtgcgtcatagcaactgagg

SEQ ID NO: 5413 - DNA, 23 bp, Homo sapiens
attctgtccgtgaaatgaattgg

SEQ ID NO: 5414 - DNA, 23 bp, Homo sapiens
tccttccatctacgctcgggagg

SEQ ID NO: 5415 - DNA, 23 bp, Homo sapiens
tgaatgtgtcattgccacggagg

SEQ ID NO: 5416 - DNA, 23 bp, Homo sapiens
cctcctcctggatctttaggagg

SEQ ID NO: 5417 - DNA, 23 bp, Homo sapiens
cagtgttccctcttgggattggg

SEQ ID NO: 5418 - DNA, 23 bp, Homo sapiens
cagcaaccccaacttatgtgagg

SEQ ID NO: 5419 - DNA, 23 bp, Homo sapiens
cagggtggggcggctctggaggg

SEQ ID NO: 5420 - DNA, 23 bp, Homo sapiens
ggggcgccccggtgagcgcgggg

SEQ ID NO: 5421 - DNA, 23 bp, Homo sapiens
ggtgctcagtacacagccccagg

SEQ ID NO: 5422 - DNA, 23 bp, Homo sapiens
ccccagattcacatcatctgagg

SEQ ID NO: 5423 - DNA, 23 bp, Homo sapiens
tccgggacactctattagatggg

SEQ ID NO: 5424 - DNA, 23 bp, Homo sapiens
tgggcaactcacatcatctgtgg

SEQ ID NO: 5425 - DNA, 23 bp, Homo sapiens
atggacagacatcactactgtgg

SEQ ID NO: 5426 - DNA, 23 bp, Homo sapiens
ggtggtactttcaaacaacgcgg

SEQ ID NO: 5427 - DNA, 23 bp, Homo sapiens
agcctgagctgaggtctcactgg

SEQ ID NO: 5428 - DNA, 23 bp, Homo sapiens
gacagggctaaaggctaggcagg

SEQ ID NO: 5429 - DNA, 23 bp, Homo sapiens
gtgggagtcgactgggctgaggg

SEQ ID NO: 5430 - DNA, 23 bp, Homo sapiens
gaaagccaagaagccgtgagagg

SEQ ID NO: 5431 - DNA, 23 bp, Homo sapiens
agaagaggagcctcggtaggtgg

SEQ ID NO: 5432 - DNA, 23 bp, Homo sapiens
ttggaagccagacagtcagttgg

SEQ ID NO: 5433 - DNA, 23 bp, Homo sapiens
tggggatgccaaggagtaggtgg

SEQ ID NO: 5434 - DNA, 23 bp, Homo sapiens
ccctggaaagccaatgagagagg

SEQ ID NO: 5435 - DNA, 23 bp, Homo sapiens
tcagtcatgacagatgaagaagg

SEQ ID NO: 5436 - DNA, 23 bp, Homo sapiens
tgtcttagagggggacaacatgg

SEQ ID NO: 5437 - DNA, 23 bp, Homo sapiens
gcttcagaaaaaaggtggaaagg

SEQ ID NO: 5438 - DNA, 23 bp, Homo sapiens
gcagtgggtgaagttttggtagg

SEQ ID NO: 5439 - DNA, 23 bp, Homo sapiens
gctccttgtctggaggtcacggg

SEQ ID NO: 5440 - DNA, 23 bp, Homo sapiens
gctgatgctaatagccgtcttgg

SEQ ID NO: 5441 - DNA, 23 bp, Homo sapiens
cgaagacagttctagggttcagg

SEQ ID NO: 5442 - DNA, 23 bp, Homo sapiens
aggccaggcctagggacctgtgg

SEQ ID NO: 5443 - DNA, 23 bp, Homo sapiens
gttctagggttcagggagcgcgg

SEQ ID NO: 5444 - DNA, 23 bp, Homo sapiens
agtcactcccgtcatcgaggagg

SEQ ID NO: 5445 - DNA, 23 bp, Homo sapiens
cactcgtgtctctcagtgaaagg

SEQ ID NO: 5446 - DNA, 23 bp, Homo sapiens
gttgagtgttctagagtctgagg

SEQ ID NO: 5447 - DNA, 23 bp, Homo sapiens
cattacggattgtcctgatttgg

SEQ ID NO: 5448 - DNA, 23 bp, Homo sapiens
ggcgctccggagaagcagtaggg

SEQ ID NO: 5449 - DNA, 23 bp, Homo sapiens
gggcgggcctggggcctagtcgg

SEQ ID NO: 5450 - DNA, 23 bp, Homo sapiens
atgcatctccctcttgagctagg

SEQ ID NO: 5451 - DNA, 23 bp, Homo sapiens
catctctgggtttctagctcagg

SEQ ID NO: 5452 - DNA, 23 bp, Homo sapiens
ttcaaaggatgtcgaagatttgg

SEQ ID NO: 5453 - DNA, 23 bp, Homo sapiens
agaaggcctctctcttctgatgg

SEQ ID NO: 5454 - DNA, 23 bp, Homo sapiens
caactccccgagtggcacagtgg

SEQ ID NO: 5455 - DNA, 23 bp, Homo sapiens
tttaaagggctaaactgatctgg

SEQ ID NO: 5456 - DNA, 23 bp, Homo sapiens
aaaagcattgggcaaaaccctgg

SEQ ID NO: 5457 - DNA, 23 bp, Homo sapiens
tttgaaagtcacccaatatgtgg

SEQ ID NO: 5458 - DNA, 23 bp, Homo sapiens
ggggaaaactatgatgctttcgg

SEQ ID NO: 5459 - DNA, 23 bp, Homo sapiens
tatgcaggatggtagtgtgcagg

SEQ ID NO: 5460 - DNA, 23 bp, Homo sapiens
gttgggtcagactccagttttgg

SEQ ID NO: 5461 - DNA, 23 bp, Homo sapiens
aggcctacaggattatgaagcgg

SEQ ID NO: 5462 - DNA, 23 bp, Homo sapiens
tgtatacgtgcaggtcactaggg

SEQ ID NO: 5463 - DNA, 23 bp, Homo sapiens
aaaccagcgtggtcactgtgtgg

SEQ ID NO: 5464 - DNA, 23 bp, Homo sapiens
ctgtctgagtctagtagtccagg

SEQ ID NO: 5465 - DNA, 23 bp, Homo sapiens
gttaatcagaattcagggtgagg

SEQ ID NO: 5466 - DNA, 23 bp, Homo sapiens
gctctgcttctagaagcgtaagg

SEQ ID NO: 5467 - DNA, 23 bp, Homo sapiens
gctggattgctgggtggtatggg

SEQ ID NO: 5468 - DNA, 23 bp, Homo sapiens
tgtcagttggatgactaaattgg

SEQ ID NO: 5469 - DNA, 23 bp, Homo sapiens
agggatttaggacttttccgagg

SEQ ID NO: 5470 - DNA, 23 bp, Homo sapiens
atattttctgatttccggtgagg

SEQ ID NO: 5471 - DNA, 23 bp, Homo sapiens
tagtcactggatcacaatgcggg

SEQ ID NO: 5472 - DNA, 23 bp, Homo sapiens
tgctggaatgccattttcagtgg

SEQ ID NO: 5473 - DNA, 23 bp, Homo sapiens
caggagcgagctaaacctgtagg

SEQ ID NO: 5474 - DNA, 23 bp, Homo sapiens
cgcctgagcccgggaggcagagg

SEQ ID NO: 5475 - DNA, 23 bp, Homo sapiens
ggaggaggtctcagctgtccagg

SEQ ID NO: 5476 - DNA, 23 bp, Homo sapiens
tgtgccagctggataactgatgg

SEQ ID NO: 5477 - DNA, 23 bp, Homo sapiens
gttacttgacatcacacagaagg

SEQ ID NO: 5478 - DNA, 23 bp, Homo sapiens
tgccagctgagcgaatgaaaagg

SEQ ID NO: 5479 - DNA, 23 bp, Homo sapiens
aaggaacactggattggacgagg

SEQ ID NO: 5480 - DNA, 23 bp, Homo sapiens
tcactggatcctgagaggagtgg

SEQ ID NO: 5481 - DNA, 23 bp, Homo sapiens
gctctgcaggatgctaaatctgg

SEQ ID NO: 5482 - DNA, 23 bp, Homo sapiens
agtgaaaatcaagacctgagggg

SEQ ID NO: 5483 - DNA, 23 bp, Homo sapiens
ggaagaaggggatgaagaagtgg

SEQ ID NO: 5484 - DNA, 23 bp, Homo sapiens
tcagtgtcagacctcttaatggg

SEQ ID NO: 5485 - DNA, 23 bp, Homo sapiens
ttgtttgcagagtttactgatgg

SEQ ID NO: 5486 - DNA, 23 bp, Homo sapiens
agatccactggaaactaggccgg

SEQ ID NO: 5487 - DNA, 23 bp, Homo sapiens
gaggctggggaggacgaggaggg

SEQ ID NO: 5488 - DNA, 23 bp, Homo sapiens
cagtgccagacggcatgacgtgg

SEQ ID NO: 5489 - DNA, 23 bp, Homo sapiens
gggagctcagatagctatattgg

SEQ ID NO: 5490 - DNA, 23 bp, Homo sapiens
aaggtatacaatggactgcaagg

SEQ ID NO: 5491 - DNA, 23 bp, Homo sapiens
tggcccaggactatccatgcagg

SEQ ID NO: 5492 - DNA, 23 bp, Homo sapiens
acagtcatgtcagcaatgcctgg

SEQ ID NO: 5493 - DNA, 23 bp, Homo sapiens
cggcttaccagtctttataaagg

SEQ ID NO: 5494 - DNA, 23 bp, Homo sapiens
tataccaaagaccaagtagatgg

SEQ ID NO: 5495 - DNA, 23 bp, Homo sapiens
aggttgggcccggtgttcagagg

SEQ ID NO: 5496 - DNA, 23 bp, Homo sapiens
tccagctcagaacacatctgcgg

SEQ ID NO: 5497 - DNA, 23 bp, Homo sapiens
agggtggaagtggaggaagatgg

SEQ ID NO: 5498 - DNA, 23 bp, Homo sapiens
agttcttcattctatgaggcagg

SEQ ID NO: 5499 - DNA, 23 bp, Homo sapiens
gcagcacctaccctgttcctagg

SEQ ID NO: 5500 - DNA, 23 bp, Homo sapiens
accaaaggcaatcactagaccgg

SEQ ID NO: 5501 - DNA, 23 bp, Homo sapiens
taaggagcagctgctgcgcttgg

SEQ ID NO: 5502 - DNA, 23 bp, Homo sapiens
tgcaaaagaagtctaccaaaagg

SEQ ID NO: 5503 - DNA, 23 bp, Homo sapiens
caaatggatggacagcaagtagg

SEQ ID NO: 5504 - DNA, 23 bp, Homo sapiens
actacatacactgactgttcagg

SEQ ID NO: 5505 - DNA, 23 bp, Homo sapiens
gtacaagttgctggttgaactgg

SEQ ID NO: 5506 - DNA, 23 bp, Homo sapiens
aaatcaaggcaagaggaataagg

SEQ ID NO: 5507 - DNA, 23 bp, Homo sapiens
atccatctgtatcgatcctgtgg

SEQ ID NO: 5508 - DNA, 23 bp, Homo sapiens
aagacggtgggtttctcgctggg

SEQ ID NO: 5509 - DNA, 23 bp, Homo sapiens
catagtttctgaacttcctcagg

SEQ ID NO: 5510 - DNA, 23 bp, Homo sapiens
tatttcaagtctgatagccaagg

SEQ ID NO: 5511 - DNA, 23 bp, Homo sapiens
aagagaaggggcatcaacgttgg

SEQ ID NO: 5512 - DNA, 23 bp, Homo sapiens
ggtccttaagcatcaatgtttgg

SEQ ID NO: 5513 - DNA, 23 bp, Homo sapiens
atggcctgaactagactgagagg

SEQ ID NO: 5514 - DNA, 23 bp, Homo sapiens
ggctggagctggggctacgtagg

SEQ ID NO: 5515 - DNA, 23 bp, Homo sapiens
cctacgcagaggtggctgagagg

SEQ ID NO: 5516 - DNA, 23 bp, Homo sapiens
taaggagatcctcctttgtcagg

SEQ ID NO: 5517 - DNA, 23 bp, Homo sapiens
ggactgcatgaaacgatacaagg

SEQ ID NO: 5518 - DNA, 23 bp, Homo sapiens
aggtgctcttgcatgacctgtgg

SEQ ID NO: 5519 - DNA, 23 bp, Homo sapiens
gggaagtttcttttcacctccgg

SEQ ID NO: 5520 - DNA, 23 bp, Homo sapiens
cagtgtttccaaggatgaagcgg

SEQ ID NO: 5521 - DNA, 23 bp, Homo sapiens
gcctgggcggttaacatttgtgg

SEQ ID NO: 5522 - DNA, 23 bp, Homo sapiens
aggcattaatgagatgttccagg

SEQ ID NO: 5523 - DNA, 23 bp, Homo sapiens
tctacttgatgtttttcaggagg

SEQ ID NO: 5524 - DNA, 23 bp, Homo sapiens
aataaccttgatcaaggagaagg

SEQ ID NO: 5525 - DNA, 23 bp, Homo sapiens
ttcaatcccttcagctcaggcgg

SEQ ID NO: 5526 - DNA, 23 bp, Homo sapiens
ggaaaatggcagccgtgtctcgg

SEQ ID NO: 5527 - DNA, 23 bp, Homo sapiens
agcaggagcgacaacggctaggg

SEQ ID NO: 5528 - DNA, 23 bp, Homo sapiens
catccaggtgagcccctcagggg

SEQ ID NO: 5529 - DNA, 23 bp, Homo sapiens
accccagctaccacactgacggg

SEQ ID NO: 5530 - DNA, 23 bp, Homo sapiens
tctcatttgcatttgtaggctgg

SEQ ID NO: 5531 - DNA, 23 bp, Homo sapiens
cagagtcagcctccaaggtcagg

SEQ ID NO: 5532 - DNA, 23 bp, Homo sapiens
aatataagggcttttggccttgg

SEQ ID NO: 5533 - DNA, 23 bp, Homo sapiens
gcattctttggcggtcctggcgg

SEQ ID NO: 5534 - DNA, 23 bp, Homo sapiens
gagaccaccgaaagtaaaaatgg

SEQ ID NO: 5535 - DNA, 23 bp, Homo sapiens
gcaaatcttccaaaggaggaggg

SEQ ID NO: 5536 - DNA, 23 bp, Homo sapiens
tccagtaattaaaggggatgagg

SEQ ID NO: 5537 - DNA, 23 bp, Homo sapiens
gcaccctggctgtgtgcgtctgg

SEQ ID NO: 5538 - DNA, 23 bp, Homo sapiens
gtgcaataatgccttccagttgg

SEQ ID NO: 5539 - DNA, 23 bp, Homo sapiens
cacttcagcatcacctccactgg

SEQ ID NO: 5540 - DNA, 23 bp, Homo sapiens
tagggggacgctcaggcagcagg

SEQ ID NO: 5541 - DNA, 23 bp, Homo sapiens
ccagccaggcctcgagtcatcgg

SEQ ID NO: 5542 - DNA, 23 bp, Homo sapiens
agtgacagattttttgctgttgg

SEQ ID NO: 5543 - DNA, 23 bp, Homo sapiens
ttagatcttataagctctgctgg

SEQ ID NO: 5544 - DNA, 23 bp, Homo sapiens
caccaagccttcagaagtggagg

SEQ ID NO: 5545 - DNA, 23 bp, Homo sapiens
atggagtcactgtttaaccatgg

SEQ ID NO: 5546 - DNA, 23 bp, Homo sapiens
agttttaatcagtgtgaccaagg

SEQ ID NO: 5547 - DNA, 23 bp, Homo sapiens
gccttgcaggtattctgaattgg

SEQ ID NO: 5548 - DNA, 23 bp, Homo sapiens
ttggtagacgggctcaagacagg

SEQ ID NO: 5549 - DNA, 23 bp, Homo sapiens
ggggagcgcaggagtcagctcgg

SEQ ID NO: 5550 - DNA, 23 bp, Homo sapiens
aagaggagggatctgtttagagg

SEQ ID NO: 5551 - DNA, 23 bp, Homo sapiens
atcactatcagtgacccctgagg

SEQ ID NO: 5552 - DNA, 23 bp, Homo sapiens
ccatggctgacgctcctcagggg

SEQ ID NO: 5553 - DNA, 23 bp, Homo sapiens
aaatccgggagactcatctttgg

SEQ ID NO: 5554 - DNA, 23 bp, Homo sapiens
cgagccatccctgctcgactagg

SEQ ID NO: 5555 - DNA, 23 bp, Homo sapiens
atgaatgatgggggttaggatgg

SEQ ID NO: 5556 - DNA, 23 bp, Homo sapiens
gacacttcgtttagtctaacagg

SEQ ID NO: 5557 - DNA, 23 bp, Homo sapiens
ttactgcggaaagcttgtcctgg

SEQ ID NO: 5558 - DNA, 23 bp, Homo sapiens
aacgtgggctcaggtgtactcgg

SEQ ID NO: 5559 - DNA, 23 bp, Homo sapiens
aaaggaggaggaagctgctaagg

SEQ ID NO: 5560 - DNA, 23 bp, Homo sapiens
agtattttgcgtgtgtgtaaggg

SEQ ID NO: 5561 - DNA, 23 bp, Homo sapiens
ccctgactctcagggtatgctgg

SEQ ID NO: 5562 - DNA, 23 bp, Homo sapiens
catgcaaagtagtccttcagagg

SEQ ID NO: 5563 - DNA, 23 bp, Homo sapiens
aaagcagttcttcaccagcttgg

SEQ ID NO: 5564 - DNA, 23 bp, Homo sapiens
tctaagccataatctcttagtgg

SEQ ID NO: 5565 - DNA, 23 bp, Homo sapiens
cgcggtgctcagagcccaccagg

SEQ ID NO: 5566 - DNA, 23 bp, Homo sapiens
gtgagattaagtcaagtggttgg

SEQ ID NO: 5567 - DNA, 23 bp, Homo sapiens
accgtgggaaagaaatgcctagg

SEQ ID NO: 5568 - DNA, 23 bp, Homo sapiens
gaagcacctccacagacctgagg

SEQ ID NO: 5569 - DNA, 23 bp, Homo sapiens
gaaaaagcagcaaatgcagcagg

SEQ ID NO: 5570 - DNA, 23 bp, Homo sapiens
ggctctgtcctcagcctgagtgg

SEQ ID NO: 5571 - DNA, 23 bp, Homo sapiens
cagtcgctgagcacagcccctgg

SEQ ID NO: 5572 - DNA, 23 bp, Homo sapiens
gcgacgtcactgcacgatcccgg

SEQ ID NO: 5573 - DNA, 23 bp, Homo sapiens
catctagtgctgaagtctgaggg

SEQ ID NO: 5574 - DNA, 23 bp, Homo sapiens
ccaagatacgctgaagtgtgagg

SEQ ID NO: 5575 - DNA, 23 bp, Homo sapiens
cctagtcagcagcagctcacagg

SEQ ID NO: 5576 - DNA, 23 bp, Homo sapiens
cggccgaggggagcagtgagggg

SEQ ID NO: 5577 - DNA, 23 bp, Homo sapiens
cttataactgagagaccttgcgg

SEQ ID NO: 5578 - DNA, 23 bp, Homo sapiens
agggagggcaagatccttactgg

SEQ ID NO: 5579 - DNA, 23 bp, Homo sapiens
ccccacaataccgaaatccatgg

SEQ ID NO: 5580 - DNA, 23 bp, Homo sapiens
tttggtccttgtgggctcagagg

SEQ ID NO: 5581 - DNA, 23 bp, Homo sapiens
gcatcttctcacttctttcatgg

SEQ ID NO: 5582 - DNA, 23 bp, Homo sapiens
tcgaatgagccttcgcaaaatgg

SEQ ID NO: 5583 - DNA, 23 bp, Homo sapiens
tgtgaaacccagttgtcacaggg

SEQ ID NO: 5584 - DNA, 23 bp, Homo sapiens
caactacagggaaatggcgaagg

SEQ ID NO: 5585 - DNA, 23 bp, Homo sapiens
gtgacacgttcaccaactattgg

SEQ ID NO: 5586 - DNA, 23 bp, Homo sapiens
ggtgagggtggggccctaggagg

SEQ ID NO: 5587 - DNA, 23 bp, Homo sapiens
tcagagggctctacctgagaagg

SEQ ID NO: 5588 - DNA, 23 bp, Homo sapiens
ctctgctgcctctgtcactttgg

SEQ ID NO: 5589 - DNA, 23 bp, Homo sapiens
atgaggttcaggatgtgccaagg

SEQ ID NO: 5590 - DNA, 23 bp, Homo sapiens
ctctgctgggcgttcagggccgg

SEQ ID NO: 5591 - DNA, 23 bp, Homo sapiens
ctcgccagcactgtggtcactgg

SEQ ID NO: 5592 - DNA, 23 bp, Homo sapiens
ctgtcagtgctcagatctgtagg

SEQ ID NO: 5593 - DNA, 23 bp, Homo sapiens
tcaagccagattcttgaaaaagg

SEQ ID NO: 5594 - DNA, 23 bp, Homo sapiens
agcggctctctgtgtgtcattgg

SEQ ID NO: 5595 - DNA, 23 bp, Homo sapiens
gggatctgcggctctcaaggagg

SEQ ID NO: 5596 - DNA, 23 bp, Homo sapiens
cctggggggcctccatcaccagg

SEQ ID NO: 5597 - DNA, 23 bp, Homo sapiens
ctggcgctgtgacctcactgcgg

SEQ ID NO: 5598 - DNA, 23 bp, Homo sapiens
ctacctcctgatattgctgatgg

SEQ ID NO: 5599 - DNA, 23 bp, Homo sapiens
ggaacagacaacgcaagctgggg

SEQ ID NO: 5600 - DNA, 23 bp, Homo sapiens
tggtttgcaccctaacactctgg

SEQ ID NO: 5601 - DNA, 23 bp, Homo sapiens
aaccatgttccagcaaagccagg

SEQ ID NO: 5602 - DNA, 23 bp, Homo sapiens
ctctcacatggttaacattctgg

SEQ ID NO: 5603 - DNA, 23 bp, Homo sapiens
gtggcaggcggcacagttggagg

SEQ ID NO: 5604 - DNA, 23 bp, Homo sapiens
tcgaacgagctgatatcgaatgg

SEQ ID NO: 5605 - DNA, 23 bp, Homo sapiens
ggcgtgggcaaagctcagcaagg

SEQ ID NO: 5606 - DNA, 23 bp, Homo sapiens
aaggctcaggggccaactactgg

SEQ ID NO: 5607 - DNA, 23 bp, Homo sapiens
gcctcctctgggatgggacatgg

SEQ ID NO: 5608 - DNA, 23 bp, Homo sapiens
gtgtctatctagatcaggaatgg

SEQ ID NO: 5609 - DNA, 23 bp, Homo sapiens
cgcctactccaagatcaccgtgg

SEQ ID NO: 5610 - DNA, 23 bp, Homo sapiens
tctggtctcccaggtttcacagg

SEQ ID NO: 5611 - DNA, 23 bp, Homo sapiens
ccttcccagtccttattctgtgg

SEQ ID NO: 5612 - DNA, 23 bp, Homo sapiens
gactgtgtcagcagagccactgg

SEQ ID NO: 5613 - DNA, 23 bp, Homo sapiens
tacatcaccctcacctaggccgg

SEQ ID NO: 5614 - DNA, 23 bp, Homo sapiens
aaccagaactcctcttgatgtgg

SEQ ID NO: 5615 - DNA, 23 bp, Homo sapiens
agcctttggctgccaggcctagg

SEQ ID NO: 5616 - DNA, 23 bp, Homo sapiens
tcgcccacagcagataaaaaggg

SEQ ID NO: 5617 - DNA, 23 bp, Homo sapiens
ggagcgcgtcaaggagccagcgg

SEQ ID NO: 5618 - DNA, 23 bp, Homo sapiens
gcctatgaggatgagggaagcgg

SEQ ID NO: 5619 - DNA, 23 bp, Homo sapiens
actaattctttgttggctgaagg

SEQ ID NO: 5620 - DNA, 23 bp, Homo sapiens
cttagtactgcagcaaaagaagg

SEQ ID NO: 5621 - DNA, 23 bp, Homo sapiens
actcattctttgttgactgaagg

SEQ ID NO: 5622 - DNA, 23 bp, Homo sapiens
tcagaatctcaaagcatcaatgg

SEQ ID NO: 5623 - DNA, 23 bp, Homo sapiens
ttagatgttctgtagttgtcagg

SEQ ID NO: 5624 - DNA, 23 bp, Homo sapiens
gcaatctcactgataaaaggagg

SEQ ID NO: 5625 - DNA, 23 bp, Homo sapiens
attgctggatgaaagactagcgg

SEQ ID NO: 5626 - DNA, 23 bp, Homo sapiens
ctcaactgccaaaaggcaatggg

SEQ ID NO: 5627 - DNA, 23 bp, Homo sapiens
tccacctctgggagtgggagggg

SEQ ID NO: 5628 - DNA, 23 bp, Homo sapiens
tatggtgaatccaagttgggagg

SEQ ID NO: 5629 - DNA, 23 bp, Homo sapiens
tgaccaagaaggctcagtgaagg

SEQ ID NO: 5630 - DNA, 23 bp, Homo sapiens
gtcagaagcgcagccccctgcgg

SEQ ID NO: 5631 - DNA, 23 bp, Homo sapiens
gatacgttatgaccttcatctgg

SEQ ID NO: 5632 - DNA, 23 bp, Homo sapiens
tcatcttcttctggttcctgtgg

SEQ ID NO: 5633 - DNA, 23 bp, Homo sapiens
gccccatctggccaagcttgagg

SEQ ID NO: 5634 - DNA, 23 bp, Homo sapiens
gttttatgaagtggctcatgtgg

SEQ ID NO: 5635 - DNA, 23 bp, Homo sapiens
cagaggctgcaaggctcactcgg

SEQ ID NO: 5636 - DNA, 23 bp, Homo sapiens
agcgaaagaggacgaggaggagg

SEQ ID NO: 5637 - DNA, 23 bp, Homo sapiens
ccctccagtcctgtgctcagagg

SEQ ID NO: 5638 - DNA, 23 bp, Homo sapiens
gagcagcaatacgtgatccaagg

SEQ ID NO: 5639 - DNA, 23 bp, Homo sapiens
ctcccggtgggcaggctcagagg

SEQ ID NO: 5640 - DNA, 23 bp, Homo sapiens
tctacagctggcacttgagtggg

SEQ ID NO: 5641 - DNA, 23 bp, Homo sapiens
tatgccccgactgtgctaagagg

SEQ ID NO: 5642 - DNA, 23 bp, Homo sapiens
gatttatggctgaagtggcttgg

SEQ ID NO: 5643 - DNA, 23 bp, Homo sapiens
aacatattgtcttcaaggtgcgg

SEQ ID NO: 5644 - DNA, 23 bp, Homo sapiens
tcctgatattctattcccattgg

SEQ ID NO: 5645 - DNA, 23 bp, Homo sapiens
aaactggttcacttcatccaagg

SEQ ID NO: 5646 - DNA, 23 bp, Homo sapiens
tttatcatctctctcgactttgg

SEQ ID NO: 5647 - DNA, 23 bp, Homo sapiens
cacagtcgtattcagtcatccgg

SEQ ID NO: 5648 - DNA, 23 bp, Homo sapiens
ggactttgtaaacactgttctgg

SEQ ID NO: 5649 - DNA, 23 bp, Homo sapiens
tgaaatactgtggtgaagtaagg

SEQ ID NO: 5650 - DNA, 23 bp, Homo sapiens
aaatctgcgctacttgtttctgg

SEQ ID NO: 5651 - DNA, 23 bp, Homo sapiens
atatgggcgattttgtcatgagg

SEQ ID NO: 5652 - DNA, 23 bp, Homo sapiens
agaaattcaatgggatttggtgg

SEQ ID NO: 5653 - DNA, 23 bp, Homo sapiens
gtgcttgcaaaggaaagatgagg

SEQ ID NO: 5654 - DNA, 23 bp, Homo sapiens
gagggacccattaatattggtgg

SEQ ID NO: 5655 - DNA, 23 bp, Homo sapiens
tctgtgaatccggtgtgttaagg

SEQ ID NO: 5656 - DNA, 23 bp, Homo sapiens
accgatggcacacacttcagggg

SEQ ID NO: 5657 - DNA, 23 bp, Homo sapiens
cagcccaggagctctagcccagg

SEQ ID NO: 5658 - DNA, 23 bp, Homo sapiens
gtgatattagaacggccgcctgg

SEQ ID NO: 5659 - DNA, 23 bp, Homo sapiens
cctgggcgtctaggagagagagg

SEQ ID NO: 5660 - DNA, 23 bp, Homo sapiens
ggtcgagtggcatttggtaaagg

SEQ ID NO: 5661 - DNA, 23 bp, Homo sapiens
ataggcaggcaggtcactgcagg

SEQ ID NO: 5662 - DNA, 23 bp, Homo sapiens
taatcaggcgggatcttctcagg

SEQ ID NO: 5663 - DNA, 23 bp, Homo sapiens
aggatatccacagaaatcaatgg

SEQ ID NO: 5664 - DNA, 23 bp, Homo sapiens
cgttcattgttaatagggcaagg

SEQ ID NO: 5665 - DNA, 23 bp, Homo sapiens
cccctcagcacctgatgaagagg

SEQ ID NO: 5666 - DNA, 23 bp, Homo sapiens
gatccttcatcaacgtctagcgg

SEQ ID NO: 5667 - DNA, 23 bp, Homo sapiens
cgggtacccacaaaatgagctgg

SEQ ID NO: 5668 - DNA, 23 bp, Homo sapiens
ggctgacattcatctagtctagg

SEQ ID NO: 5669 - DNA, 23 bp, Homo sapiens
ttcaattatgtggaggcttctgg

SEQ ID NO: 5670 - DNA, 23 bp, Homo sapiens
atattttctggagctcccccagg

SEQ ID NO: 5671 - DNA, 23 bp, Homo sapiens
attcatctgcgagttcaggttgg

SEQ ID NO: 5672 - DNA, 23 bp, Homo sapiens
gcaggcagcagagtcagcagtgg

SEQ ID NO: 5673 - DNA, 23 bp, Homo sapiens
tcaagatcctgtcttgctgaggg

SEQ ID NO: 5674 - DNA, 23 bp, Homo sapiens
ctgcgtgcctgctgctgagccgg

SEQ ID NO: 5675 - DNA, 23 bp, Homo sapiens
agtttaatggaatccattcgggg

SEQ ID NO: 5676 - DNA, 23 bp, Homo sapiens
agaccatacgttggaggatgagg

SEQ ID NO: 5677 - DNA, 23 bp, Homo sapiens
aagtacagtccgcagcgggtggg

SEQ ID NO: 5678 - DNA, 23 bp, Homo sapiens
tccagatcgtgaagaagtaacgg

SEQ ID NO: 5679 - DNA, 23 bp, Homo sapiens
tcccaccaaggaacagagcgagg

SEQ ID NO: 5680 - DNA, 23 bp, Homo sapiens
tccacagaagggcttcaccctgg

SEQ ID NO: 5681 - DNA, 23 bp, Homo sapiens
ttgatgtcttcagtctcatctgg

SEQ ID NO: 5682 - DNA, 23 bp, Homo sapiens
ggggatctggctccatcaagagg

SEQ ID NO: 5683 - DNA, 23 bp, Homo sapiens
aatcagagtgtgtcctctaatgg

SEQ ID NO: 5684 - DNA, 23 bp, Homo sapiens
atcacctggaacccaaatttagg

SEQ ID NO: 5685 - DNA, 23 bp, Homo sapiens
ttctgctagtgtcctaaatttgg

SEQ ID NO: 5686 - DNA, 23 bp, Homo sapiens
agtgaaaagcaggaagaagatgg

SEQ ID NO: 5687 - DNA, 23 bp, Homo sapiens
gaatccattagaggacacactgg

SEQ ID NO: 5688 - DNA, 23 bp, Homo sapiens
gtcatgctgtctgttataccagg

SEQ ID NO: 5689 - DNA, 23 bp, Homo sapiens
aaatcctacaccctggtgtaggg

SEQ ID NO: 5690 - DNA, 23 bp, Homo sapiens
tctcattcttcgatgcaaaatgg

SEQ ID NO: 5691 - DNA, 23 bp, Homo sapiens
aagctctgcaggatatagcccgg

SEQ ID NO: 5692 - DNA, 23 bp, Homo sapiens
ttcagtgctaacactgtgattgg

SEQ ID NO: 5693 - DNA, 23 bp, Homo sapiens
tggactctgatggatcgcctagg

SEQ ID NO: 5694 - DNA, 23 bp, Homo sapiens
gtgcaatatagcaagtagtcagg

SEQ ID NO: 5695 - DNA, 23 bp, Homo sapiens
atgctgtacagtgctatgcttgg

SEQ ID NO: 5696 - DNA, 23 bp, Homo sapiens
tcattctggtcatattagacggg

SEQ ID NO: 5697 - DNA, 23 bp, Homo sapiens
gaccataaagcacttactgttgg

SEQ ID NO: 5698 - DNA, 23 bp, Homo sapiens
gccatacatggatctggatctgg

SEQ ID NO: 5699 - DNA, 23 bp, Homo sapiens
agaactactgctaaatgagtagg

SEQ ID NO: 5700 - DNA, 23 bp, Homo sapiens
tctaatcatcactggttgagtgg

SEQ ID NO: 5701 - DNA, 23 bp, Homo sapiens
ccaattgcactatctctttgagg

SEQ ID NO: 5702 - DNA, 23 bp, Homo sapiens
gcctctactattcttcctaatgg

SEQ ID NO: 5703 - DNA, 23 bp, Homo sapiens
tggcactgaataatctacacagg

SEQ ID NO: 5704 - DNA, 23 bp, Homo sapiens
gaatcatctagtcctctgtttgg

SEQ ID NO: 5705 - DNA, 23 bp, Homo sapiens
gggaggcttaggccgaagaatgg

SEQ ID NO: 5706 - DNA, 23 bp, Homo sapiens
gggcgacgtgtcctctgaacggg

SEQ ID NO: 5707 - DNA, 23 bp, Homo sapiens
taagtgtgtgaatggtccgttgg

SEQ ID NO: 5708 - DNA, 23 bp, Homo sapiens
gagagatcaggcttttactcagg

SEQ ID NO: 5709 - DNA, 23 bp, Homo sapiens
aagtcccaggaggacttctgtgg

SEQ ID NO: 5710 - DNA, 23 bp, Homo sapiens
gctgcaagatgaagcttatcagg

SEQ ID NO: 5711 - DNA, 23 bp, Homo sapiens
gctgggtttgcacttagaacagg

SEQ ID NO: 5712 - DNA, 23 bp, Homo sapiens
tgttagttaagacctgcagtagg

SEQ ID NO: 5713 - DNA, 23 bp, Homo sapiens
ttttggtggatgcgtctagatgg

SEQ ID NO: 5714 - DNA, 23 bp, Homo sapiens
cagttggatcacttgagatcagg

SEQ ID NO: 5715 - DNA, 23 bp, Homo sapiens
gtgcaggaggccttcgcacaagg

SEQ ID NO: 5716 - DNA, 23 bp, Homo sapiens
agagctgatgaagttgctgaagg

SEQ ID NO: 5717 - DNA, 23 bp, Homo sapiens
agataagcaattcacactactgg

SEQ ID NO: 5718 - DNA, 23 bp, Homo sapiens
atgaaggtgctagtacatgcagg

SEQ ID NO: 5719 - DNA, 23 bp, Homo sapiens
atgcagaatgggaaagacagagg

SEQ ID NO: 5720 - DNA, 23 bp, Homo sapiens
ctggtgaaggagctccattcagg

SEQ ID NO: 5721 - DNA, 23 bp, Homo sapiens
tgtcacacaggatcgcgtagggg

SEQ ID NO: 5722 - DNA, 23 bp, Homo sapiens
ttctgtttatgtgtacagagcgg

SEQ ID NO: 5723 - DNA, 23 bp, Homo sapiens
gaggacagcgactcttaaattgg

SEQ ID NO: 5724 - DNA, 23 bp, Homo sapiens
ggggtttatgcgtaagtgactgg

SEQ ID NO: 5725 - DNA, 23 bp, Homo sapiens
tgctctggagataaggaaacagg

SEQ ID NO: 5726 - DNA, 23 bp, Homo sapiens
caaacgcaaactcaggaaaatgg

SEQ ID NO: 5727 - DNA, 23 bp, Homo sapiens
gaggctgcagccaaggcttgagg

SEQ ID NO: 5728 - DNA, 23 bp, Homo sapiens
tgcgaggtcactgctgctccagg

SEQ ID NO: 5729 - DNA, 23 bp, Homo sapiens
agggtatcacagatgactgaagg

SEQ ID NO: 5730 - DNA, 23 bp, Homo sapiens
aaagaggagctgaaagccaaagg

SEQ ID NO: 5731 - DNA, 23 bp, Homo sapiens
actgcccaggagaaggactgagg

SEQ ID NO: 5732 - DNA, 23 bp, Homo sapiens
agaagccgctgggggagctatgg

SEQ ID NO: 5733 - DNA, 23 bp, Homo sapiens
aaatacaacagagtgccatcagg

SEQ ID NO: 5734 - DNA, 23 bp, Homo sapiens
ccaccattatgagaacttctagg

SEQ ID NO: 5735 - DNA, 23 bp, Homo sapiens
aggctcagaagttctcatagtgg

SEQ ID NO: 5736 - DNA, 23 bp, Homo sapiens
taaagcacaatcaggatctttgg

SEQ ID NO: 5737 - DNA, 23 bp, Homo sapiens
taattcagattagaggtgtgtgg

SEQ ID NO: 5738 - DNA, 23 bp, Homo sapiens
atcaccactaacctgtgaggggg

SEQ ID NO: 5739 - DNA, 23 bp, Homo sapiens
ggaggatggcagggagctgtagg

SEQ ID NO: 5740 - DNA, 23 bp, Homo sapiens
tgggcagtgccctggcctgaagg

SEQ ID NO: 5741 - DNA, 23 bp, Homo sapiens
aagaaagccccctggaaggctgg

SEQ ID NO: 5742 - DNA, 23 bp, Homo sapiens
ctgaggctacttgtacgcgttgg

SEQ ID NO: 5743 - DNA, 23 bp, Homo sapiens
agtctagtcaaatgccataatgg

SEQ ID NO: 5744 - DNA, 23 bp, Homo sapiens
gacctctcccagctgctgaaagg

SEQ ID NO: 5745 - DNA, 23 bp, Homo sapiens
aaagctgatgggcgtggagacgg

SEQ ID NO: 5746 - DNA, 23 bp, Homo sapiens
ccaggacaggtttgtatcactgg

SEQ ID NO: 5747 - DNA, 23 bp, Homo sapiens
cctgttttgggatcacaaacagg

SEQ ID NO: 5748 - DNA, 23 bp, Homo sapiens
gagacggggcggttctgatctgg

SEQ ID NO: 5749 - DNA, 23 bp, Homo sapiens
gacacctgatgccttactggggg

SEQ ID NO: 5750 - DNA, 23 bp, Homo sapiens
ctgttgggggctgccttcagcgg

SEQ ID NO: 5751 - DNA, 23 bp, Homo sapiens
tcccgcaagggcggcaagtgagg

SEQ ID NO: 5752 - DNA, 23 bp, Homo sapiens
gggcagcatggaaatcattgagg

SEQ ID NO: 5753 - DNA, 23 bp, Homo sapiens
gctcgtgggatggctcacagtgg

SEQ ID NO: 5754 - DNA, 23 bp, Homo sapiens
cagcttcgtacatatcaagaggg

SEQ ID NO: 5755 - DNA, 23 bp, Homo sapiens
tgagctttggttctttgaacagg

SEQ ID NO: 5756 - DNA, 23 bp, Homo sapiens
caggtgctgtgtcactgaggtgg

SEQ ID NO: 5757 - DNA, 23 bp, Homo sapiens
catccctgacatctatgagaagg

SEQ ID NO: 5758 - DNA, 23 bp, Homo sapiens
acattacagtcttctgagaaagg

SEQ ID NO: 5759 - DNA, 23 bp, Homo sapiens
ctccgtcgtataattatcgtagg

SEQ ID NO: 5760 - DNA, 23 bp, Homo sapiens
ctaccagcgaacgaaataagggg

SEQ ID NO: 5761 - DNA, 23 bp, Homo sapiens
gcagggtctggaagcatgagggg

SEQ ID NO: 5762 - DNA, 23 bp, Homo sapiens
aaaaggagggaggactgagctgg

SEQ ID NO: 5763 - DNA, 23 bp, Homo sapiens
gccttcaagcttcaagcctcagg

SEQ ID NO: 5764 - DNA, 23 bp, Homo sapiens
gaggggaagttgaaaccctaggg

SEQ ID NO: 5765 - DNA, 23 bp, Homo sapiens
cccagggcggctctaacagctgg

SEQ ID NO: 5766 - DNA, 23 bp, Homo sapiens
tcctccatcccagttttagcagg

SEQ ID NO: 5767 - DNA, 23 bp, Homo sapiens
tagattgcagagagtccacctgg

SEQ ID NO: 5768 - DNA, 23 bp, Homo sapiens
cccgtgcaccaggcctcacgtgg

SEQ ID NO: 5769 - DNA, 23 bp, Homo sapiens
gggcagcgtggaggtcatcgagg

SEQ ID NO: 5770 - DNA, 23 bp, Homo sapiens
gccggccacggggccctaggtgg

SEQ ID NO: 5771 - DNA, 23 bp, Homo sapiens
tcaggaggttttggttccactgg

SEQ ID NO: 5772 - DNA, 23 bp, Homo sapiens
gaagagctggccagagagacggg

SEQ ID NO: 5773 - DNA, 23 bp, Homo sapiens
cctccgcctccgcgcggcagggg

SEQ ID NO: 5774 - DNA, 23 bp, Homo sapiens
tgactgtgttcaccacgttctgg

SEQ ID NO: 5775 - DNA, 23 bp, Homo sapiens
ctgaatgggaccctctcaaaggg

SEQ ID NO: 5776 - DNA, 23 bp, Homo sapiens
gaacccctgcgagttcttcgtgg

SEQ ID NO: 5777 - DNA, 23 bp, Homo sapiens
caatcccagcgagttctttgtgg

SEQ ID NO: 5778 - DNA, 23 bp, Homo sapiens
tttgtggatgtgatgtgagcagg

SEQ ID NO: 5779 - DNA, 23 bp, Homo sapiens
ggggtctctctctgtcgcctagg

SEQ ID NO: 5780 - DNA, 23 bp, Homo sapiens
aaagcattactatttgggagagg

SEQ ID NO: 5781 - DNA, 23 bp, Homo sapiens
agcacctaacttgagcagagtgg

SEQ ID NO: 5782 - DNA, 23 bp, Homo sapiens
tggctccaaatctcctttttagg

SEQ ID NO: 5783 - DNA, 23 bp, Homo sapiens
gagagcatcctgccctcagtcgg

SEQ ID NO: 5784 - DNA, 23 bp, Homo sapiens
tcggtaggtgcaacagttatagg

SEQ ID NO: 5785 - DNA, 23 bp, Homo sapiens
cctcgcagcttctacgagcgggg

SEQ ID NO: 5786 - DNA, 23 bp, Homo sapiens
ctcaagcaatcctcctatgttgg

SEQ ID NO: 5787 - DNA, 23 bp, Homo sapiens
ctgttgagttatctgcctagtgg

SEQ ID NO: 5788 - DNA, 23 bp, Homo sapiens
ccccttttcaggaactaagcagg

SEQ ID NO: 5789 - DNA, 23 bp, Homo sapiens
caagaagcttctccttccgtagg

SEQ ID NO: 5790 - DNA, 23 bp, Homo sapiens
gactcgaaagccagactctatgg

SEQ ID NO: 5791 - DNA, 23 bp, Homo sapiens
caagaccagtggattcagtgtgg

SEQ ID NO: 5792 - DNA, 23 bp, Homo sapiens
ctcgatttgtttccaagacttgg

SEQ ID NO: 5793 - DNA, 23 bp, Homo sapiens
tcaaaatgaacttggctagcagg

SEQ ID NO: 5794 - DNA, 23 bp, Homo sapiens
ttgctgtttgggattattactgg

SEQ ID NO: 5795 - DNA, 23 bp, Homo sapiens
gccattcttctgttcaaatctgg

SEQ ID NO: 5796 - DNA, 23 bp, Homo sapiens
cctcttcaagtcaggctaggtgg

SEQ ID NO: 5797 - DNA, 23 bp, Homo sapiens
aagaaaaacagctttctccaagg

SEQ ID NO: 5798 - DNA, 23 bp, Homo sapiens
agcagggcccgaggagttgaagg

SEQ ID NO: 5799 - DNA, 23 bp, Homo sapiens
agccaagagagtggcttattcgg

SEQ ID NO: 5800 - DNA, 23 bp, Homo sapiens
ccatcgcaggtctattcacatgg

SEQ ID NO: 5801 - DNA, 23 bp, Homo sapiens
aggtcaaatagacagtccgaagg

SEQ ID NO: 5802 - DNA, 23 bp, Homo sapiens
ttctgggacagctctactgacgg

SEQ ID NO: 5803 - DNA, 23 bp, Homo sapiens
aacgttgacaatacagttcatgg

SEQ ID NO: 5804 - DNA, 23 bp, Homo sapiens
acggtcattctaaaggcacctgg

SEQ ID NO: 5805 - DNA, 23 bp, Homo sapiens
cctgctcctcttggttggtcagg

SEQ ID NO: 5806 - DNA, 23 bp, Homo sapiens
tgtagtcacgagctagctacagg

SEQ ID NO: 5807 - DNA, 23 bp, Homo sapiens
gagggggcagggtcacgagctgg

SEQ ID NO: 5808 - DNA, 23 bp, Homo sapiens
tgagctcagctaacaagttttgg

SEQ ID NO: 5809 - DNA, 23 bp, Homo sapiens
tgccaaaactgattagctagtgg

SEQ ID NO: 5810 - DNA, 23 bp, Homo sapiens
ctcagcaaaggtcatacaatagg

SEQ ID NO: 5811 - DNA, 23 bp, Homo sapiens
ctggtgaagcccttcagctgagg

SEQ ID NO: 5812 - DNA, 23 bp, Homo sapiens
ttgcccaatttgaagtgaaatgg

SEQ ID NO: 5813 - DNA, 23 bp, Homo sapiens
ctcagggctaacagtcatccagg

SEQ ID NO: 5814 - DNA, 23 bp, Homo sapiens
gcttagtaactgtgactgattgg

SEQ ID NO: 5815 - DNA, 23 bp, Homo sapiens
agcttctggggtgaatcaccagg

SEQ ID NO: 5816 - DNA, 23 bp, Homo sapiens
cagccagacgggcagccttcagg

SEQ ID NO: 5817 - DNA, 23 bp, Homo sapiens
atcagatcttgggcaactgccgg

SEQ ID NO: 5818 - DNA, 23 bp, Homo sapiens
acccccctggatttctgacaggg

SEQ ID NO: 5819 - DNA, 23 bp, Homo sapiens
ggacctgttgattaattgagtgg

SEQ ID NO: 5820 - DNA, 23 bp, Homo sapiens
cacatgaagtcttccaccagtgg

SEQ ID NO: 5821 - DNA, 23 bp, Homo sapiens
ggcatgtccctgtcagtcagagg

SEQ ID NO: 5822 - DNA, 23 bp, Homo sapiens
ttaaagttgtagtcatctgccgg

SEQ ID NO: 5823 - DNA, 23 bp, Homo sapiens
tgcttgaagtaagcaactgatgg

SEQ ID NO: 5824 - DNA, 23 bp, Homo sapiens
aggttagtcagcgccgccgctgg

SEQ ID NO: 5825 - DNA, 23 bp, Homo sapiens
agccaacatctgttgattaatgg

SEQ ID NO: 5826 - DNA, 23 bp, Homo sapiens
gggccagctggaggtgcagacgg

SEQ ID NO: 5827 - DNA, 23 bp, Homo sapiens
ggtggacagccacatcatgaagg

SEQ ID NO: 5828 - DNA, 23 bp, Homo sapiens
gacttgcagttgagtgagtctgg

SEQ ID NO: 5829 - DNA, 23 bp, Homo sapiens
gatttgcagctgagtgaatcagg

SEQ ID NO: 5830 - DNA, 23 bp, Homo sapiens
ccagttgggctgtttaggaatgg

SEQ ID NO: 5831 - DNA, 23 bp, Homo sapiens
ttcaagacagcatcactatttgg

SEQ ID NO: 5832 - DNA, 23 bp, Homo sapiens
cgaaacatcctctccctagctgg

SEQ ID NO: 5833 - DNA, 23 bp, Homo sapiens
tattgagctcagtgcctgccagg

SEQ ID NO: 5834 - DNA, 23 bp, Homo sapiens
agcacaacggctaatgaagaagg

SEQ ID NO: 5835 - DNA, 23 bp, Homo sapiens
tcaaggcaattctttcacatagg

SEQ ID NO: 5836 - DNA, 23 bp, Homo sapiens
ttcaggagaaggccagtcccggg

SEQ ID NO: 5837 - DNA, 23 bp, Homo sapiens
aagcagttcttctttacatcggg

SEQ ID NO: 5838 - DNA, 23 bp, Homo sapiens
tggtagtcccgccaatgtgaggg

SEQ ID NO: 5839 - DNA, 23 bp, Homo sapiens
accgtaattaggagtatgccagg

SEQ ID NO: 5840 - DNA, 23 bp, Homo sapiens
atgagcctgggcaagtagcaagg

SEQ ID NO: 5841 - DNA, 23 bp, Homo sapiens
cttcgcggttatgggatttcggg

SEQ ID NO: 5842 - DNA, 23 bp, Homo sapiens
gacttgcgtagcttgtgtagagg

SEQ ID NO: 5843 - DNA, 23 bp, Homo sapiens
ttctctcttgttcgttttccagg

SEQ ID NO: 5844 - DNA, 23 bp, Homo sapiens
gccaagagcaagaagaactgagg

SEQ ID NO: 5845 - DNA, 23 bp, Homo sapiens
ctgaaacttcttcactgaactgg

SEQ ID NO: 5846 - DNA, 23 bp, Homo sapiens
gatagcaatctattcaccccagg

SEQ ID NO: 5847 - DNA, 23 bp, Homo sapiens
cttacttgttggtctgtgatcgg

SEQ ID NO: 5848 - DNA, 23 bp, Homo sapiens
cacaagtgcgaagtctggtaagg

SEQ ID NO: 5849 - DNA, 23 bp, Homo sapiens
gggcagccaggctcaccacacgg

SEQ ID NO: 5850 - DNA, 23 bp, Homo sapiens
acgcgagggctctcagagcttgg

SEQ ID NO: 5851 - DNA, 23 bp, Homo sapiens
caaggttgggcattgggtggagg

SEQ ID NO: 5852 - DNA, 23 bp, Homo sapiens
ttagaggctattgctaagaaagg

SEQ ID NO: 5853 - DNA, 23 bp, Homo sapiens
aagcggactcccaaatttgttgg

SEQ ID NO: 5854 - DNA, 23 bp, Homo sapiens
gtcacacgagccagtgtgagtgg

SEQ ID NO: 5855 - DNA, 23 bp, Homo sapiens
caggggcagctggttctcactgg

SEQ ID NO: 5856 - DNA, 23 bp, Homo sapiens
ccctgcagatgtacttagagagg

SEQ ID NO: 5857 - DNA, 23 bp, Homo sapiens
agatgaatgcacaaatgctgtgg

SEQ ID NO: 5858 - DNA, 23 bp, Homo sapiens
tggggtgactcattcttccttgg

SEQ ID NO: 5859 - DNA, 23 bp, Homo sapiens
agaggatgatgactcaaatctgg

SEQ ID NO: 5860 - DNA, 23 bp, Homo sapiens
tggcctttcctctctggtagagg

SEQ ID NO: 5861 - DNA, 23 bp, Homo sapiens
acaaagtctctcagcagagaagg

SEQ ID NO: 5862 - DNA, 23 bp, Homo sapiens
tgatgttcttcatggagataagg

SEQ ID NO: 5863 - DNA, 23 bp, Homo sapiens
agctggacctggagtatgtgagg

SEQ ID NO: 5864 - DNA, 23 bp, Homo sapiens
gcgccggctcagactagctctgg

SEQ ID NO: 5865 - DNA, 23 bp, Homo sapiens
ggagtatgtgaggagtggctggg

SEQ ID NO: 5866 - DNA, 23 bp, Homo sapiens
atgacgtacagattgaaaccagg

SEQ ID NO: 5867 - DNA, 23 bp, Homo sapiens
gccttccttccttctttgaaagg

SEQ ID NO: 5868 - DNA, 23 bp, Homo sapiens
ttcgaagtactgacagccatagg

SEQ ID NO: 5869 - DNA, 23 bp, Homo sapiens
agagggaagacacaactcattgg

SEQ ID NO: 5870 - DNA, 23 bp, Homo sapiens
atggggggaatctaggatgcagg

SEQ ID NO: 5871 - DNA, 23 bp, Homo sapiens
tttctcagcagaaaccttgtagg

SEQ ID NO: 5872 - DNA, 23 bp, Homo sapiens
acctcattagagttaagggctgg

SEQ ID NO: 5873 - DNA, 23 bp, Homo sapiens
tcttgtggacatcacatttcagg

SEQ ID NO: 5874 - DNA, 23 bp, Homo sapiens
gcttttcaggatgcagcatgtgg

SEQ ID NO: 5875 - DNA, 23 bp, Homo sapiens
ctggtggtggggctgtgacctgg

SEQ ID NO: 5876 - DNA, 23 bp, Homo sapiens
cccactgcactctgcttagaggg

SEQ ID NO: 5877 - DNA, 23 bp, Homo sapiens
aaggcaggcttagcagctaaggg

SEQ ID NO: 5878 - DNA, 23 bp, Homo sapiens
tagactttctagttgctgatagg

SEQ ID NO: 5879 - DNA, 23 bp, Homo sapiens
tagactttctagttgccgatagg

SEQ ID NO: 5880 - DNA, 23 bp, Homo sapiens
cgacagattgaccagatggttgg

SEQ ID NO: 5881 - DNA, 23 bp, Homo sapiens
ccagtggttatgaggagtctagg

SEQ ID NO: 5882 - DNA, 23 bp, Homo sapiens
agcatttgaaatgatggagaagg

SEQ ID NO: 5883 - DNA, 23 bp, Homo sapiens
acgccgctcccgtgcctcactgg

SEQ ID NO: 5884 - DNA, 23 bp, Homo sapiens
cttcgccgggtccgctgaacagg

SEQ ID NO: 5885 - DNA, 23 bp, Homo sapiens
ctttgtgttcatttcgccctagg

SEQ ID NO: 5886 - DNA, 23 bp, Homo sapiens
ctgcacagaggaggaatgagggg

SEQ ID NO: 5887 - DNA, 23 bp, Homo sapiens
tgacccacaaccgagcacattgg

SEQ ID NO: 5888 - DNA, 23 bp, Homo sapiens
acactatctcttcctccacctgg

SEQ ID NO: 5889 - DNA, 23 bp, Homo sapiens
caaggaccaacaaagcaagcagg

SEQ ID NO: 5890 - DNA, 23 bp, Homo sapiens
ctgcaggcctgtcctcctaaggg

SEQ ID NO: 5891 - DNA, 23 bp, Homo sapiens
gtcagttcatgctgtccttatgg

SEQ ID NO: 5892 - DNA, 23 bp, Homo sapiens
gcacgactgcttttcctccaagg

SEQ ID NO: 5893 - DNA, 23 bp, Homo sapiens
taaaccaaaacccaacaatgtgg

SEQ ID NO: 5894 - DNA, 23 bp, Homo sapiens
ggctctgtgcagtcactgaacgg

SEQ ID NO: 5895 - DNA, 23 bp, Homo sapiens
tcaatgacttgcaaggataatgg

SEQ ID NO: 5896 - DNA, 23 bp, Homo sapiens
tgatgccagtatttggcgctggg

SEQ ID NO: 5897 - DNA, 23 bp, Homo sapiens
ggtgggtgtcatcaaagcagtgg

SEQ ID NO: 5898 - DNA, 23 bp, Homo sapiens
gcgcagaaggcgcagaaggcggg

SEQ ID NO: 5899 - DNA, 23 bp, Homo sapiens
atgattctgggctggactgtggg

SEQ ID NO: 5900 - DNA, 23 bp, Homo sapiens
ataccatgccaggccctcgttgg

SEQ ID NO: 5901 - DNA, 23 bp, Homo sapiens
tggaaacagtgtagcagcattgg

SEQ ID NO: 5902 - DNA, 23 bp, Homo sapiens
cagcaagggtgatgtcaagcagg

SEQ ID NO: 5903 - DNA, 23 bp, Homo sapiens
ggccaggggcaggtcagtgatgg

SEQ ID NO: 5904 - DNA, 23 bp, Homo sapiens
cttagtgccattcagctctgagg

SEQ ID NO: 5905 - DNA, 23 bp, Homo sapiens
cagggcagctgtgtgaggtgtgg

SEQ ID NO: 5906 - DNA, 23 bp, Homo sapiens
ctatgtgcagtccatggatgtgg

SEQ ID NO: 5907 - DNA, 23 bp, Homo sapiens
ggaggagatcaccaagtttgagg

SEQ ID NO: 5908 - DNA, 23 bp, Homo sapiens
agctgaggcacacagaggtaggg

SEQ ID NO: 5909 - DNA, 23 bp, Homo sapiens
atggcatggacagcttctagtgg

SEQ ID NO: 5910 - DNA, 23 bp, Homo sapiens
gtgggcaaagccttcaatcaggg

SEQ ID NO: 5911 - DNA, 23 bp, Homo sapiens
cttcctggacaaattgtaggcgg

SEQ ID NO: 5912 - DNA, 23 bp, Homo sapiens
gcccagatggaggagtaaccagg

SEQ ID NO: 5913 - DNA, 23 bp, Homo sapiens
gagtcgtgtgtgagtcctacagg

SEQ ID NO: 5914 - DNA, 23 bp, Homo sapiens
cttcgacacccacaagcgcatgg

SEQ ID NO: 5915 - DNA, 23 bp, Homo sapiens
tcatcgctcgtgcttgatgttgg

SEQ ID NO: 5916 - DNA, 23 bp, Homo sapiens
cttgagcttcaaattccatctgg

SEQ ID NO: 5917 - DNA, 23 bp, Homo sapiens
tgccctgaactatggacagaagg

SEQ ID NO: 5918 - DNA, 23 bp, Homo sapiens
accggaaaggactgttcttgagg

SEQ ID NO: 5919 - DNA, 23 bp, Homo sapiens
ctagttgatgtagtacaccttgg

SEQ ID NO: 5920 - DNA, 23 bp, Homo sapiens
ggattcgatagttaaagcacagg

SEQ ID NO: 5921 - DNA, 23 bp, Homo sapiens
tgaaactactaaccatgttcagg

SEQ ID NO: 5922 - DNA, 23 bp, Homo sapiens
ctggagctaagggtagctttagg

SEQ ID NO: 5923 - DNA, 23 bp, Homo sapiens
gcctttttctcaagaggaaatgg

SEQ ID NO: 5924 - DNA, 23 bp, Homo sapiens
ggagtttcgctccgtcgcccagg

SEQ ID NO: 5925 - DNA, 23 bp, Homo sapiens
agtgaatgttacacagactcagg

SEQ ID NO: 5926 - DNA, 23 bp, Homo sapiens
tatggaaatttggtctcaagagg

SEQ ID NO: 5927 - DNA, 23 bp, Homo sapiens
ttctcttgcaaaccttcccctgg

SEQ ID NO: 5928 - DNA, 23 bp, Homo sapiens
cacacagcaggggtgtctactgg

SEQ ID NO: 5929 - DNA, 23 bp, Homo sapiens
agtgggacccaaatctacaatgg

SEQ ID NO: 5930 - DNA, 23 bp, Homo sapiens
tgaaggggagctcccatgtcagg

SEQ ID NO: 5931 - DNA, 23 bp, Homo sapiens
acagaagaggcagaaaacagagg

SEQ ID NO: 5932 - DNA, 23 bp, Homo sapiens
ggtgggccagtaacctcagcagg

SEQ ID NO: 5933 - DNA, 23 bp, Homo sapiens
atcttaacacagagcttgtgcgg

SEQ ID NO: 5934 - DNA, 23 bp, Homo sapiens
gctccctcctgctcctcagaagg

SEQ ID NO: 5935 - DNA, 23 bp, Homo sapiens
tgagtgttttacacttgatccgg

SEQ ID NO: 5936 - DNA, 23 bp, Homo sapiens
aggatgtgctctcatggagaagg

SEQ ID NO: 5937 - DNA, 23 bp, Homo sapiens
ggacgcgtttggcttagaggagg

SEQ ID NO: 5938 - DNA, 23 bp, Homo sapiens
gcaggactatgtattgaagttgg

SEQ ID NO: 5939 - DNA, 23 bp, Homo sapiens
cagtccacctttaagtagcgggg

SEQ ID NO: 5940 - DNA, 23 bp, Homo sapiens
tggagcatgcagaaaagcagagg

SEQ ID NO: 5941 - DNA, 23 bp, Homo sapiens
ggtgtggcatacaccttcacggg

SEQ ID NO: 5942 - DNA, 23 bp, Homo sapiens
ggggctgggactaggaacccagg

SEQ ID NO: 5943 - DNA, 23 bp, Homo sapiens
ggggagggggcagagctaggagg

SEQ ID NO: 5944 - DNA, 23 bp, Homo sapiens
ggagcctgtcccctcatcacagg

SEQ ID NO: 5945 - DNA, 23 bp, Homo sapiens
gacaagatggagcattgatgggg

SEQ ID NO: 5946 - DNA, 23 bp, Homo sapiens
gcagtaatagcaagagacagagg

SEQ ID NO: 5947 - DNA, 23 bp, Homo sapiens
ataatgtcaaaagcatcgccagg

SEQ ID NO: 5948 - DNA, 23 bp, Homo sapiens
cccggcgaacatctactacaagg

SEQ ID NO: 5949 - DNA, 23 bp, Homo sapiens
atttactacaaggtctgagaggg

SEQ ID NO: 5950 - DNA, 23 bp, Homo sapiens
acatctactacaaggtatgaggg

SEQ ID NO: 5951 - DNA, 23 bp, Homo sapiens
agatctgtgtgtgtactgatcgg

SEQ ID NO: 5952 - DNA, 23 bp, Homo sapiens
attcagtatacacacagatcggg

SEQ ID NO: 5953 - DNA, 23 bp, Homo sapiens
tcactagcctggctccatgaagg

SEQ ID NO: 5954 - DNA, 23 bp, Homo sapiens
caggagtccacgcactcacatgg

SEQ ID NO: 5955 - DNA, 23 bp, Homo sapiens
ttcactgagtcagctccatttgg

SEQ ID NO: 5956 - DNA, 23 bp, Homo sapiens
tccagatagccttttatctgtgg

SEQ ID NO: 5957 - DNA, 23 bp, Homo sapiens
cagtcacgagtctttcttgcagg

SEQ ID NO: 5958 - DNA, 23 bp, Homo sapiens
cttatcgatgattgacgccgagg

SEQ ID NO: 5959 - DNA, 23 bp, Homo sapiens
caaggccagctggtgttacttgg

SEQ ID NO: 5960 - DNA, 23 bp, Homo sapiens
aaaaccgtaaaggaaatcacagg

SEQ ID NO: 5961 - DNA, 23 bp, Homo sapiens
agatttgcagacacagtgaaggg

SEQ ID NO: 5962 - DNA, 23 bp, Homo sapiens
cgtgaaggcatgaggctcagtgg

SEQ ID NO: 5963 - DNA, 23 bp, Homo sapiens
gccatccaaactgcacctacggg

SEQ ID NO: 5964 - DNA, 23 bp, Homo sapiens
tgctttgtggcgcgacccttagg

SEQ ID NO: 5965 - DNA, 23 bp, Homo sapiens
aataaaccttcagattcggtcgg

SEQ ID NO: 5966 - DNA, 23 bp, Homo sapiens
ctctgggactggccactaggtgg

SEQ ID NO: 5967 - DNA, 23 bp, Homo sapiens
agcacggtcagtcttcagtgagg

SEQ ID NO: 5968 - DNA, 23 bp, Homo sapiens
tgacagcaaccttttctcccagg

SEQ ID NO: 5969 - DNA, 23 bp, Homo sapiens
gagtctcatctcaaggtgtccgg

SEQ ID NO: 5970 - DNA, 23 bp, Homo sapiens
gtggtcaccacctgcgcctgagg

SEQ ID NO: 5971 - DNA, 23 bp, Homo sapiens
tcttgctcagagagaagcgaagg

SEQ ID NO: 5972 - DNA, 23 bp, Homo sapiens
aggcaagatggccaagaaagagg

SEQ ID NO: 5973 - DNA, 23 bp, Homo sapiens
gagcgctgcgtgctgagctgagg

SEQ ID NO: 5974 - DNA, 23 bp, Homo sapiens
ccaagcgcagacatgagtgatgg

SEQ ID NO: 5975 - DNA, 23 bp, Homo sapiens
aagggctccgccgagtgagccgg

SEQ ID NO: 5976 - DNA, 23 bp, Homo sapiens
aggaaagttgccgagtgatgggg

SEQ ID NO: 5977 - DNA, 23 bp, Homo sapiens
cctgcccaaggccgactgagggg

SEQ ID NO: 5978 - DNA, 23 bp, Homo sapiens
tttcattttctctccatcctcgg

SEQ ID NO: 5979 - DNA, 23 bp, Homo sapiens
aaagaatggcaaagcttggcagg

SEQ ID NO: 5980 - DNA, 23 bp, Homo sapiens
gctggccggcggcgtctcatagg

SEQ ID NO: 5981 - DNA, 23 bp, Homo sapiens
acaaaattgtttggcttctctgg

SEQ ID NO: 5982 - DNA, 23 bp, Homo sapiens
tcctcaccataagtcaccaaagg

SEQ ID NO: 5983 - DNA, 23 bp, Homo sapiens
gtccgttctcatgtgttgacagg

SEQ ID NO: 5984 - DNA, 23 bp, Homo sapiens
gttgcttaagaagaccaccaagg

SEQ ID NO: 5985 - DNA, 23 bp, Homo sapiens
gccaaactgaaggctactgcagg

SEQ ID NO: 5986 - DNA, 23 bp, Homo sapiens
aatcgtctgaccgaagaactcgg

SEQ ID NO: 5987 - DNA, 23 bp, Homo sapiens
aaccctctgatagaagaacttgg

SEQ ID NO: 5988 - DNA, 23 bp, Homo sapiens
agtcctctggccgactgagtcgg

SEQ ID NO: 5989 - DNA, 23 bp, Homo sapiens
ggcagcttttgaaatttctgagg

SEQ ID NO: 5990 - DNA, 23 bp, Homo sapiens
acgatcagctgaaggttcatggg

SEQ ID NO: 5991 - DNA, 23 bp, Homo sapiens
ggaggagagtgaagaggaggagg

SEQ ID NO: 5992 - DNA, 23 bp, Homo sapiens
tgaatttcatcatcatctccagg

SEQ ID NO: 5993 - DNA, 23 bp, Homo sapiens
catctccaatatcgtcaaactgg

SEQ ID NO: 5994 - DNA, 23 bp, Homo sapiens
gaggaacagcttaaggttcatgg

SEQ ID NO: 5995 - DNA, 23 bp, Homo sapiens
gagctggaagatttggaattggg

SEQ ID NO: 5996 - DNA, 23 bp, Homo sapiens
gacggaaaggatgggggcgtggg

SEQ ID NO: 5997 - DNA, 23 bp, Homo sapiens
gtgtgtcgttcatttttctctgg

SEQ ID NO: 5998 - DNA, 23 bp, Homo sapiens
acaacttaaggctaattgcttgg

SEQ ID NO: 5999 - DNA, 23 bp, Homo sapiens
tgaggtatctttgctttggcagg

SEQ ID NO: 6000 - DNA, 23 bp, Homo sapiens
gagctcatcgctgactgctgagg

SEQ ID NO: 6001 - DNA, 23 bp, Homo sapiens
gatggtagagttcactcatcagg

SEQ ID NO: 6002 - DNA, 23 bp, Homo sapiens
aactcagtcactgtggaggaagg

SEQ ID NO: 6003 - DNA, 23 bp, Homo sapiens
cccacttgaggcaaagataatgg

SEQ ID NO: 6004 - DNA, 23 bp, Homo sapiens
gaactcagatctccatgagctgg

SEQ ID NO: 6005 - DNA, 23 bp, Homo sapiens
aagagcagtgaccagtgacgggg

SEQ ID NO: 6006 - DNA, 23 bp, Homo sapiens
gtggctaaaagaggcagaagagg

SEQ ID NO: 6007 - DNA, 23 bp, Homo sapiens
gtctgtcacttcttcttgccagg

SEQ ID NO: 6008 - DNA, 23 bp, Homo sapiens
agatgatgatgcagaagaaatgg

SEQ ID NO: 6009 - DNA, 23 bp, Homo sapiens
accggcttccaggctgtcacggg

SEQ ID NO: 6010 - DNA, 23 bp, Homo sapiens
cttcagtcatcatctactgttgg

SEQ ID NO: 6011 - DNA, 23 bp, Homo sapiens
tgagacttaacgtcgtactgtgg

SEQ ID NO: 6012 - DNA, 23 bp, Homo sapiens
ctcgggaatcaggagtgacctgg

SEQ ID NO: 6013 - DNA, 23 bp, Homo sapiens
aacagagtggagagctcagtagg

SEQ ID NO: 6014 - DNA, 23 bp, Homo sapiens
agatgaggaggaagaggaggagg

SEQ ID NO: 6015 - DNA, 23 bp, Homo sapiens
aactgggcaactcaagattctgg

SEQ ID NO: 6016 - DNA, 23 bp, Homo sapiens
actgcttggggtccattcacagg

SEQ ID NO: 6017 - DNA, 23 bp, Homo sapiens
acagtggcagctggcttagttgg

SEQ ID NO: 6018 - DNA, 23 bp, Homo sapiens
tgttgtattcttgaagagcctgg

SEQ ID NO: 6019 - DNA, 23 bp, Homo sapiens
aactcaaattcgaagtactgtgg

SEQ ID NO: 6020 - DNA, 23 bp, Homo sapiens
gattatggtggttatgatggagg

SEQ ID NO: 6021 - DNA, 23 bp, Homo sapiens
aaacacctgaagttactgggagg

SEQ ID NO: 6022 - DNA, 23 bp, Homo sapiens
aatcgaaccctgaagaagatggg

SEQ ID NO: 6023 - DNA, 23 bp, Homo sapiens
aggtatcagaaagactcaaaagg

SEQ ID NO: 6024 - DNA, 23 bp, Homo sapiens
tgttgctgacctcatctgagggg

SEQ ID NO: 6025 - DNA, 23 bp, Homo sapiens
ggtggacggtttggccgtaaagg

SEQ ID NO: 6026 - DNA, 23 bp, Homo sapiens
ggaggagatgcccatgaatgtgg

SEQ ID NO: 6027 - DNA, 23 bp, Homo sapiens
cggcatctcatcaatctgagtgg

SEQ ID NO: 6028 - DNA, 23 bp, Homo sapiens
acaggatgtagaggtctattcgg

SEQ ID NO: 6029 - DNA, 23 bp, Homo sapiens
gcggctccaccactaaaaatagg

SEQ ID NO: 6030 - DNA, 23 bp, Homo sapiens
aacaagtttgtggtgtgaggggg

SEQ ID NO: 6031 - DNA, 23 bp, Homo sapiens
gagggggagcgtccgatcagcgg

SEQ ID NO: 6032 - DNA, 23 bp, Homo sapiens
cctacctcccaacaccattatgg

SEQ ID NO: 6033 - DNA, 23 bp, Homo sapiens
ggtcatggcacattcaaccgcgg

SEQ ID NO: 6034 - DNA, 23 bp, Homo sapiens
catgcttttgaaggtggacgtgg

SEQ ID NO: 6035 - DNA, 23 bp, Homo sapiens
ggctggaactgctgatcattcgg

SEQ ID NO: 6036 - DNA, 23 bp, Homo sapiens
aagtatactctcaagcaagcagg

SEQ ID NO: 6037 - DNA, 23 bp, Homo sapiens
ttggaataccgacagtgagcagg

SEQ ID NO: 6038 - DNA, 23 bp, Homo sapiens
aggagtctgaccacaactgaggg

SEQ ID NO: 6039 - DNA, 23 bp, Homo sapiens
ttcttcagcagtttctaaccagg

SEQ ID NO: 6040 - DNA, 23 bp, Homo sapiens
cagcattcattcgatgtttctgg

SEQ ID NO: 6041 - DNA, 23 bp, Homo sapiens
ggaagcagaagaggagtctgagg

SEQ ID NO: 6042 - DNA, 23 bp, Homo sapiens
tagagaggaagtcgttcaaaagg

SEQ ID NO: 6043 - DNA, 23 bp, Homo sapiens
gttgcatccatccctttaaatgg

SEQ ID NO: 6044 - DNA, 23 bp, Homo sapiens
caaggccatggcaaaataactgg

SEQ ID NO: 6045 - DNA, 23 bp, Homo sapiens
tgatgtttccgtttatttgcagg

SEQ ID NO: 6046 - DNA, 23 bp, Homo sapiens
gagtgactggcagcttattgtgg

SEQ ID NO: 6047 - DNA, 23 bp, Homo sapiens
cttggaaggtgactcaggtgagg

SEQ ID NO: 6048 - DNA, 23 bp, Homo sapiens
ccaggcccgggagtcatagcagg

SEQ ID NO: 6049 - DNA, 23 bp, Homo sapiens
cttctgctagagtcacttcttgg

SEQ ID NO: 6050 - DNA, 23 bp, Homo sapiens
agggtctcccagatcttcactgg

SEQ ID NO: 6051 - DNA, 23 bp, Homo sapiens
gccagcaggacccactgagaagg

SEQ ID NO: 6052 - DNA, 23 bp, Homo sapiens
aagcatgagcgagttatttgtgg

SEQ ID NO: 6053 - DNA, 23 bp, Homo sapiens
agcctcaatggataccgtctggg

SEQ ID NO: 6054 - DNA, 23 bp, Homo sapiens
caagaccagcaaacagcacaagg

SEQ ID NO: 6055 - DNA, 23 bp, Homo sapiens
aatgggaaattcaggacttgtgg

SEQ ID NO: 6056 - DNA, 23 bp, Homo sapiens
atcaaagcaaactgaagcagagg

SEQ ID NO: 6057 - DNA, 23 bp, Homo sapiens
tatgaaacaaaacgaactgctgg

SEQ ID NO: 6058 - DNA, 23 bp, Homo sapiens
acaggaagggcaatagctgaagg

SEQ ID NO: 6059 - DNA, 23 bp, Homo sapiens
ttctccagagtcggaactgaggg

SEQ ID NO: 6060 - DNA, 23 bp, Homo sapiens
acccctttgcttatatgtcatgg

SEQ ID NO: 6061 - DNA, 23 bp, Homo sapiens
aaaaaatgcacacgggtggcagg

SEQ ID NO: 6062 - DNA, 23 bp, Homo sapiens
ggggggctcaggacttgtgctgg

SEQ ID NO: 6063 - DNA, 23 bp, Homo sapiens
gggggggtcacagcttctgctgg

SEQ ID NO: 6064 - DNA, 23 bp, Homo sapiens
gtggtagtagtcatggcttctgg

SEQ ID NO: 6065 - DNA, 23 bp, Homo sapiens
tcccattgcgccccgtagcccgg

SEQ ID NO: 6066 - DNA, 23 bp, Homo sapiens
gagtttgaagaaagcagtactgg

SEQ ID NO: 6067 - DNA, 23 bp, Homo sapiens
gcataggttatgtcttctgtagg

SEQ ID NO: 6068 - DNA, 23 bp, Homo sapiens
ggtagcttgctcgctctttatgg

SEQ ID NO: 6069 - DNA, 23 bp, Homo sapiens
accagcggcagctgcaggcttgg

SEQ ID NO: 6070 - DNA, 23 bp, Homo sapiens
accaacagcaagcagagtcatgg

SEQ ID NO: 6071 - DNA, 23 bp, Homo sapiens
gagtttgaggaaaagaacagggg

SEQ ID NO: 6072 - DNA, 23 bp, Homo sapiens
gtctatgactgtaactgaagtgg

SEQ ID NO: 6073 - DNA, 23 bp, Homo sapiens
atagacaaagtcatagctgctgg

SEQ ID NO: 6074 - DNA, 23 bp, Homo sapiens
gtcatagcagaagttgaagttgg

SEQ ID NO: 6075 - DNA, 23 bp, Homo sapiens
catgttgattaaaccttccgagg

SEQ ID NO: 6076 - DNA, 23 bp, Homo sapiens
tgatgaaagtgttccattgttgg

SEQ ID NO: 6077 - DNA, 23 bp, Homo sapiens
ctcactcatccgaaggcgtatgg

SEQ ID NO: 6078 - DNA, 23 bp, Homo sapiens
aaaaaatgtggcaggtaaggtgg

SEQ ID NO: 6079 - DNA, 23 bp, Homo sapiens
aggaagctcattttctcttccgg

SEQ ID NO: 6080 - DNA, 23 bp, Homo sapiens
gcaagtcctcagtttatcgtcgg

SEQ ID NO: 6081 - DNA, 23 bp, Homo sapiens
gcaagtcctgagtttatcgtcgg

SEQ ID NO: 6082 - DNA, 23 bp, Homo sapiens
aaggcaattcgagactacaaggg

SEQ ID NO: 6083 - DNA, 23 bp, Homo sapiens
cacaggtccacccacgctggggg

SEQ ID NO: 6084 - DNA, 23 bp, Homo sapiens
aatgaacaagccgtgcagtgagg

SEQ ID NO: 6085 - DNA, 23 bp, Homo sapiens
aattgcactggaactgctgatgg

SEQ ID NO: 6086 - DNA, 23 bp, Homo sapiens
tcctctgtgtcgctactgattgg

SEQ ID NO: 6087 - DNA, 23 bp, Homo sapiens
tctaggccatgcttctcagttgg

SEQ ID NO: 6088 - DNA, 23 bp, Homo sapiens
gcctacttcactgcagcaaatgg

SEQ ID NO: 6089 - DNA, 23 bp, Homo sapiens
tgttctctccaaaccttcactgg

SEQ ID NO: 6090 - DNA, 23 bp, Homo sapiens
gctggaaaaacagccatgaatgg

SEQ ID NO: 6091 - DNA, 23 bp, Homo sapiens
ctctggtggctggttcaggcagg

SEQ ID NO: 6092 - DNA, 23 bp, Homo sapiens
gaagccaaggaagctgcggaagg

SEQ ID NO: 6093 - DNA, 23 bp, Homo sapiens
aggcctacatcggcaaaatgagg

SEQ ID NO: 6094 - DNA, 23 bp, Homo sapiens
ttgcccaaaactgtgaaaaatgg

SEQ ID NO: 6095 - DNA, 23 bp, Homo sapiens
ctgcagtcactcagtctagcagg

SEQ ID NO: 6096 - DNA, 23 bp, Homo sapiens
tggttacactttgcaagctgtgg

SEQ ID NO: 6097 - DNA, 23 bp, Homo sapiens
tggtgaagatgctgaaataatgg

SEQ ID NO: 6098 - DNA, 23 bp, Homo sapiens
aagaagcacctggacttctaggg

SEQ ID NO: 6099 - DNA, 23 bp, Homo sapiens
ctcactgtgtctgacaagtctgg

SEQ ID NO: 6100 - DNA, 23 bp, Homo sapiens
tctgcatgcagcgactaaggagg

SEQ ID NO: 6101 - DNA, 23 bp, Homo sapiens
gggtggggtcagggattctaggg

SEQ ID NO: 6102 - DNA, 23 bp, Homo sapiens
tgacgacctggatatttgactgg

SEQ ID NO: 6103 - DNA, 23 bp, Homo sapiens
aaatcaggtcacagaacagcagg

SEQ ID NO: 6104 - DNA, 23 bp, Homo sapiens
tcagcatcagcaatacacccagg

SEQ ID NO: 6105 - DNA, 23 bp, Homo sapiens
cttttcacaaagcagaatggtgg

SEQ ID NO: 6106 - DNA, 23 bp, Homo sapiens
agtctttgttctttatcgccagg

SEQ ID NO: 6107 - DNA, 23 bp, Homo sapiens
tgaccagcctgggccctcaccgg

SEQ ID NO: 6108 - DNA, 23 bp, Homo sapiens
gcccgcgccaccgccacaggagg

SEQ ID NO: 6109 - DNA, 23 bp, Homo sapiens
agacatttgtctattgtctgtgg

SEQ ID NO: 6110 - DNA, 23 bp, Homo sapiens
ttgcagatcacccagtcttaagg

SEQ ID NO: 6111 - DNA, 23 bp, Homo sapiens
gctcggtcttcaaaaaatagagg

SEQ ID NO: 6112 - DNA, 23 bp, Homo sapiens
agaatggagttcagtggtggagg

SEQ ID NO: 6113 - DNA, 23 bp, Homo sapiens
ggagccactgggcttaaagaagg

SEQ ID NO: 6114 - DNA, 23 bp, Homo sapiens
atggtgcacgtctactgaaatgg

SEQ ID NO: 6115 - DNA, 23 bp, Homo sapiens
gctggcaaaaggaggtagtcagg

SEQ ID NO: 6116 - DNA, 23 bp, Homo sapiens
gtcctacacttgtgctaggcagg

SEQ ID NO: 6117 - DNA, 23 bp, Homo sapiens
cgcagtgtcgctgaagccctcgg

SEQ ID NO: 6118 - DNA, 23 bp, Homo sapiens
gttggtcccactaatggaaatgg

SEQ ID NO: 6119 - DNA, 23 bp, Homo sapiens
ttcctcaagctgtcagttcttgg

SEQ ID NO: 6120 - DNA, 23 bp, Homo sapiens
agaaggcaaccccttctagaggg

SEQ ID NO: 6121 - DNA, 23 bp, Homo sapiens
gcactatctaaagagagatgtgg

SEQ ID NO: 6122 - DNA, 23 bp, Homo sapiens
cctgatctcctgctggacctggg

SEQ ID NO: 6123 - DNA, 23 bp, Homo sapiens
agcctttgaggaagtatgggggg

SEQ ID NO: 6124 - DNA, 23 bp, Homo sapiens
gccgggacgagagaggctgaggg

SEQ ID NO: 6125 - DNA, 23 bp, Homo sapiens
gagcttgaacacgcgtagactgg

SEQ ID NO: 6126 - DNA, 23 bp, Homo sapiens
ttcctttcccacctctaaggtgg

SEQ ID NO: 6127 - DNA, 23 bp, Homo sapiens
ccagggcaagccaactagacagg

SEQ ID NO: 6128 - DNA, 23 bp, Homo sapiens
aagacacaagcatcatgcagtgg

SEQ ID NO: 6129 - DNA, 23 bp, Homo sapiens
cagtggcgggtggtctgatgcgg

SEQ ID NO: 6130 - DNA, 23 bp, Homo sapiens
caggcagcgatcaaacgtcgagg

SEQ ID NO: 6131 - DNA, 23 bp, Homo sapiens
cgggtctaaacagtgtgtgcagg

SEQ ID NO: 6132 - DNA, 23 bp, Homo sapiens
gaagccagggtgttaggacgagg

SEQ ID NO: 6133 - DNA, 23 bp, Homo sapiens
catctcagcatctctcagtgagg

SEQ ID NO: 6134 - DNA, 23 bp, Homo sapiens
aagtatgtggtcagcactggagg

SEQ ID NO: 6135 - DNA, 23 bp, Homo sapiens
ctggtcctgagaaagaaataagg

SEQ ID NO: 6136 - DNA, 23 bp, Homo sapiens
atgaatgaatgaatggtggatgg

SEQ ID NO: 6137 - DNA, 23 bp, Homo sapiens
ctacatccacctacggaagcggg

SEQ ID NO: 6138 - DNA, 23 bp, Homo sapiens
cttctcagagctctgctgaacgg

SEQ ID NO: 6139 - DNA, 23 bp, Homo sapiens
gtcacctccaatgactagggtgg

SEQ ID NO: 6140 - DNA, 23 bp, Homo sapiens
gaggtcacgtctatttcctccgg

SEQ ID NO: 6141 - DNA, 23 bp, Homo sapiens
aagggacgcaccatattaaccgg

SEQ ID NO: 6142 - DNA, 23 bp, Homo sapiens
actcgctctcgtctttgtcctgg

SEQ ID NO: 6143 - DNA, 23 bp, Homo sapiens
aagtcggacagcgagtagggcgg

SEQ ID NO: 6144 - DNA, 23 bp, Homo sapiens
gcaagtcaaatactgcatagagg

SEQ ID NO: 6145 - DNA, 23 bp, Homo sapiens
gcttactacttcaggcctagggg

SEQ ID NO: 6146 - DNA, 23 bp, Homo sapiens
ttaagaaggcagatgtttccagg

SEQ ID NO: 6147 - DNA, 23 bp, Homo sapiens
ctgcaagcggattggctacaagg

SEQ ID NO: 6148 - DNA, 23 bp, Homo sapiens
tcacggcgggcagtaagtgaggg

SEQ ID NO: 6149 - DNA, 23 bp, Homo sapiens
tggctcgaagttctattaggtgg

SEQ ID NO: 6150 - DNA, 23 bp, Homo sapiens
cccagcaccaggtggggcagagg

SEQ ID NO: 6151 - DNA, 23 bp, Homo sapiens
gcatgccccaaaggagactccgg

SEQ ID NO: 6152 - DNA, 23 bp, Homo sapiens
ggcaaggactggcagtagggtgg

SEQ ID NO: 6153 - DNA, 23 bp, Homo sapiens
ggggcccggcatgctcactgtgg

SEQ ID NO: 6154 - DNA, 23 bp, Homo sapiens
cccctgctccaccagcagcatgg

SEQ ID NO: 6155 - DNA, 23 bp, Homo sapiens
ttattcagcccctgcatgagcgg

SEQ ID NO: 6156 - DNA, 23 bp, Homo sapiens
gctacctgctgcagccctgaagg

SEQ ID NO: 6157 - DNA, 23 bp, Homo sapiens
gcccaaagtcttcgtgaagatgg

SEQ ID NO: 6158 - DNA, 23 bp, Homo sapiens
aaacaactagaacacgacattgg

SEQ ID NO: 6159 - DNA, 23 bp, Homo sapiens
ttgcctgcccacagcttacttgg

SEQ ID NO: 6160 - DNA, 23 bp, Homo sapiens
gcagaggaatcacagcacactgg

SEQ ID NO: 6161 - DNA, 23 bp, Homo sapiens
ggagcctccagcttctcacttgg

SEQ ID NO: 6162 - DNA, 23 bp, Homo sapiens
acaggagcatcctctggataggg

SEQ ID NO: 6163 - DNA, 23 bp, Homo sapiens
aacaacccttctctaggttgagg

SEQ ID NO: 6164 - DNA, 23 bp, Homo sapiens
agcacttaattttcttgagcagg

SEQ ID NO: 6165 - DNA, 23 bp, Homo sapiens
tggaagctgtgtgcctttgaagg

SEQ ID NO: 6166 - DNA, 23 bp, Homo sapiens
tggaaattctgtggcttcgaggg

SEQ ID NO: 6167 - DNA, 23 bp, Homo sapiens
atagaaacaccatcagagaatgg

SEQ ID NO: 6168 - DNA, 23 bp, Homo sapiens
atatcagtcttcttggctaaagg

SEQ ID NO: 6169 - DNA, 23 bp, Homo sapiens
tctcgctctcatatgtatgcagg

SEQ ID NO: 6170 - DNA, 23 bp, Homo sapiens
agttgcaaaatttcagagacagg

SEQ ID NO: 6171 - DNA, 23 bp, Homo sapiens
agcacatgtcacccaattaaagg

SEQ ID NO: 6172 - DNA, 23 bp, Homo sapiens
ttcagcatgcatatcttgtaagg

SEQ ID NO: 6173 - DNA, 23 bp, Homo sapiens
atatgatcagttatgcaagcagg

SEQ ID NO: 6174 - DNA, 23 bp, Homo sapiens
gaccgtgattcttctgtctgagg

SEQ ID NO: 6175 - DNA, 23 bp, Homo sapiens
ccgggcagcatcattcaacttgg

SEQ ID NO: 6176 - DNA, 23 bp, Homo sapiens
tcgtcaccagcaagcttgcgggg

SEQ ID NO: 6177 - DNA, 23 bp, Homo sapiens
ttgttgttgaacagaagtagagg

SEQ ID NO: 6178 - DNA, 23 bp, Homo sapiens
aggtcccccagtcttctgagggg

SEQ ID NO: 6179 - DNA, 23 bp, Homo sapiens
cttcaaacagacttcactgcagg

SEQ ID NO: 6180 - DNA, 23 bp, Homo sapiens
ttcacaagccttcatatttctgg

SEQ ID NO: 6181 - DNA, 23 bp, Homo sapiens
tgcccccgtcggcccctaaatgg

SEQ ID NO: 6182 - DNA, 23 bp, Homo sapiens
acaaattcacagaggagacttgg

SEQ ID NO: 6183 - DNA, 23 bp, Homo sapiens
ctcagtcagaatccactgcatgg

SEQ ID NO: 6184 - DNA, 23 bp, Homo sapiens
gagctgtgagctggatcacaagg

SEQ ID NO: 6185 - DNA, 23 bp, Homo sapiens
aaggaagtacgtggcctcaatgg

SEQ ID NO: 6186 - DNA, 23 bp, Homo sapiens
gccctgttaaaggatggctttgg

SEQ ID NO: 6187 - DNA, 23 bp, Homo sapiens
ggctgccgtactgaggtgatggg

SEQ ID NO: 6188 - DNA, 23 bp, Homo sapiens
gggatggctcggccactatgagg

SEQ ID NO: 6189 - DNA, 23 bp, Homo sapiens
tccaggagttcggctttcccagg

SEQ ID NO: 6190 - DNA, 23 bp, Homo sapiens
ggagtacaggtggggccgtgagg

SEQ ID NO: 6191 - DNA, 23 bp, Homo sapiens
cttctggttgcaggactagtggg

SEQ ID NO: 6192 - DNA, 23 bp, Homo sapiens
aaaggctggcatgctgagcaagg

SEQ ID NO: 6193 - DNA, 23 bp, Homo sapiens
ttcttcttaaatggccactttgg

SEQ ID NO: 6194 - DNA, 23 bp, Homo sapiens
acacctcaaaaggcatgggaggg

SEQ ID NO: 6195 - DNA, 23 bp, Homo sapiens
tgtctagtgtactctgtgagagg

SEQ ID NO: 6196 - DNA, 23 bp, Homo sapiens
aagcctccgtgccagtagtcagg

SEQ ID NO: 6197 - DNA, 23 bp, Homo sapiens
ggtagaaggcctggctcaggtgg

SEQ ID NO: 6198 - DNA, 23 bp, Homo sapiens
gggcaaatccccacaggagaagg

SEQ ID NO: 6199 - DNA, 23 bp, Homo sapiens
agctcactcatcagcaatctcgg

SEQ ID NO: 6200 - DNA, 23 bp, Homo sapiens
ggagagggacaagaagccacagg

SEQ ID NO: 6201 - DNA, 23 bp, Homo sapiens
aacagagttggctgaggaagggg

SEQ ID NO: 6202 - DNA, 23 bp, Homo sapiens
gatcacaccagaagatggagagg

SEQ ID NO: 6203 - DNA, 23 bp, Homo sapiens
tgcagacattgaccatgaccagg

SEQ ID NO: 6204 - DNA, 23 bp, Homo sapiens
aacttgaagaagccatagaaagg

SEQ ID NO: 6205 - DNA, 23 bp, Homo sapiens
aggatcaagtctctgtcttgagg

SEQ ID NO: 6206 - DNA, 23 bp, Homo sapiens
ttggctgctgtggttggttcagg

SEQ ID NO: 6207 - DNA, 23 bp, Homo sapiens
aaggggagaatttcacagttcgg

SEQ ID NO: 6208 - DNA, 23 bp, Homo sapiens
agaaccagaagaacttaggaggg

SEQ ID NO: 6209 - DNA, 23 bp, Homo sapiens
caacactcatatctcagtcatgg

SEQ ID NO: 6210 - DNA, 23 bp, Homo sapiens
tacaggccctcagagctcagtgg

SEQ ID NO: 6211 - DNA, 23 bp, Homo sapiens
tactgaccactgagctctgaggg

SEQ ID NO: 6212 - DNA, 23 bp, Homo sapiens
agtttaagctgatagttcagggg

SEQ ID NO: 6213 - DNA, 23 bp, Homo sapiens
agacaacacagtagcgatggagg

SEQ ID NO: 6214 - DNA, 23 bp, Homo sapiens
agcagagacaacagtagctatgg

SEQ ID NO: 6215 - DNA, 23 bp, Homo sapiens
ggagatgggtgagatgcataggg

SEQ ID NO: 6216 - DNA, 23 bp, Homo sapiens
gcgggtgctggacgagaggaagg

SEQ ID NO: 6217 - DNA, 23 bp, Homo sapiens
tccctatgcacaggctcaccagg

SEQ ID NO: 6218 - DNA, 23 bp, Homo sapiens
tcagtgttaactatcgtatgtgg

SEQ ID NO: 6219 - DNA, 23 bp, Homo sapiens
tcttcacaaaggcctcacagtgg

SEQ ID NO: 6220 - DNA, 23 bp, Homo sapiens
ttgcagtattcagggattcaagg

SEQ ID NO: 6221 - DNA, 23 bp, Homo sapiens
ccagggggtgcaggtgtgagtgg

SEQ ID NO: 6222 - DNA, 23 bp, Homo sapiens
ttggctgggggccgtggggtggg

SEQ ID NO: 6223 - DNA, 23 bp, Homo sapiens
aggccctgtcgaggctcagatgg

SEQ ID NO: 6224 - DNA, 23 bp, Homo sapiens
cccgaacagccgctggatatggg

SEQ ID NO: 6225 - DNA, 23 bp, Homo sapiens
cttccgtcccgtgctttacacgg

SEQ ID NO: 6226 - DNA, 23 bp, Homo sapiens
ttattcagtactggctcagacgg

SEQ ID NO: 6227 - DNA, 23 bp, Homo sapiens
cgctgtggctcaggtgaccttgg

SEQ ID NO: 6228 - DNA, 23 bp, Homo sapiens
ggtgcagctggtaaacggaatgg

SEQ ID NO: 6229 - DNA, 23 bp, Homo sapiens
atgatgcacatacaggagaaggg

SEQ ID NO: 6230 - DNA, 23 bp, Homo sapiens
agaggttaagtgttagagtttgg

SEQ ID NO: 6231 - DNA, 23 bp, Homo sapiens
caaaggccgctgcttctagttgg

SEQ ID NO: 6232 - DNA, 23 bp, Homo sapiens
aaagcaggctaccagcaaaaagg

SEQ ID NO: 6233 - DNA, 23 bp, Homo sapiens
atgctacatttacatggaactgg

SEQ ID NO: 6234 - DNA, 23 bp, Homo sapiens
tcaccaggacccagagctggagg

SEQ ID NO: 6235 - DNA, 23 bp, Homo sapiens
ccctgctggctgtacatcagagg

SEQ ID NO: 6236 - DNA, 23 bp, Homo sapiens
aagtcagtcaccaacggcaatgg

SEQ ID NO: 6237 - DNA, 23 bp, Homo sapiens
gaaccagattcagtctgtggagg

SEQ ID NO: 6238 - DNA, 23 bp, Homo sapiens
agcaatgactgttcttgcggggg

SEQ ID NO: 6239 - DNA, 23 bp, Homo sapiens
agccggtgtcagacctgcacagg

SEQ ID NO: 6240 - DNA, 23 bp, Homo sapiens
gttcctgcaggtcagtactgcgg

SEQ ID NO: 6241 - DNA, 23 bp, Homo sapiens
gaggcagcagggctcagtggagg

SEQ ID NO: 6242 - DNA, 23 bp, Homo sapiens
agttcctgtcggtgctggagcgg

SEQ ID NO: 6243 - DNA, 23 bp, Homo sapiens
ttctacatctttgagaccaccgg

SEQ ID NO: 6244 - DNA, 23 bp, Homo sapiens
tgcaagacctgctggactagtgg

SEQ ID NO: 6245 - DNA, 23 bp, Homo sapiens
atttgttcactatgtcaggttgg

SEQ ID NO: 6246 - DNA, 23 bp, Homo sapiens
attatagtggaaatgtgtcctgg

SEQ ID NO: 6247 - DNA, 23 bp, Homo sapiens
gaagcaggctgaccagctacagg

SEQ ID NO: 6248 - DNA, 23 bp, Homo sapiens
tctcacaaggtcatcccaaccgg

SEQ ID NO: 6249 - DNA, 23 bp, Homo sapiens
ccccttccgccctggattatagg

SEQ ID NO: 6250 - DNA, 23 bp, Homo sapiens
ccaggcccaggcactagagaagg

SEQ ID NO: 6251 - DNA, 23 bp, Homo sapiens
tgggacggggcggggctcagagg

SEQ ID NO: 6252 - DNA, 23 bp, Homo sapiens
aggacaggggacagatgaccagg

SEQ ID NO: 6253 - DNA, 23 bp, Homo sapiens
caaattctgggggatcaacatgg

SEQ ID NO: 6254 - DNA, 23 bp, Homo sapiens
cagctatgtggcttgctcttagg

SEQ ID NO: 6255 - DNA, 23 bp, Homo sapiens
cttgcaggtgttcaggcagttgg

SEQ ID NO: 6256 - DNA, 23 bp, Homo sapiens
gtttattcttgcaggtgttcagg

SEQ ID NO: 6257 - DNA, 23 bp, Homo sapiens
ctggatttatgtagacagagagg

SEQ ID NO: 6258 - DNA, 23 bp, Homo sapiens
tctctctctctacagtgactggg

SEQ ID NO: 6259 - DNA, 23 bp, Homo sapiens
tatttggtcgcagctactgaggg

SEQ ID NO: 6260 - DNA, 23 bp, Homo sapiens
ggaacaagaagacttagaactgg

SEQ ID NO: 6261 - DNA, 23 bp, Homo sapiens
gcggaggactcaacttacagagg

SEQ ID NO: 6262 - DNA, 23 bp, Homo sapiens
acacacggccctcgcctaggcgg

SEQ ID NO: 6263 - DNA, 23 bp, Homo sapiens
cagttttggagccatggtaaagg

SEQ ID NO: 6264 - DNA, 23 bp, Homo sapiens
gcggaaccaagctggcttacagg

SEQ ID NO: 6265 - DNA, 23 bp, Homo sapiens
ggagtggaatcttttgatgaagg

SEQ ID NO: 6266 - DNA, 23 bp, Homo sapiens
ggaaggcgaggtggaaatggagg

SEQ ID NO: 6267 - DNA, 23 bp, Homo sapiens
gaggaggggggaggacagctagg

SEQ ID NO: 6268 - DNA, 23 bp, Homo sapiens
gtgtctaagctggtgcctaaggg

SEQ ID NO: 6269 - DNA, 23 bp, Homo sapiens
cctcatttatgcatgtttggagg

SEQ ID NO: 6270 - DNA, 23 bp, Homo sapiens
tatgaatagcggtaacagctggg

SEQ ID NO: 6271 - DNA, 23 bp, Homo sapiens
tcagcctggcgagggacatgagg

SEQ ID NO: 6272 - DNA, 23 bp, Homo sapiens
aattagacaaggctcccaacagg

SEQ ID NO: 6273 - DNA, 23 bp, Homo sapiens
gggttccttgatttcttcaccgg

SEQ ID NO: 6274 - DNA, 23 bp, Homo sapiens
cagtagagggtggtcacttgagg

SEQ ID NO: 6275 - DNA, 23 bp, Homo sapiens
gatcctgaagctgacgcaacagg

SEQ ID NO: 6276 - DNA, 23 bp, Homo sapiens
tgaagaaaacatcggttggatgg

SEQ ID NO: 6277 - DNA, 23 bp, Homo sapiens
gactctgaggacttggctaatgg

SEQ ID NO: 6278 - DNA, 23 bp, Homo sapiens
tactatccactctccaaactggg

SEQ ID NO: 6279 - DNA, 23 bp, Homo sapiens
gtggctgctctgtggcctgaagg

SEQ ID NO: 6280 - DNA, 23 bp, Homo sapiens
aagaccgttggactcacgagtgg

SEQ ID NO: 6281 - DNA, 23 bp, Homo sapiens
cttggccttctggttcacactgg

SEQ ID NO: 6282 - DNA, 23 bp, Homo sapiens
ggcaccgcagctcatctaccagg

SEQ ID NO: 6283 - DNA, 23 bp, Homo sapiens
ggagcaggagttacgttctctgg

SEQ ID NO: 6284 - DNA, 23 bp, Homo sapiens
tcaccttggccgctgtctaaagg

SEQ ID NO: 6285 - DNA, 23 bp, Homo sapiens
ttacagacaccggaatactgtgg

SEQ ID NO: 6286 - DNA, 23 bp, Homo sapiens
ttttgtccacagtgcttatgagg

SEQ ID NO: 6287 - DNA, 23 bp, Homo sapiens
ccccataaagcagggtcaagagg

SEQ ID NO: 6288 - DNA, 23 bp, Homo sapiens
tccgttgcatcccaaagccatgg

SEQ ID NO: 6289 - DNA, 23 bp, Homo sapiens
gagggcatatgggcatagccggg

SEQ ID NO: 6290 - DNA, 23 bp, Homo sapiens
caaaatgttgggattacaggcgg

SEQ ID NO: 6291 - DNA, 23 bp, Homo sapiens
tcatcagggtactttcaagaagg

SEQ ID NO: 6292 - DNA, 23 bp, Homo sapiens
attgctcagcagctctgagtggg

SEQ ID NO: 6293 - DNA, 23 bp, Homo sapiens
ctcagcactgtggaagcagcagg

SEQ ID NO: 6294 - DNA, 23 bp, Homo sapiens
acccgctcttcaagcgctttagg

SEQ ID NO: 6295 - DNA, 23 bp, Homo sapiens
tttgcagaagtcgtatcaaaagg

SEQ ID NO: 6296 - DNA, 23 bp, Homo sapiens
gacgtgcgaggggaagaaaaagg

SEQ ID NO: 6297 - DNA, 23 bp, Homo sapiens
cttctggtggtgaaggaatttgg

SEQ ID NO: 6298 - DNA, 23 bp, Homo sapiens
aaagtcaagagcataacttcagg

SEQ ID NO: 6299 - DNA, 23 bp, Homo sapiens
gagaagaagttcacacctccagg

SEQ ID NO: 6300 - DNA, 23 bp, Homo sapiens
ttatgtggtactctgtgtattgg

SEQ ID NO: 6301 - DNA, 23 bp, Homo sapiens
tcctgttctcacattctacaggg

SEQ ID NO: 6302 - DNA, 23 bp, Homo sapiens
tggagcagcagtgatgaagaagg

SEQ ID NO: 6303 - DNA, 23 bp, Homo sapiens
agagttgccgcaagtctgaatgg

SEQ ID NO: 6304 - DNA, 23 bp, Homo sapiens
tggagcaccgagactcctgaggg

SEQ ID NO: 6305 - DNA, 23 bp, Homo sapiens
tgtcctcctgggcgtgtgagcgg

SEQ ID NO: 6306 - DNA, 23 bp, Homo sapiens
agccatatgccttctcatctggg

SEQ ID NO: 6307 - DNA, 23 bp, Homo sapiens
agtagccgccttgcaaatccagg

SEQ ID NO: 6308 - DNA, 23 bp, Homo sapiens
tcattcaaagaccacactaaagg

SEQ ID NO: 6309 - DNA, 23 bp, Homo sapiens
agacagaagaagagaaactgagg

SEQ ID NO: 6310 - DNA, 23 bp, Homo sapiens
gtcaatgcatcttgcccagctgg

SEQ ID NO: 6311 - DNA, 23 bp, Homo sapiens
gaggtaagtggttgtctgtgtgg

SEQ ID NO: 6312 - DNA, 23 bp, Homo sapiens
tccctagatcaattttcttctgg

SEQ ID NO: 6313 - DNA, 23 bp, Homo sapiens
gtcggcaggcccaacaggctggg

SEQ ID NO: 6314 - DNA, 23 bp, Homo sapiens
ctaaaatgtggcatttgtggtgg

SEQ ID NO: 6315 - DNA, 23 bp, Homo sapiens
tgagactcaggccttcaatgagg

SEQ ID NO: 6316 - DNA, 23 bp, Homo sapiens
tgtcactggcatgtctgcaaagg

SEQ ID NO: 6317 - DNA, 23 bp, Homo sapiens
gacatcgaagccgttctgattgg

SEQ ID NO: 6318 - DNA, 23 bp, Homo sapiens
ggcgagtgtcttcatgatgttgg

SEQ ID NO: 6319 - DNA, 23 bp, Homo sapiens
gagaagagcagtgactaaaatgg

SEQ ID NO: 6320 - DNA, 23 bp, Homo sapiens
gctgaaaaacagatcaagtcagg

SEQ ID NO: 6321 - DNA, 23 bp, Homo sapiens
acagcaaagaacaaacagaatgg

SEQ ID NO: 6322 - DNA, 23 bp, Homo sapiens
agctctgacgaaggtgaagatgg

SEQ ID NO: 6323 - DNA, 23 bp, Homo sapiens
ccccaacaacgtgcaggtctagg

SEQ ID NO: 6324 - DNA, 23 bp, Homo sapiens
gactttgagatgatgatctgagg

SEQ ID NO: 6325 - DNA, 23 bp, Homo sapiens
ggttcactcttctatctatgtgg

SEQ ID NO: 6326 - DNA, 23 bp, Homo sapiens
attgccctttgtcacagttctgg

SEQ ID NO: 6327 - DNA, 23 bp, Homo sapiens
tctaaactctggttttaaggcgg

SEQ ID NO: 6328 - DNA, 23 bp, Homo sapiens
ttctttctctccccaactaaagg

SEQ ID NO: 6329 - DNA, 23 bp, Homo sapiens
atccaaaacaaagagagcacagg

SEQ ID NO: 6330 - DNA, 23 bp, Homo sapiens
acccttggagacggccactaagg

SEQ ID NO: 6331 - DNA, 23 bp, Homo sapiens
tcccaggaatcttcataaaaggg

SEQ ID NO: 6332 - DNA, 23 bp, Homo sapiens
ctcaaggctccttctttttaggg

SEQ ID NO: 6333 - DNA, 23 bp, Homo sapiens
ccagttacgaaaagaacaagtgg

SEQ ID NO: 6334 - DNA, 23 bp, Homo sapiens
tcctatcggaaaatcagaaaggg

SEQ ID NO: 6335 - DNA, 23 bp, Homo sapiens
gagatcgtaggtgcacacccagg

SEQ ID NO: 6336 - DNA, 23 bp, Homo sapiens
gaggggccgccctcgctcagagg

SEQ ID NO: 6337 - DNA, 23 bp, Homo sapiens
ggggccacagggaggtgaggtgg

SEQ ID NO: 6338 - DNA, 23 bp, Homo sapiens
tcataactaggtccactttctgg

SEQ ID NO: 6339 - DNA, 23 bp, Homo sapiens
aaagagcaactatttcctgtcgg

SEQ ID NO: 6340 - DNA, 23 bp, Homo sapiens
agaagtcagagttccacctttgg

SEQ ID NO: 6341 - DNA, 23 bp, Homo sapiens
gagaaagaggagctgtaaaaagg

SEQ ID NO: 6342 - DNA, 23 bp, Homo sapiens
aactagcacccagtgaatatagg

SEQ ID NO: 6343 - DNA, 23 bp, Homo sapiens
ggtctaaggagaaaccacatagg

SEQ ID NO: 6344 - DNA, 23 bp, Homo sapiens
atcccagttcagacttggaaagg

SEQ ID NO: 6345 - DNA, 23 bp, Homo sapiens
caagagtcacccttctaaggagg

SEQ ID NO: 6346 - DNA, 23 bp, Homo sapiens
ataaaggaatggaaatgccgcgg

SEQ ID NO: 6347 - DNA, 23 bp, Homo sapiens
agtttcaaatagggcaatgaagg

SEQ ID NO: 6348 - DNA, 23 bp, Homo sapiens
tatagagacaagggccaaagagg

SEQ ID NO: 6349 - DNA, 23 bp, Homo sapiens
aagattccgggaaactatggagg

SEQ ID NO: 6350 - DNA, 23 bp, Homo sapiens
tgtgcagctgagatttcctcagg

SEQ ID NO: 6351 - DNA, 23 bp, Homo sapiens
ccagagtcaagctggctctctgg

SEQ ID NO: 6352 - DNA, 23 bp, Homo sapiens
ctgtggcactggtcaatttctgg

SEQ ID NO: 6353 - DNA, 23 bp, Homo sapiens
attaggggtgttgcagtacttgg

SEQ ID NO: 6354 - DNA, 23 bp, Homo sapiens
tggagttttttcatgcattcagg

SEQ ID NO: 6355 - DNA, 23 bp, Homo sapiens
tgcttgaaactgctctgttttgg

SEQ ID NO: 6356 - DNA, 23 bp, Homo sapiens
aatcacagccgggatcagcgtgg

SEQ ID NO: 6357 - DNA, 23 bp, Homo sapiens
atggcttgcctgtctctctgcgg

SEQ ID NO: 6358 - DNA, 23 bp, Homo sapiens
gggacatcgctaagtactagagg

SEQ ID NO: 6359 - DNA, 23 bp, Homo sapiens
gaagctgagatgttcaactttgg

SEQ ID NO: 6360 - DNA, 23 bp, Homo sapiens
gaccagaggctttagacacgagg

SEQ ID NO: 6361 - DNA, 23 bp, Homo sapiens
gccagggagctctcagaccgtgg

SEQ ID NO: 6362 - DNA, 23 bp, Homo sapiens
gccaggcgtcactgagactgtgg

SEQ ID NO: 6363 - DNA, 23 bp, Homo sapiens
tcttttgcctgaagcaacgatgg

SEQ ID NO: 6364 - DNA, 23 bp, Homo sapiens
tgatgctcctgtcccacgtcagg

SEQ ID NO: 6365 - DNA, 23 bp, Homo sapiens
tgtcccacgtcaggcatgcgagg

SEQ ID NO: 6366 - DNA, 23 bp, Homo sapiens
ggcctacaatactggagttaagg

SEQ ID NO: 6367 - DNA, 23 bp, Homo sapiens
caggactctacccaaagaatggg

SEQ ID NO: 6368 - DNA, 23 bp, Homo sapiens
atgaagagctgagtgcctgctgg

SEQ ID NO: 6369 - DNA, 23 bp, Homo sapiens
caaggaatgggtgtgtttgtagg

SEQ ID NO: 6370 - DNA, 23 bp, Homo sapiens
ctcgaggccatgatggactgagg

SEQ ID NO: 6371 - DNA, 23 bp, Homo sapiens
gctccaagccagatgttacatgg

SEQ ID NO: 6372 - DNA, 23 bp, Homo sapiens
gggagcttttagtcagaccttgg

SEQ ID NO: 6373 - DNA, 23 bp, Homo sapiens
ccctgcccggcgcaaagcttcgg

SEQ ID NO: 6374 - DNA, 23 bp, Homo sapiens
ggctcctgtacacatcacatggg

SEQ ID NO: 6375 - DNA, 23 bp, Homo sapiens
caaggacaagggcagctcctagg

SEQ ID NO: 6376 - DNA, 23 bp, Homo sapiens
tgcggctatgtcatcgcctgagg

SEQ ID NO: 6377 - DNA, 23 bp, Homo sapiens
gaattctcatcatcagcttctgg

SEQ ID NO: 6378 - DNA, 23 bp, Homo sapiens
tcacacagaagaaaggagttagg

SEQ ID NO: 6379 - DNA, 23 bp, Homo sapiens
gggagctgcatttacagatgagg

SEQ ID NO: 6380 - DNA, 23 bp, Homo sapiens
ttttgaccttgatgactactagg

SEQ ID NO: 6381 - DNA, 23 bp, Homo sapiens
attttccaagtggcagattatgg

SEQ ID NO: 6382 - DNA, 23 bp, Homo sapiens
ccaagctgaaggagattgggcgg

SEQ ID NO: 6383 - DNA, 23 bp, Homo sapiens
ctgacaacaagcacagtgtgggg

SEQ ID NO: 6384 - DNA, 23 bp, Homo sapiens
ggaggaggacctgcttacaatgg

SEQ ID NO: 6385 - DNA, 23 bp, Homo sapiens
tcatagctctgtatttcctaagg

SEQ ID NO: 6386 - DNA, 23 bp, Homo sapiens
acagaagtgagatcaggcagtgg

SEQ ID NO: 6387 - DNA, 23 bp, Homo sapiens
acttttaatgcagtaacctcagg

SEQ ID NO: 6388 - DNA, 23 bp, Homo sapiens
taaccggctgcagagggtcaagg

SEQ ID NO: 6389 - DNA, 23 bp, Homo sapiens
cctgaggaaatcaaagtcgatgg

SEQ ID NO: 6390 - DNA, 23 bp, Homo sapiens
gatggggtggctggtcactttgg

SEQ ID NO: 6391 - DNA, 23 bp, Homo sapiens
cacattcactgctcagtaagagg

SEQ ID NO: 6392 - DNA, 23 bp, Homo sapiens
agccagatgccgacgagtgatgg

SEQ ID NO: 6393 - DNA, 23 bp, Homo sapiens
cagcccgacacggaggactgagg

SEQ ID NO: 6394 - DNA, 23 bp, Homo sapiens
aacccccacccctacaacgaagg

SEQ ID NO: 6395 - DNA, 23 bp, Homo sapiens
gactgtgcgggaggcggacgggg

SEQ ID NO: 6396 - DNA, 23 bp, Homo sapiens
cagctgctgttgccaagccctgg

SEQ ID NO: 6397 - DNA, 23 bp, Homo sapiens
ttcatcaacattcggtcaagtgg

SEQ ID NO: 6398 - DNA, 23 bp, Homo sapiens
accttcctctctagttaaggagg

SEQ ID NO: 6399 - DNA, 23 bp, Homo sapiens
ctagtaagagtagccacccttgg

SEQ ID NO: 6400 - DNA, 23 bp, Homo sapiens
aacttagtaagcaaagccttcgg

SEQ ID NO: 6401 - DNA, 23 bp, Homo sapiens
accaagaagatgaatgctgaagg

SEQ ID NO: 6402 - DNA, 23 bp, Homo sapiens
gccagaaatctctccgtgagggg

SEQ ID NO: 6403 - DNA, 23 bp, Homo sapiens
ttttggctatttggggtcactgg

SEQ ID NO: 6404 - DNA, 23 bp, Homo sapiens
agcctgaatcgctactattaggg

SEQ ID NO: 6405 - DNA, 23 bp, Homo sapiens
ccgcatgcactattactgatggg

SEQ ID NO: 6406 - DNA, 23 bp, Homo sapiens
catgtggttttcagtagaactgg

SEQ ID NO: 6407 - DNA, 23 bp, Homo sapiens
aaagtgaagctggggacagtggg

SEQ ID NO: 6408 - DNA, 23 bp, Homo sapiens
acatagagacacagggaaggagg

SEQ ID NO: 6409 - DNA, 23 bp, Homo sapiens
ggccatgagggccttgggcatgg

SEQ ID NO: 6410 - DNA, 23 bp, Homo sapiens
agggaaagaaaagatgaagaagg

SEQ ID NO: 6411 - DNA, 23 bp, Homo sapiens
atttataacagttctgcaggtgg

SEQ ID NO: 6412 - DNA, 23 bp, Homo sapiens
acaatgtggattccatcaaaagg

SEQ ID NO: 6413 - DNA, 23 bp, Homo sapiens
tcacagtgatggtcagacagtgg

SEQ ID NO: 6414 - DNA, 23 bp, Homo sapiens
agccagggtctggacaactgagg

SEQ ID NO: 6415 - DNA, 23 bp, Homo sapiens
tgggatcagcaccacgtaagggg

SEQ ID NO: 6416 - DNA, 23 bp, Homo sapiens
ccgcgctcccttcgctgacacgg

SEQ ID NO: 6417 - DNA, 23 bp, Homo sapiens
cccttcatgcagagtcaatgagg

SEQ ID NO: 6418 - DNA, 23 bp, Homo sapiens
ggtgcccctcactagataagggg

SEQ ID NO: 6419 - DNA, 23 bp, Homo sapiens
cccgccggaccagagggacgagg

SEQ ID NO: 6420 - DNA, 23 bp, Homo sapiens
ccggcagcataatgaaaagtggg

SEQ ID NO: 6421 - DNA, 23 bp, Homo sapiens
gcggggtctctgcatctagtagg

SEQ ID NO: 6422 - DNA, 23 bp, Homo sapiens
ctctagggcagatttagaaaagg

SEQ ID NO: 6423 - DNA, 23 bp, Homo sapiens
aaagcagctatcaagacagctgg

SEQ ID NO: 6424 - DNA, 23 bp, Homo sapiens
agcagttaactcttttcactcgg

SEQ ID NO: 6425 - DNA, 23 bp, Homo sapiens
attgtctggctgtcctcagaagg

SEQ ID NO: 6426 - DNA, 23 bp, Homo sapiens
aatgagctctggaaaaactttgg

SEQ ID NO: 6427 - DNA, 23 bp, Homo sapiens
ttgcagcagtctgcatttactgg

SEQ ID NO: 6428 - DNA, 23 bp, Homo sapiens
tggagtgctcagctctacactgg

SEQ ID NO: 6429 - DNA, 23 bp, Homo sapiens
tcttctttcacaaggtttagtgg

SEQ ID NO: 6430 - DNA, 23 bp, Homo sapiens
tgtggtacacagcttcagagtgg

SEQ ID NO: 6431 - DNA, 23 bp, Homo sapiens
tcatggttgaagaagctgcttgg

SEQ ID NO: 6432 - DNA, 23 bp, Homo sapiens
cggaggctacttgagcagcttgg

SEQ ID NO: 6433 - DNA, 23 bp, Homo sapiens
tggtttattctgcgagcagcagg

SEQ ID NO: 6434 - DNA, 23 bp, Homo sapiens
gacctcgggcccagcgctgaggg

SEQ ID NO: 6435 - DNA, 23 bp, Homo sapiens
agccagagagaactagacgcagg

SEQ ID NO: 6436 - DNA, 23 bp, Homo sapiens
aagataactaccgtttagcaggg

SEQ ID NO: 6437 - DNA, 23 bp, Homo sapiens
agtcggagtggagaactgcaagg

SEQ ID NO: 6438 - DNA, 23 bp, Homo sapiens
ctcagctgaagtgtcgagcaagg

SEQ ID NO: 6439 - DNA, 23 bp, Homo sapiens
catgtgaggtctacatgtgctgg

SEQ ID NO: 6440 - DNA, 23 bp, Homo sapiens
cagcagccaccactcatgaaggg

SEQ ID NO: 6441 - DNA, 23 bp, Homo sapiens
agcagggtcagagcagtcactgg

SEQ ID NO: 6442 - DNA, 23 bp, Homo sapiens
ctagcagcaggctcaggcagagg

SEQ ID NO: 6443 - DNA, 23 bp, Homo sapiens
tctctgccctggtctcatgaggg

SEQ ID NO: 6444 - DNA, 23 bp, Homo sapiens
tcctgaaagtacaacatcagtgg

SEQ ID NO: 6445 - DNA, 23 bp, Homo sapiens
actaggatggctttcttatctgg

SEQ ID NO: 6446 - DNA, 23 bp, Homo sapiens
actgaaaaagacaaggttgttgg

SEQ ID NO: 6447 - DNA, 23 bp, Homo sapiens
ttcttaggtctgcaagaattcgg

SEQ ID NO: 6448 - DNA, 23 bp, Homo sapiens
gtcttccaggactatctctgtgg

SEQ ID NO: 6449 - DNA, 23 bp, Homo sapiens
ttggaacaggagggataaggagg

SEQ ID NO: 6450 - DNA, 23 bp, Homo sapiens
atatcaactttctgccaatctgg

SEQ ID NO: 6451 - DNA, 23 bp, Homo sapiens
tcctgtatgatttcacaatctgg

SEQ ID NO: 6452 - DNA, 23 bp, Homo sapiens
tgaggcctctatcttgctggggg

SEQ ID NO: 6453 - DNA, 23 bp, Homo sapiens
aggcgttactccaagagctgagg

SEQ ID NO: 6454 - DNA, 23 bp, Homo sapiens
tcaggcttctggttcagggctgg

SEQ ID NO: 6455 - DNA, 23 bp, Homo sapiens
gttgatgtgcaaatcatcccagg

SEQ ID NO: 6456 - DNA, 23 bp, Homo sapiens
aaatgtggtggctgtttatttgg

SEQ ID NO: 6457 - DNA, 23 bp, Homo sapiens
tgctttttcttgttttgcactgg

SEQ ID NO: 6458 - DNA, 23 bp, Homo sapiens
gacaaagagtcagaactgtgagg

SEQ ID NO: 6459 - DNA, 23 bp, Homo sapiens
cgagacattgagcgactttgagg

SEQ ID NO: 6460 - DNA, 23 bp, Homo sapiens
gtttcataagctgccaatgttgg

SEQ ID NO: 6461 - DNA, 23 bp, Homo sapiens
agcctggagaagccctagggggg

SEQ ID NO: 6462 - DNA, 23 bp, Homo sapiens
tggcatatggaaaaccaaactgg

SEQ ID NO: 6463 - DNA, 23 bp, Homo sapiens
agtgcttcaagttcatctagggg

SEQ ID NO: 6464 - DNA, 23 bp, Homo sapiens
aaagtgccgagcgctgttacagg

SEQ ID NO: 6465 - DNA, 23 bp, Homo sapiens
ggagctggagtatttatagcagg

SEQ ID NO: 6466 - DNA, 23 bp, Homo sapiens
atactcttcatccagttaagtgg

SEQ ID NO: 6467 - DNA, 23 bp, Homo sapiens
gaaaatcaagctctaaagcctgg

SEQ ID NO: 6468 - DNA, 23 bp, Homo sapiens
aatactctaattccagtgcttgg

SEQ ID NO: 6469 - DNA, 23 bp, Homo sapiens
atgggctggcaacatgtatctgg

SEQ ID NO: 6470 - DNA, 23 bp, Homo sapiens
tgatggagatgaacaaaatgagg

SEQ ID NO: 6471 - DNA, 23 bp, Homo sapiens
ttcttacgataaatcccacctgg

SEQ ID NO: 6472 - DNA, 23 bp, Homo sapiens
gtggggcctgggagggctaaagg

SEQ ID NO: 6473 - DNA, 23 bp, Homo sapiens
gaggaggtagcagatgtcaaggg

SEQ ID NO: 6474 - DNA, 23 bp, Homo sapiens
ggtcctggcctggctgttacagg

SEQ ID NO: 6475 - DNA, 23 bp, Homo sapiens
aggcaggcgccacgttcatgcgg

SEQ ID NO: 6476 - DNA, 23 bp, Homo sapiens
tgagtgggatctcactttaatgg

SEQ ID NO: 6477 - DNA, 23 bp, Homo sapiens
aaaactcaagcagtgtgaatggg

SEQ ID NO: 6478 - DNA, 23 bp, Homo sapiens
gagccgaccaggctcacaccagg

SEQ ID NO: 6479 - DNA, 23 bp, Homo sapiens
gtccctgagcaatcaggaaacgg

SEQ ID NO: 6480 - DNA, 23 bp, Homo sapiens
cagcttcctgtgcattcacatgg

SEQ ID NO: 6481 - DNA, 23 bp, Homo sapiens
ttagaatgcaatgtgacagaggg

SEQ ID NO: 6482 - DNA, 23 bp, Homo sapiens
tgatcagtttggagagtaggggg

SEQ ID NO: 6483 - DNA, 23 bp, Homo sapiens
gttattcaggttactagagcagg

SEQ ID NO: 6484 - DNA, 23 bp, Homo sapiens
gaggacctggaaaactcaatagg

SEQ ID NO: 6485 - DNA, 23 bp, Homo sapiens
gtaagcagtggagtgatttctgg

SEQ ID NO: 6486 - DNA, 23 bp, Homo sapiens
ccttccccactttgtgtcactgg

SEQ ID NO: 6487 - DNA, 23 bp, Homo sapiens
ccccactgaatgtttcataaagg

SEQ ID NO: 6488 - DNA, 23 bp, Homo sapiens
aggagtggggcagagctggaagg

SEQ ID NO: 6489 - DNA, 23 bp, Homo sapiens
gcacttcgcctggaactctttgg

SEQ ID NO: 6490 - DNA, 23 bp, Homo sapiens
gggctgctgggctagggaaatgg

SEQ ID NO: 6491 - DNA, 23 bp, Homo sapiens
aggcacaggacctctactgaggg

SEQ ID NO: 6492 - DNA, 23 bp, Homo sapiens
accatctccccctcaggacaggg

SEQ ID NO: 6493 - DNA, 23 bp, Homo sapiens
ccggtatgtcaactggattaagg

SEQ ID NO: 6494 - DNA, 23 bp, Homo sapiens
ggagttgtcactgcgtcttcagg

SEQ ID NO: 6495 - DNA, 23 bp, Homo sapiens
ctgaaaagcagtcatcctgatgg

SEQ ID NO: 6496 - DNA, 23 bp, Homo sapiens
ctgtccaggaaagttttaggagg

SEQ ID NO: 6497 - DNA, 23 bp, Homo sapiens
agcctcatcctgctgtgaccagg

SEQ ID NO: 6498 - DNA, 23 bp, Homo sapiens
aaagcacagaagacgtgacgtgg

SEQ ID NO: 6499 - DNA, 23 bp, Homo sapiens
cacctgcctcagcctctcaaagg

SEQ ID NO: 6500 - DNA, 23 bp, Homo sapiens
ctgccgagggggctgtcatgcgg

SEQ ID NO: 6501 - DNA, 23 bp, Homo sapiens
gccagaaggagttcgcccccagg

SEQ ID NO: 6502 - DNA, 23 bp, Homo sapiens
gggggcagcttaggagccagcgg

SEQ ID NO: 6503 - DNA, 23 bp, Homo sapiens
tgaatgaccctggcagtcaaggg

SEQ ID NO: 6504 - DNA, 23 bp, Homo sapiens
gcctgcctcagcctctcaaaggg

SEQ ID NO: 6505 - DNA, 23 bp, Homo sapiens
ccctgaggccagccctcacctgg

SEQ ID NO: 6506 - DNA, 23 bp, Homo sapiens
gacaatgtcacccaatgtcatgg

SEQ ID NO: 6507 - DNA, 23 bp, Homo sapiens
aactcagtctcaaactcttaagg

SEQ ID NO: 6508 - DNA, 23 bp, Homo sapiens
atgaaggagtagaagccaaaagg

SEQ ID NO: 6509 - DNA, 23 bp, Homo sapiens
cactcgcacttatgagaaagagg

SEQ ID NO: 6510 - DNA, 23 bp, Homo sapiens
tgctctctcataaactctcgtgg

SEQ ID NO: 6511 - DNA, 23 bp, Homo sapiens
tttttcatagatccgagtacagg

SEQ ID NO: 6512 - DNA, 23 bp, Homo sapiens
tgagcgcgtgagcaagagactgg

SEQ ID NO: 6513 - DNA, 23 bp, Homo sapiens
aaggaaggaaggaggaagaatgg

SEQ ID NO: 6514 - DNA, 23 bp, Homo sapiens
tgctgttcgccactatgagaagg

SEQ ID NO: 6515 - DNA, 23 bp, Homo sapiens
cagcaccagaatctacgaaaagg

SEQ ID NO: 6516 - DNA, 23 bp, Homo sapiens
tacctccgaagcgtcctgatggg

SEQ ID NO: 6517 - DNA, 23 bp, Homo sapiens
ggcagggtggctgttgttattgg

SEQ ID NO: 6518 - DNA, 23 bp, Homo sapiens
ggctgtggcttcatttgtgaagg

SEQ ID NO: 6519 - DNA, 23 bp, Homo sapiens
acgcctacctccatcagtgaagg

SEQ ID NO: 6520 - DNA, 23 bp, Homo sapiens
gagcttgtggggctgtaatgagg

SEQ ID NO: 6521 - DNA, 23 bp, Homo sapiens
actcttttgcttcaaggaaaagg

SEQ ID NO: 6522 - DNA, 23 bp, Homo sapiens
aacttctgtgtggctgagtccgg

SEQ ID NO: 6523 - DNA, 23 bp, Homo sapiens
gagcagagaaaatctcatgatgg

SEQ ID NO: 6524 - DNA, 23 bp, Homo sapiens
tgtgagactacaggaatgaaggg

SEQ ID NO: 6525 - DNA, 23 bp, Homo sapiens
ccctcagcttcccgtttctgagg

SEQ ID NO: 6526 - DNA, 23 bp, Homo sapiens
cgaggctggcatacacgggctgg

SEQ ID NO: 6527 - DNA, 23 bp, Homo sapiens
agtcactgggcccatcacaaggg

SEQ ID NO: 6528 - DNA, 23 bp, Homo sapiens
tcatcaacaaggtggtgtgatgg

SEQ ID NO: 6529 - DNA, 23 bp, Homo sapiens
gtagtgggaagcggaaagaaggg

SEQ ID NO: 6530 - DNA, 23 bp, Homo sapiens
tttggcactaaccgagaatgagg

SEQ ID NO: 6531 - DNA, 23 bp, Homo sapiens
cccggacacctgctcctcaatgg

SEQ ID NO: 6532 - DNA, 23 bp, Homo sapiens
gcagtcatcatcttccaaatagg

SEQ ID NO: 6533 - DNA, 23 bp, Homo sapiens
ttctatcagtagtaaccgtaagg

SEQ ID NO: 6534 - DNA, 23 bp, Homo sapiens
ctgccggcacatcatgtcagagg

SEQ ID NO: 6535 - DNA, 23 bp, Homo sapiens
gtctggctcaagctgccttccgg

SEQ ID NO: 6536 - DNA, 23 bp, Homo sapiens
gtgtgcacttcagacttagtagg

SEQ ID NO: 6537 - DNA, 23 bp, Homo sapiens
tcaacagcctgcagcagcgaggg

SEQ ID NO: 6538 - DNA, 23 bp, Homo sapiens
tcaatacttcacagcagggaagg

SEQ ID NO: 6539 - DNA, 23 bp, Homo sapiens
ccccagcggacttaaaagactgg

SEQ ID NO: 6540 - DNA, 23 bp, Homo sapiens
tgtaataggcacagaacgttagg

SEQ ID NO: 6541 - DNA, 23 bp, Homo sapiens
agcgaagagagagagctgtaggg

SEQ ID NO: 6542 - DNA, 23 bp, Homo sapiens
cgcccaagcccaggagtcctagg

SEQ ID NO: 6543 - DNA, 23 bp, Homo sapiens
ctggagcagaaaatgacatcagg

SEQ ID NO: 6544 - DNA, 23 bp, Homo sapiens
gggggatgcaggctctgagaagg

SEQ ID NO: 6545 - DNA, 23 bp, Homo sapiens
caaaatgtgaggaacaggatagg

SEQ ID NO: 6546 - DNA, 23 bp, Homo sapiens
gagcccagcagctgaaggctagg

SEQ ID NO: 6547 - DNA, 23 bp, Homo sapiens
tccacgcactgtcttacacatgg

SEQ ID NO: 6548 - DNA, 23 bp, Homo sapiens
ttcaagaagtcttcatcatcggg

SEQ ID NO: 6549 - DNA, 23 bp, Homo sapiens
gagccgcggcggtcacacctcgg

SEQ ID NO: 6550 - DNA, 23 bp, Homo sapiens
tgtagaaatgatgagtgatgagg

SEQ ID NO: 6551 - DNA, 23 bp, Homo sapiens
agatcatcagattgaacccatgg

SEQ ID NO: 6552 - DNA, 23 bp, Homo sapiens
aagcagaatgacaagggaggtgg

SEQ ID NO: 6553 - DNA, 23 bp, Homo sapiens
acaattgagtaatgtgctagagg

SEQ ID NO: 6554 - DNA, 23 bp, Homo sapiens
ttgaaagcacagccgtgacctgg

SEQ ID NO: 6555 - DNA, 23 bp, Homo sapiens
tcacacagacatgagctgcaggg

SEQ ID NO: 6556 - DNA, 23 bp, Homo sapiens
agagctccctgatggtctgaggg

SEQ ID NO: 6557 - DNA, 23 bp, Homo sapiens
aattgaggaagctgaaggatagg

SEQ ID NO: 6558 - DNA, 23 bp, Homo sapiens
aagaggaagttagaagagaatgg

SEQ ID NO: 6559 - DNA, 23 bp, Homo sapiens
gcagcacacagtgaaataagagg

SEQ ID NO: 6560 - DNA, 23 bp, Homo sapiens
ccgcagagaagctgctctggagg

SEQ ID NO: 6561 - DNA, 23 bp, Homo sapiens
aaaatgcacaagagattacgagg

SEQ ID NO: 6562 - DNA, 23 bp, Homo sapiens
caaaaggacaaaacacccatagg

SEQ ID NO: 6563 - DNA, 23 bp, Homo sapiens
aagaatgatcttagtgttggtgg

SEQ ID NO: 6564 - DNA, 23 bp, Homo sapiens
atgagcatgaccagtggagaagg

SEQ ID NO: 6565 - DNA, 23 bp, Homo sapiens
aactgtggcacaacggaaagagg

SEQ ID NO: 6566 - DNA, 23 bp, Homo sapiens
ccatagggcagctcacaacatgg

SEQ ID NO: 6567 - DNA, 23 bp, Homo sapiens
cggtctcgctcccaggtaaatgg

SEQ ID NO: 6568 - DNA, 23 bp, Homo sapiens
ttagacgaaagttcatctagtgg

SEQ ID NO: 6569 - DNA, 23 bp, Homo sapiens
tcagaaatggttaagtcacttgg

SEQ ID NO: 6570 - DNA, 23 bp, Homo sapiens
tcctgccttgaccagatgtgtgg

SEQ ID NO: 6571 - DNA, 23 bp, Homo sapiens
cctgtgtcaccttctgatactgg

SEQ ID NO: 6572 - DNA, 23 bp, Homo sapiens
attacatgcttgcaactttgtgg

SEQ ID NO: 6573 - DNA, 23 bp, Homo sapiens
catagtctcaaggtcagaagagg

SEQ ID NO: 6574 - DNA, 23 bp, Homo sapiens
ctacttccagctacttttgatgg

SEQ ID NO: 6575 - DNA, 23 bp, Homo sapiens
gcccctttgatcaatggacttgg

SEQ ID NO: 6576 - DNA, 23 bp, Homo sapiens
tcctcttccaaaggaagcagggg

SEQ ID NO: 6577 - DNA, 23 bp, Homo sapiens
ccccggggataacgacatggagg

SEQ ID NO: 6578 - DNA, 23 bp, Homo sapiens
gactggtactatagtgtttgagg

SEQ ID NO: 6579 - DNA, 23 bp, Homo sapiens
ccctgaggtcttcaccttctggg

SEQ ID NO: 6580 - DNA, 23 bp, Homo sapiens
ctccttcatctgcaagttcaggg

SEQ ID NO: 6581 - DNA, 23 bp, Homo sapiens
agagtaatgctaatactaggagg

SEQ ID NO: 6582 - DNA, 23 bp, Homo sapiens
gaggatgtcaaaactacacctgg

SEQ ID NO: 6583 - DNA, 23 bp, Homo sapiens
ctgccctcagaggagtgaaaggg

SEQ ID NO: 6584 - DNA, 23 bp, Homo sapiens
aggggtgcagactgagttctagg

SEQ ID NO: 6585 - DNA, 23 bp, Homo sapiens
tcaggaatatctcattgtcttgg

SEQ ID NO: 6586 - DNA, 23 bp, Homo sapiens
tgtgggtgaagattcagctccgg

SEQ ID NO: 6587 - DNA, 23 bp, Homo sapiens
gatgtgggtcactgttcctctgg

SEQ ID NO: 6588 - DNA, 23 bp, Homo sapiens
tgggggaggaaactagttgttgg

SEQ ID NO: 6589 - DNA, 23 bp, Homo sapiens
gaggtgttctataactgaggtgg

SEQ ID NO: 6590 - DNA, 23 bp, Homo sapiens
ctggatcaagtcacaagtcaagg

SEQ ID NO: 6591 - DNA, 23 bp, Homo sapiens
tcttaatgttatggtgagtcagg

SEQ ID NO: 6592 - DNA, 23 bp, Homo sapiens
atacagctgattcactcattggg

SEQ ID NO: 6593 - DNA, 23 bp, Homo sapiens
gactcaactacttcaagtagtgg

SEQ ID NO: 6594 - DNA, 23 bp, Homo sapiens
aaggaggctctcttatcaattgg

SEQ ID NO: 6595 - DNA, 23 bp, Homo sapiens
tgattccaagtccatgtgagggg

SEQ ID NO: 6596 - DNA, 23 bp, Homo sapiens
aacttcaagaagcctaagcttgg

SEQ ID NO: 6597 - DNA, 23 bp, Homo sapiens
gatgtggccaaaactatttgagg

SEQ ID NO: 6598 - DNA, 23 bp, Homo sapiens
gctgcaattttttgcaggaacgg

SEQ ID NO: 6599 - DNA, 23 bp, Homo sapiens
ggtggtttcaagatgtcacttgg

SEQ ID NO: 6600 - DNA, 23 bp, Homo sapiens
cgaaccaggcagggaccataagg

SEQ ID NO: 6601 - DNA, 23 bp, Homo sapiens
aaggacttgctggctcatgttgg

SEQ ID NO: 6602 - DNA, 23 bp, Homo sapiens
tacagcctgactatttggactgg

SEQ ID NO: 6603 - DNA, 23 bp, Homo sapiens
gtggaatgtcctgaaatgttggg

SEQ ID NO: 6604 - DNA, 23 bp, Homo sapiens
actcaaccaatgaggagtaacgg

SEQ ID NO: 6605 - DNA, 23 bp, Homo sapiens
actgtcactcttcccgtgtcagg

SEQ ID NO: 6606 - DNA, 23 bp, Homo sapiens
gctgctcaagcagtggttagagg

SEQ ID NO: 6607 - DNA, 23 bp, Homo sapiens
tttatgggactggtccacatagg

SEQ ID NO: 6608 - DNA, 23 bp, Homo sapiens
ttgatgctgcatttgaattgagg

SEQ ID NO: 6609 - DNA, 23 bp, Homo sapiens
caagatcttgggtgactttgagg

SEQ ID NO: 6610 - DNA, 23 bp, Homo sapiens
tggaagaaagttaaggattgagg

SEQ ID NO: 6611 - DNA, 23 bp, Homo sapiens
agatgttatttatggtgtggagg

SEQ ID NO: 6612 - DNA, 23 bp, Homo sapiens
ttgccttcatggtggtaagaggg

SEQ ID NO: 6613 - DNA, 23 bp, Homo sapiens
ctccccagccccggaagggcagg

SEQ ID NO: 6614 - DNA, 23 bp, Homo sapiens
ctcttcttcactttcctcattgg

SEQ ID NO: 6615 - DNA, 23 bp, Homo sapiens
gcaagtgatacgagattttctgg

SEQ ID NO: 6616 - DNA, 23 bp, Homo sapiens
atacctctgctactctgttttgg

SEQ ID NO: 6617 - DNA, 23 bp, Homo sapiens
agaagctgcattggctgcacagg

SEQ ID NO: 6618 - DNA, 23 bp, Homo sapiens
acgtctgtactaatagcccttgg

SEQ ID NO: 6619 - DNA, 23 bp, Homo sapiens
ttacatacggacggctgacatgg

SEQ ID NO: 6620 - DNA, 23 bp, Homo sapiens
ccaggctcgtggcagggataagg

SEQ ID NO: 6621 - DNA, 23 bp, Homo sapiens
gagggcctactggaaggaatggg

SEQ ID NO: 6622 - DNA, 23 bp, Homo sapiens
acaaagagaaaatggtttggagg

SEQ ID NO: 6623 - DNA, 23 bp, Homo sapiens
catagttaggtaaaagacccagg

SEQ ID NO: 6624 - DNA, 23 bp, Homo sapiens
ccagaagcagctcttggcttagg

SEQ ID NO: 6625 - DNA, 23 bp, Homo sapiens
cggaggttctctctctgctgagg

SEQ ID NO: 6626 - DNA, 23 bp, Homo sapiens
cggcgcttcaccctctgctgagg

SEQ ID NO: 6627 - DNA, 23 bp, Homo sapiens
ggctgcaggctttaccagtgtgg

SEQ ID NO: 6628 - DNA, 23 bp, Homo sapiens
tttgcaggtgatcaccactgagg

SEQ ID NO: 6629 - DNA, 23 bp, Homo sapiens
agaaagctaagctgacctgaagg

SEQ ID NO: 6630 - DNA, 23 bp, Homo sapiens
cgtctggagacgtcagggactgg

SEQ ID NO: 6631 - DNA, 23 bp, Homo sapiens
tgtttcattctccaaaggacagg

SEQ ID NO: 6632 - DNA, 23 bp, Homo sapiens
ggtgctctcagcacagcagcagg

SEQ ID NO: 6633 - DNA, 23 bp, Homo sapiens
ttaatgttaaacgccatcagggg

SEQ ID NO: 6634 - DNA, 23 bp, Homo sapiens
ttgacgttgaacaccatcagcgg

SEQ ID NO: 6635 - DNA, 23 bp, Homo sapiens
tccccattggagttaatttatgg

SEQ ID NO: 6636 - DNA, 23 bp, Homo sapiens
caagcacgaagagctgtaagagg

SEQ ID NO: 6637 - DNA, 23 bp, Homo sapiens
tatcgtgtctaatactcagctgg

SEQ ID NO: 6638 - DNA, 23 bp, Homo sapiens
agataccgcgcttggcgagaagg

SEQ ID NO: 6639 - DNA, 23 bp, Homo sapiens
tttatgcttgaatgggcagctgg

SEQ ID NO: 6640 - DNA, 23 bp, Homo sapiens
acctttagaacaggatgatgagg

SEQ ID NO: 6641 - DNA, 23 bp, Homo sapiens
tgaagaggatgatgaagatgagg

SEQ ID NO: 6642 - DNA, 23 bp, Homo sapiens
ttttatggtgggacagagactgg

SEQ ID NO: 6643 - DNA, 23 bp, Homo sapiens
ctggatgaggtgcttcactgagg

SEQ ID NO: 6644 - DNA, 23 bp, Homo sapiens
cccctggaaagacatctaaaggg

SEQ ID NO: 6645 - DNA, 23 bp, Homo sapiens
tgtgggccagtctctcagggagg

SEQ ID NO: 6646 - DNA, 23 bp, Homo sapiens
gaacaaaagaggagggtcagggg

SEQ ID NO: 6647 - DNA, 23 bp, Homo sapiens
ggccctctccgcgtggctagagg

SEQ ID NO: 6648 - DNA, 23 bp, Homo sapiens
gcgtgcctcgaagtcagtcccgg

SEQ ID NO: 6649 - DNA, 23 bp, Homo sapiens
atccgctgggatgctacttgtgg

SEQ ID NO: 6650 - DNA, 23 bp, Homo sapiens
tctttcagaatgtgaagtaccgg

SEQ ID NO: 6651 - DNA, 23 bp, Homo sapiens
agtacttggtgaaccattcctgg

SEQ ID NO: 6652 - DNA, 23 bp, Homo sapiens
gtttcagtccctgaaactgcagg

SEQ ID NO: 6653 - DNA, 23 bp, Homo sapiens
ctcttgcatccctccaatcacgg

SEQ ID NO: 6654 - DNA, 23 bp, Homo sapiens
tattccccggctgttgacactgg

SEQ ID NO: 6655 - DNA, 23 bp, Homo sapiens
gagctgaagagagctcctagggg

SEQ ID NO: 6656 - DNA, 23 bp, Homo sapiens
gagaagcacacaggtgctggtgg

SEQ ID NO: 6657 - DNA, 23 bp, Homo sapiens
acgttctggaccaggtatgaagg

SEQ ID NO: 6658 - DNA, 23 bp, Homo sapiens
ttctgtcttccagggttcacagg

SEQ ID NO: 6659 - DNA, 23 bp, Homo sapiens
acgggggcagccgggagactggg

SEQ ID NO: 6660 - DNA, 23 bp, Homo sapiens
tgtagggacggagaaactagggg

SEQ ID NO: 6661 - DNA, 23 bp, Homo sapiens
tgaggtgggcagatcacttgagg

SEQ ID NO: 6662 - DNA, 23 bp, Homo sapiens
tccagggagtcctcattcagtgg

SEQ ID NO: 6663 - DNA, 23 bp, Homo sapiens
actcctagcacagctcagtgagg

SEQ ID NO: 6664 - DNA, 23 bp, Homo sapiens
ccagacaccgtgagtgttaaagg

SEQ ID NO: 6665 - DNA, 23 bp, Homo sapiens
tgcttctggtggatctgagctgg

SEQ ID NO: 6666 - DNA, 23 bp, Homo sapiens
cagggctgtgtgcggcttatggg

SEQ ID NO: 6667 - DNA, 23 bp, Homo sapiens
cacctatatcaatgcacacgggg

SEQ ID NO: 6668 - DNA, 23 bp, Homo sapiens
aaacatcaacatctgcttcatgg

SEQ ID NO: 6669 - DNA, 23 bp, Homo sapiens
aaatgcttctgttaggttcttgg

SEQ ID NO: 6670 - DNA, 23 bp, Homo sapiens
cttgatttctcctgggttaatgg

SEQ ID NO: 6671 - DNA, 23 bp, Homo sapiens
acacaaagtcaaaaccaccaagg

SEQ ID NO: 6672 - DNA, 23 bp, Homo sapiens
ggtcacggcctggacaagaaagg

SEQ ID NO: 6673 - DNA, 23 bp, Homo sapiens
tcaggttggtcctgtagcagtgg

SEQ ID NO: 6674 - DNA, 23 bp, Homo sapiens
cgggaggataaagaccaccacgg

SEQ ID NO: 6675 - DNA, 23 bp, Homo sapiens
ttcatgtgttcctgactggaagg

SEQ ID NO: 6676 - DNA, 23 bp, Homo sapiens
actggaatgaacttatgaacagg

SEQ ID NO: 6677 - DNA, 23 bp, Homo sapiens
tgggaaaccaaaagcaacatggg

SEQ ID NO: 6678 - DNA, 23 bp, Homo sapiens
gtgagggtcaggagctaggttgg

SEQ ID NO: 6679 - DNA, 23 bp, Homo sapiens
agagcagattatttaggcactgg

SEQ ID NO: 6680 - DNA, 23 bp, Homo sapiens
gccacaacagctacgtcatgagg

SEQ ID NO: 6681 - DNA, 23 bp, Homo sapiens
gatggcggccagctctgaccagg

SEQ ID NO: 6682 - DNA, 23 bp, Homo sapiens
cccctttggagctgggagttggg

SEQ ID NO: 6683 - DNA, 23 bp, Homo sapiens
tttctcttgtgaatatggcctgg

SEQ ID NO: 6684 - DNA, 23 bp, Homo sapiens
ctccatttaggagtagctattgg

SEQ ID NO: 6685 - DNA, 23 bp, Homo sapiens
agaagaaagctctagctgaatgg

SEQ ID NO: 6686 - DNA, 23 bp, Homo sapiens
aggctaacttgacaagctaaggg

SEQ ID NO: 6687 - DNA, 23 bp, Homo sapiens
gagaattacaagtgtgagagagg

SEQ ID NO: 6688 - DNA, 23 bp, Homo sapiens
cggcggacactacctcgccgagg

SEQ ID NO: 6689 - DNA, 23 bp, Homo sapiens
ggagcttatcacagagaaaatgg

SEQ ID NO: 6690 - DNA, 23 bp, Homo sapiens
gttcattaaggttttgcagctgg

SEQ ID NO: 6691 - DNA, 23 bp, Homo sapiens
aggctggagggcagggtcagagg

SEQ ID NO: 6692 - DNA, 23 bp, Homo sapiens
gccctggagcactcaccctcagg

SEQ ID NO: 6693 - DNA, 23 bp, Homo sapiens
gatgatcaaaccacagactttgg

SEQ ID NO: 6694 - DNA, 23 bp, Homo sapiens
agtgtgacagagaggtgtgaggg

SEQ ID NO: 6695 - DNA, 23 bp, Homo sapiens
cacacctctctgtcacactgagg

SEQ ID NO: 6696 - DNA, 23 bp, Homo sapiens
atcactccttatcaacatcttgg

SEQ ID NO: 6697 - DNA, 23 bp, Homo sapiens
agtgctggcaatcagggcaaagg

SEQ ID NO: 6698 - DNA, 23 bp, Homo sapiens
gtttgcatgaacagtttccttgg

SEQ ID NO: 6699 - DNA, 23 bp, Homo sapiens
gtaaaaggcgccaagtgctcagg

SEQ ID NO: 6700 - DNA, 23 bp, Homo sapiens
gtcgccttcccttattgctaagg

SEQ ID NO: 6701 - DNA, 23 bp, Homo sapiens
ttttttctcactcgatacagtgg

SEQ ID NO: 6702 - DNA, 23 bp, Homo sapiens
cttgaggcagcctgctctatagg

SEQ ID NO: 6703 - DNA, 23 bp, Homo sapiens
cgcctgccacattcagtagcggg

SEQ ID NO: 6704 - DNA, 23 bp, Homo sapiens
ccttggagggtaatgtctactgg

SEQ ID NO: 6705 - DNA, 23 bp, Homo sapiens
ttctgcttgtaccttaactatgg

SEQ ID NO: 6706 - DNA, 23 bp, Homo sapiens
ttctccaatagtcttcatgaagg

SEQ ID NO: 6707 - DNA, 23 bp, Homo sapiens
gatctgggccagactcacaaagg

SEQ ID NO: 6708 - DNA, 23 bp, Homo sapiens
cgcctacccgtctacagataagg

SEQ ID NO: 6709 - DNA, 23 bp, Homo sapiens
tcagcacccagggtatagatagg

SEQ ID NO: 6710 - DNA, 23 bp, Homo sapiens
ccactcacttccaagccctgagg

SEQ ID NO: 6711 - DNA, 23 bp, Homo sapiens
aacagacaactacaactttgagg

SEQ ID NO: 6712 - DNA, 23 bp, Homo sapiens
agcacctgcaaaatcagtaaagg

SEQ ID NO: 6713 - DNA, 23 bp, Homo sapiens
gctgtggcggtggctcattctgg

SEQ ID NO: 6714 - DNA, 23 bp, Homo sapiens
gcgtttggggctgctgaagctgg

SEQ ID NO: 6715 - DNA, 23 bp, Homo sapiens
agggagcaggcgcactcacgtgg

SEQ ID NO: 6716 - DNA, 23 bp, Homo sapiens
gccacctgcacaaagcagcaagg

SEQ ID NO: 6717 - DNA, 23 bp, Homo sapiens
cgggaggcacagtggcctgatgg

SEQ ID NO: 6718 - DNA, 23 bp, Homo sapiens
caggaggcacagtagcctgatgg

SEQ ID NO: 6719 - DNA, 23 bp, Homo sapiens
ggtaccagagtgaggcgtagagg

SEQ ID NO: 6720 - DNA, 23 bp, Homo sapiens
agctgcgaagatttctctctagg

SEQ ID NO: 6721 - DNA, 23 bp, Homo sapiens
aggggaggataccgggcactcgg

SEQ ID NO: 6722 - DNA, 23 bp, Homo sapiens
tgtcattggaaaagtgaacctgg

SEQ ID NO: 6723 - DNA, 23 bp, Homo sapiens
ctatacacagaggcactgtatgg

SEQ ID NO: 6724 - DNA, 23 bp, Homo sapiens
aaagaacagcaactagtccaagg

SEQ ID NO: 6725 - DNA, 23 bp, Homo sapiens
ttgtttaggacaagtggtagtgg

SEQ ID NO: 6726 - DNA, 23 bp, Homo sapiens
ataaatgagggcctctgacttgg

SEQ ID NO: 6727 - DNA, 23 bp, Homo sapiens
gcccacctttcctaactcagagg

SEQ ID NO: 6728 - DNA, 23 bp, Homo sapiens
gcagagagtctggacaaacttgg

SEQ ID NO: 6729 - DNA, 23 bp, Homo sapiens
gcagaaagtctggacaaacttgg

SEQ ID NO: 6730 - DNA, 23 bp, Homo sapiens
gcagagagtctgggcaaacttgg

SEQ ID NO: 6731 - DNA, 23 bp, Homo sapiens
acgacattcccaaagtcagctgg

SEQ ID NO: 6732 - DNA, 23 bp, Homo sapiens
ggagccaatgcccgtctctgagg

SEQ ID NO: 6733 - DNA, 23 bp, Homo sapiens
agaagcacggccagctagcacgg

SEQ ID NO: 6734 - DNA, 23 bp, Homo sapiens
gcagtgtcagcttcgttctttgg

SEQ ID NO: 6735 - DNA, 23 bp, Homo sapiens
tcccccagaagcaagactaatgg

SEQ ID NO: 6736 - DNA, 23 bp, Homo sapiens
cccccgaagccattttagggtgg

SEQ ID NO: 6737 - DNA, 23 bp, Homo sapiens
gcggaggagctcagcccgagtgg

SEQ ID NO: 6738 - DNA, 23 bp, Homo sapiens
ccttcggctctcagcgcgcctgg

SEQ ID NO: 6739 - DNA, 23 bp, Homo sapiens
cggctgctgctagatgataaagg

SEQ ID NO: 6740 - DNA, 23 bp, Homo sapiens
ttaattgcagggtagccaagtgg

SEQ ID NO: 6741 - DNA, 23 bp, Homo sapiens
cagggtctgagtcagttacaagg

SEQ ID NO: 6742 - DNA, 23 bp, Homo sapiens
caggtctcaaggttagttacagg

SEQ ID NO: 6743 - DNA, 23 bp, Homo sapiens
ctgcactttcgtggatcaaatgg

SEQ ID NO: 6744 - DNA, 23 bp, Homo sapiens
agaggcatcggaagaagattagg

SEQ ID NO: 6745 - DNA, 23 bp, Homo sapiens
acttgcactgcacgttgaatagg

SEQ ID NO: 6746 - DNA, 23 bp, Homo sapiens
tgcatcggaagaagattagatgg

SEQ ID NO: 6747 - DNA, 23 bp, Homo sapiens
tgagaatatgtatatcgggaagg

SEQ ID NO: 6748 - DNA, 23 bp, Homo sapiens
gagcatcttcaagaaagcaatgg

SEQ ID NO: 6749 - DNA, 23 bp, Homo sapiens
aagcattgctcgaatctgtttgg

SEQ ID NO: 6750 - DNA, 23 bp, Homo sapiens
ccagaattgttattgcagcatgg

SEQ ID NO: 6751 - DNA, 23 bp, Homo sapiens
gcagcctcctggatgctcagcgg

SEQ ID NO: 6752 - DNA, 23 bp, Homo sapiens
ctctggcaggcgggtgttagcgg

SEQ ID NO: 6753 - DNA, 23 bp, Homo sapiens
gagcagatcgagaacaactgagg

SEQ ID NO: 6754 - DNA, 23 bp, Homo sapiens
catcgtcatcttcgtaattgagg

SEQ ID NO: 6755 - DNA, 23 bp, Homo sapiens
cagatagagaagaactgaggggg

SEQ ID NO: 6756 - DNA, 23 bp, Homo sapiens
cctggacttgaatttgattgagg

SEQ ID NO: 6757 - DNA, 23 bp, Homo sapiens
actccccaagccaaaaaggatgg

SEQ ID NO: 6758 - DNA, 23 bp, Homo sapiens
gcctgccaggcccaggactgagg

SEQ ID NO: 6759 - DNA, 23 bp, Homo sapiens
ctcaaagactacctactgcgtgg

SEQ ID NO: 6760 - DNA, 23 bp, Homo sapiens
tttggcacaattaccggtgctgg

SEQ ID NO: 6761 - DNA, 23 bp, Homo sapiens
aacaccaagtactcttgatgggg

SEQ ID NO: 6762 - DNA, 23 bp, Homo sapiens
cacactgagggagctgcaggagg

SEQ ID NO: 6763 - DNA, 23 bp, Homo sapiens
cagctctgggtcttatttaatgg

SEQ ID NO: 6764 - DNA, 23 bp, Homo sapiens
agccctggctcctctttaaatgg

SEQ ID NO: 6765 - DNA, 23 bp, Homo sapiens
ggaagtgcagaggagcccagtgg

SEQ ID NO: 6766 - DNA, 23 bp, Homo sapiens
tctgtctgcccctttctcaaggg

SEQ ID NO: 6767 - DNA, 23 bp, Homo sapiens
ttctgctgtgcccttcacgcagg

SEQ ID NO: 6768 - DNA, 23 bp, Homo sapiens
ctccgagtggccggatgcggggg

SEQ ID NO: 6769 - DNA, 23 bp, Homo sapiens
ccacagctggccccacccatagg

SEQ ID NO: 6770 - DNA, 23 bp, Homo sapiens
tacctaggagagcacttcttggg

SEQ ID NO: 6771 - DNA, 23 bp, Homo sapiens
tgtgttaaatatctcagcagagg

SEQ ID NO: 6772 - DNA, 23 bp, Homo sapiens
cttctggatgtttcacagccagg

SEQ ID NO: 6773 - DNA, 23 bp, Homo sapiens
tctgtactctcttctatctctgg

SEQ ID NO: 6774 - DNA, 23 bp, Homo sapiens
ccttgaggtctgtcatggagagg

SEQ ID NO: 6775 - DNA, 23 bp, Homo sapiens
caggtcgcagcattatcaaaggg

SEQ ID NO: 6776 - DNA, 23 bp, Homo sapiens
cgggtggtcctggctgtcaccgg

SEQ ID NO: 6777 - DNA, 23 bp, Homo sapiens
aggccagtctgcttctacttagg

SEQ ID NO: 6778 - DNA, 23 bp, Homo sapiens
atgcctcttctcagccatctagg

SEQ ID NO: 6779 - DNA, 23 bp, Homo sapiens
gccagagacccccatgtgaaggg

SEQ ID NO: 6780 - DNA, 23 bp, Homo sapiens
gcgcaagatagtggaactccagg

SEQ ID NO: 6781 - DNA, 23 bp, Homo sapiens
aggcctcccctcacttctgaagg

SEQ ID NO: 6782 - DNA, 23 bp, Homo sapiens
cgctcggcaggcagccaccccgg

SEQ ID NO: 6783 - DNA, 23 bp, Homo sapiens
gctgggttcagaaagccatcagg

SEQ ID NO: 6784 - DNA, 23 bp, Homo sapiens
gggctcggggtggtgatcagagg

SEQ ID NO: 6785 - DNA, 23 bp, Homo sapiens
cccaatgagaacaagtttcgagg

SEQ ID NO: 6786 - DNA, 23 bp, Homo sapiens
cctttggctaggactcaaagcgg

SEQ ID NO: 6787 - DNA, 23 bp, Homo sapiens
aacacggagcagttactgatagg

SEQ ID NO: 6788 - DNA, 23 bp, Homo sapiens
cttggggggcaaccctgaacagg

SEQ ID NO: 6789 - DNA, 23 bp, Homo sapiens
caggaaatcacacagttgctagg

SEQ ID NO: 6790 - DNA, 23 bp, Homo sapiens
aggctgggacatgctgctagggg

SEQ ID NO: 6791 - DNA, 23 bp, Homo sapiens
tcttgcttttgaacgtgcccagg

SEQ ID NO: 6792 - DNA, 23 bp, Homo sapiens
cgccgacctcgtggacgacaagg

SEQ ID NO: 6793 - DNA, 23 bp, Homo sapiens
agaggcagtggcacactgatggg

SEQ ID NO: 6794 - DNA, 23 bp, Homo sapiens
tgtgtgagtcctacagtgtgagg

SEQ ID NO: 6795 - DNA, 23 bp, Homo sapiens
ctacagagagcacttggagatgg

SEQ ID NO: 6796 - DNA, 23 bp, Homo sapiens
gattctggagtccatctagaggg

SEQ ID NO: 6797 - DNA, 23 bp, Homo sapiens
tcctggccgtgggtggttattgg

SEQ ID NO: 6798 - DNA, 23 bp, Homo sapiens
cattgtagcaggaaccattgtgg

SEQ ID NO: 6799 - DNA, 23 bp, Homo sapiens
tcaggttccctcctcctcagagg

SEQ ID NO: 6800 - DNA, 23 bp, Homo sapiens
agctcagtacaagtaccatttgg

SEQ ID NO: 6801 - DNA, 23 bp, Homo sapiens
ttagcaataagaagtgaggaagg

SEQ ID NO: 6802 - DNA, 23 bp, Homo sapiens
tcaacaagcagaagatgatgagg

SEQ ID NO: 6803 - DNA, 23 bp, Homo sapiens
cgtcgttagagagaatgtcctgg

SEQ ID NO: 6804 - DNA, 23 bp, Homo sapiens
aacagtacctcattgctctttgg

SEQ ID NO: 6805 - DNA, 23 bp, Homo sapiens
tcttaaaacagctatcagtcagg

SEQ ID NO: 6806 - DNA, 23 bp, Homo sapiens
tcaaaggccaggctcaggagcgg

SEQ ID NO: 6807 - DNA, 23 bp, Homo sapiens
ggaagacattacactagttgagg

SEQ ID NO: 6808 - DNA, 23 bp, Homo sapiens
ggaggaggtggtggtggtggtgg

SEQ ID NO: 6809 - DNA, 23 bp, Homo sapiens
gatggaggcccccagtgttgggg

SEQ ID NO: 6810 - DNA, 23 bp, Homo sapiens
atcaagttcactttcttcactgg

SEQ ID NO: 6811 - DNA, 23 bp, Homo sapiens
atcaagttcactgtcttcatcgg

SEQ ID NO: 6812 - DNA, 23 bp, Homo sapiens
aggtggcaacaagatgggaaagg

SEQ ID NO: 6813 - DNA, 23 bp, Homo sapiens
aaaatcactgcaccaattccagg

SEQ ID NO: 6814 - DNA, 23 bp, Homo sapiens
gtctgccatgtggttgcagttgg

SEQ ID NO: 6815 - DNA, 23 bp, Homo sapiens
ggagcctcatctcttctgacggg

SEQ ID NO: 6816 - DNA, 23 bp, Homo sapiens
gaaaaagagcttctcacacgtgg

SEQ ID NO: 6817 - DNA, 23 bp, Homo sapiens
cctccactcacaagatcgtgagg

SEQ ID NO: 6818 - DNA, 23 bp, Homo sapiens
caaacgaacctaaaagtgagtgg

SEQ ID NO: 6819 - DNA, 23 bp, Homo sapiens
gctgcgaactcaagtctagaagg

SEQ ID NO: 6820 - DNA, 23 bp, Homo sapiens
taacagatcaaatgaccttgggg

SEQ ID NO: 6821 - DNA, 23 bp, Homo sapiens
aagcacagaagctgttatggagg

SEQ ID NO: 6822 - DNA, 23 bp, Homo sapiens
cgaagtaagtgctggagaaaagg

SEQ ID NO: 6823 - DNA, 23 bp, Homo sapiens
cttgcagcactccaagtaaaggg

SEQ ID NO: 6824 - DNA, 23 bp, Homo sapiens
gtcccttggtggatggtcagggg

SEQ ID NO: 6825 - DNA, 23 bp, Homo sapiens
cgcaggcctcagttctgtatagg

SEQ ID NO: 6826 - DNA, 23 bp, Homo sapiens
cttcaaaacgtggcagctacagg

SEQ ID NO: 6827 - DNA, 23 bp, Homo sapiens
aagaaccagccaagaagaaaagg

SEQ ID NO: 6828 - DNA, 23 bp, Homo sapiens
gtgtgtgataattctcagtgtgg

SEQ ID NO: 6829 - DNA, 23 bp, Homo sapiens
agtaactcatcagaaggctgagg

SEQ ID NO: 6830 - DNA, 23 bp, Homo sapiens
tctatcttttcctatagggatgg

SEQ ID NO: 6831 - DNA, 23 bp, Homo sapiens
cagcagacacaagacttctttgg

SEQ ID NO: 6832 - DNA, 23 bp, Homo sapiens
acaaagagaaacactgctttagg

SEQ ID NO: 6833 - DNA, 23 bp, Homo sapiens
tcttcagtatctcatagtgctgg

SEQ ID NO: 6834 - DNA, 23 bp, Homo sapiens
ctcttaaactttgagcgtgctgg

SEQ ID NO: 6835 - DNA, 23 bp, Homo sapiens
aagagtctcttgtgtattgatgg

SEQ ID NO: 6836 - DNA, 23 bp, Homo sapiens
ggctggaagtagaagcttagcgg

SEQ ID NO: 6837 - DNA, 23 bp, Homo sapiens
ccacaccttgggcggtcacgtgg

SEQ ID NO: 6838 - DNA, 23 bp, Homo sapiens
ggggatggtcagggggaaggagg

SEQ ID NO: 6839 - DNA, 23 bp, Homo sapiens
tgtagcaggggtcacaaaaatgg

SEQ ID NO: 6840 - DNA, 23 bp, Homo sapiens
agctgttgggtgtggagggcagg

SEQ ID NO: 6841 - DNA, 23 bp, Homo sapiens
acacaggaggctgcgtgacatgg

SEQ ID NO: 6842 - DNA, 23 bp, Homo sapiens
agagaccaatcttcacaaaaagg

SEQ ID NO: 6843 - DNA, 23 bp, Homo sapiens
tgccaattccactaattgtttgg

SEQ ID NO: 6844 - DNA, 23 bp, Homo sapiens
ttggagattcatgagaaccttgg

SEQ ID NO: 6845 - DNA, 23 bp, Homo sapiens
tttcactctagaccaagctttgg

SEQ ID NO: 6846 - DNA, 23 bp, Homo sapiens
cccctgaaaaaaaggagctgagg

SEQ ID NO: 6847 - DNA, 23 bp, Homo sapiens
gaggaatctcagacgtttttcgg

SEQ ID NO: 6848 - DNA, 23 bp, Homo sapiens
cgtgagcgtgcgggagggctagg

SEQ ID NO: 6849 - DNA, 23 bp, Homo sapiens
ggggcctgaagggggctgagggg

SEQ ID NO: 6850 - DNA, 23 bp, Homo sapiens
gtcaacaaaggatgctcggatgg

SEQ ID NO: 6851 - DNA, 23 bp, Homo sapiens
tgcacatttacagcagcaacagg

SEQ ID NO: 6852 - DNA, 23 bp, Homo sapiens
aaaatcaagacgtgaattggtgg

SEQ ID NO: 6853 - DNA, 23 bp, Homo sapiens
attcacctctgctctctgaaggg

SEQ ID NO: 6854 - DNA, 23 bp, Homo sapiens
cctggattcccagcagcacacgg

SEQ ID NO: 6855 - DNA, 23 bp, Homo sapiens
tgattatggcagctgtgaggagg

SEQ ID NO: 6856 - DNA, 23 bp, Homo sapiens
ctgatgctgagtctccacaaagg

SEQ ID NO: 6857 - DNA, 23 bp, Homo sapiens
taaaccagtccccaaagatgggg

SEQ ID NO: 6858 - DNA, 23 bp, Homo sapiens
ggccgcgctggggcgatcactgg

SEQ ID NO: 6859 - DNA, 23 bp, Homo sapiens
aaagacttaagagttggcattgg

SEQ ID NO: 6860 - DNA, 23 bp, Homo sapiens
gacgtcacttgcactgttcgtgg

SEQ ID NO: 6861 - DNA, 23 bp, Homo sapiens
cccagactccccaaagaggatgg

SEQ ID NO: 6862 - DNA, 23 bp, Homo sapiens
acatctcattcagcctgagtggg

SEQ ID NO: 6863 - DNA, 23 bp, Homo sapiens
tgaacttcagttcttcaccttgg

SEQ ID NO: 6864 - DNA, 23 bp, Homo sapiens
atgtgaagcggagtgctgcgggg

SEQ ID NO: 6865 - DNA, 23 bp, Homo sapiens
gaatattacagggctgggctggg

SEQ ID NO: 6866 - DNA, 23 bp, Homo sapiens
acccaccttgatgcctagtgagg

SEQ ID NO: 6867 - DNA, 23 bp, Homo sapiens
agacacaaagatgaaaagcttgg

SEQ ID NO: 6868 - DNA, 23 bp, Homo sapiens
gcggagcggcggtagttctcagg

SEQ ID NO: 6869 - DNA, 23 bp, Homo sapiens
tctctgagtactggttctgaggg

SEQ ID NO: 6870 - DNA, 23 bp, Homo sapiens
ggcccgtgctggcacctcacagg

SEQ ID NO: 6871 - DNA, 23 bp, Homo sapiens
ctccagcccgaggctcagaatgg

SEQ ID NO: 6872 - DNA, 23 bp, Homo sapiens
tatccccctatgacttctgaggg

SEQ ID NO: 6873 - DNA, 23 bp, Homo sapiens
gactacctcagtggtgaactggg

SEQ ID NO: 6874 - DNA, 23 bp, Homo sapiens
ttggggaggctctcagaatgagg

SEQ ID NO: 6875 - DNA, 23 bp, Homo sapiens
cagctgcagttgctttagttggg

SEQ ID NO: 6876 - DNA, 23 bp, Homo sapiens
caggcagggcaggtgctcactgg

SEQ ID NO: 6877 - DNA, 23 bp, Homo sapiens
tgtgtgcagaaaaatcaggcagg

SEQ ID NO: 6878 - DNA, 23 bp, Homo sapiens
agctcgggctgacaggtgagggg

SEQ ID NO: 6879 - DNA, 23 bp, Homo sapiens
atcccccggaggtggaggcgcgg

SEQ ID NO: 6880 - DNA, 23 bp, Homo sapiens
ccaaagagtctatggactggtgg

SEQ ID NO: 6881 - DNA, 23 bp, Homo sapiens
aggctgaaggtcacgctgcttgg

SEQ ID NO: 6882 - DNA, 23 bp, Homo sapiens
ggggaagctccagaaggtgaggg

SEQ ID NO: 6883 - DNA, 23 bp, Homo sapiens
ggcaggcgggtcagacctgcagg

SEQ ID NO: 6884 - DNA, 23 bp, Homo sapiens
cctcgcgctactcaatgacgagg

SEQ ID NO: 6885 - DNA, 23 bp, Homo sapiens
ggcgaggcaggagcgctaggagg

SEQ ID NO: 6886 - DNA, 23 bp, Homo sapiens
caagtgtgcaccactatacctgg

SEQ ID NO: 6887 - DNA, 23 bp, Homo sapiens
gccgaacctgtggtggtgagagg

SEQ ID NO: 6888 - DNA, 23 bp, Homo sapiens
cttctcaaggacagctagttggg

SEQ ID NO: 6889 - DNA, 23 bp, Homo sapiens
gaagtggacagcgactgtgcagg

SEQ ID NO: 6890 - DNA, 23 bp, Homo sapiens
ttgaccacctccattgtcatagg

SEQ ID NO: 6891 - DNA, 23 bp, Homo sapiens
tgtgatgcctctctggtaatggg

SEQ ID NO: 6892 - DNA, 23 bp, Homo sapiens
aatcgcgagtgcggtcactgcgg

SEQ ID NO: 6893 - DNA, 23 bp, Homo sapiens
atcatgcagtttttaccaagtgg

SEQ ID NO: 6894 - DNA, 23 bp, Homo sapiens
gttatcaatctgcgaacagaagg

SEQ ID NO: 6895 - DNA, 23 bp, Homo sapiens
tcaagggtcattcgccagagcgg

SEQ ID NO: 6896 - DNA, 23 bp, Homo sapiens
caggtctgtggctgcctagctgg

SEQ ID NO: 6897 - DNA, 23 bp, Homo sapiens
caacccggctttcttctgaaggg

SEQ ID NO: 6898 - DNA, 23 bp, Homo sapiens
cctacgctcgtggcgtgattggg

SEQ ID NO: 6899 - DNA, 23 bp, Homo sapiens
aagcaggtctgtgtcctcacagg

SEQ ID NO: 6900 - DNA, 23 bp, Homo sapiens
agtgtatctgtatcatgtgtagg

SEQ ID NO: 6901 - DNA, 23 bp, Homo sapiens
aatattcagtcccaaaccaatgg

SEQ ID NO: 6902 - DNA, 23 bp, Homo sapiens
ataaattgcaggacagaactagg

SEQ ID NO: 6903 - DNA, 23 bp, Homo sapiens
agtccagtcgctaggacagacgg

SEQ ID NO: 6904 - DNA, 23 bp, Homo sapiens
ctgctcttcctcgtcttctgagg

SEQ ID NO: 6905 - DNA, 23 bp, Homo sapiens
ggtgaccaacagcagcgtgtggg

SEQ ID NO: 6906 - DNA, 23 bp, Homo sapiens
tctggagtttgtctatgaaacgg

SEQ ID NO: 6907 - DNA, 23 bp, Homo sapiens
taatggcactcatacatctgggg

SEQ ID NO: 6908 - DNA, 23 bp, Homo sapiens
tgatttcgtctgtgaatgaaggg

SEQ ID NO: 6909 - DNA, 23 bp, Homo sapiens
catgagggggattaggtctcagg

SEQ ID NO: 6910 - DNA, 23 bp, Homo sapiens
tcgacctcttcaagttttaaggg

SEQ ID NO: 6911 - DNA, 23 bp, Homo sapiens
tagtgctggactaggacagacgg

SEQ ID NO: 6912 - DNA, 23 bp, Homo sapiens
attgttgttagggctgcagacgg

SEQ ID NO: 6913 - DNA, 23 bp, Homo sapiens
cggaagccatagactctcttagg

SEQ ID NO: 6914 - DNA, 23 bp, Homo sapiens
agcagaaggcttgctaaaaaagg

SEQ ID NO: 6915 - DNA, 23 bp, Homo sapiens
cagggtgtctatagcccgattgg

SEQ ID NO: 6916 - DNA, 23 bp, Homo sapiens
acacgagaactcactaaagaagg

SEQ ID NO: 6917 - DNA, 23 bp, Homo sapiens
tcagtccctcacctcctgaccgg

SEQ ID NO: 6918 - DNA, 23 bp, Homo sapiens
tgaacaagttgataaagtcctgg

SEQ ID NO: 6919 - DNA, 23 bp, Homo sapiens
tcaaccttggcatgcagtcatgg

SEQ ID NO: 6920 - DNA, 23 bp, Homo sapiens
aaaagggactgaagctgaagagg

SEQ ID NO: 6921 - DNA, 23 bp, Homo sapiens
cctgagagaaaagcaaccttagg

SEQ ID NO: 6922 - DNA, 23 bp, Homo sapiens
atccactattgtgatgtcaatgg

SEQ ID NO: 6923 - DNA, 23 bp, Homo sapiens
agaccctgcaggaaatttacagg

SEQ ID NO: 6924 - DNA, 23 bp, Homo sapiens
aagtgtgtgaagttgtagatggg

SEQ ID NO: 6925 - DNA, 23 bp, Homo sapiens
gagtttcagcctctgtatcctgg

SEQ ID NO: 6926 - DNA, 23 bp, Homo sapiens
tgagtggattcttgaagaagtgg

SEQ ID NO: 6927 - DNA, 23 bp, Homo sapiens
taggagacgtatcttcctcgtgg

SEQ ID NO: 6928 - DNA, 23 bp, Homo sapiens
gtggaaggcggctgctaacccgg

SEQ ID NO: 6929 - DNA, 23 bp, Homo sapiens
ctttgctcgtacaaagtacaagg

SEQ ID NO: 6930 - DNA, 23 bp, Homo sapiens
caggaagtgcccagagtaagcgg

SEQ ID NO: 6931 - DNA, 23 bp, Homo sapiens
cccatctgctgaaccctgactgg

SEQ ID NO: 6932 - DNA, 23 bp, Homo sapiens
ctcagggggtgtcagggcagcgg

SEQ ID NO: 6933 - DNA, 23 bp, Homo sapiens
agccactgtcatccgtccaaagg

SEQ ID NO: 6934 - DNA, 23 bp, Homo sapiens
gggccggccgggaggaggggagg

SEQ ID NO: 6935 - DNA, 23 bp, Homo sapiens
ctgaggatttaggtagacagagg

SEQ ID NO: 6936 - DNA, 23 bp, Homo sapiens
agcagaactggaaagataagggg

SEQ ID NO: 6937 - DNA, 23 bp, Homo sapiens
tgcttttctttgtaccaggcagg

SEQ ID NO: 6938 - DNA, 23 bp, Homo sapiens
tggacagctgtcagaaaatctgg

SEQ ID NO: 6939 - DNA, 23 bp, Homo sapiens
tcaatcacatgaatgacagccgg

SEQ ID NO: 6940 - DNA, 23 bp, Homo sapiens
gtgctttttatgcagccacatgg

SEQ ID NO: 6941 - DNA, 23 bp, Homo sapiens
ctggacttgaggctctacagagg

SEQ ID NO: 6942 - DNA, 23 bp, Homo sapiens
aaaacagcggcccctgaacttgg

SEQ ID NO: 6943 - DNA, 23 bp, Homo sapiens
agagatgtaagtgtatgttctgg

SEQ ID NO: 6944 - DNA, 23 bp, Homo sapiens
agtaagtgactccagcattctgg

SEQ ID NO: 6945 - DNA, 23 bp, Homo sapiens
ctggtgttgtggaaggagcacgg

SEQ ID NO: 6946 - DNA, 23 bp, Homo sapiens
ggggtggccctgacggtcatggg

SEQ ID NO: 6947 - DNA, 23 bp, Homo sapiens
cttgccagccagaggcgctgagg

SEQ ID NO: 6948 - DNA, 23 bp, Homo sapiens
gctggtgctggactttgatgtgg

SEQ ID NO: 6949 - DNA, 23 bp, Homo sapiens
tgtttttgtatagaatggggagg

SEQ ID NO: 6950 - DNA, 23 bp, Homo sapiens
ctgaggcacatccctaaacatgg

SEQ ID NO: 6951 - DNA, 23 bp, Homo sapiens
tggaggctgcaggcctgagcagg

SEQ ID NO: 6952 - DNA, 23 bp, Homo sapiens
agagaaatccaggaccctgaggg

SEQ ID NO: 6953 - DNA, 23 bp, Homo sapiens
aaaggaagctctggagaaggagg

SEQ ID NO: 6954 - DNA, 23 bp, Homo sapiens
ggtgtttacttgcagacacttgg

SEQ ID NO: 6955 - DNA, 23 bp, Homo sapiens
gtgccaattttcaaccagtatgg

SEQ ID NO: 6956 - DNA, 23 bp, Homo sapiens
tatcagttgtttttggggtttgg

SEQ ID NO: 6957 - DNA, 23 bp, Homo sapiens
ctattctaaagctactgtggtgg

SEQ ID NO: 6958 - DNA, 23 bp, Homo sapiens
gctgtatccatgctcaagagtgg

SEQ ID NO: 6959 - DNA, 23 bp, Homo sapiens
gaacggatgccagatgattatgg

SEQ ID NO: 6960 - DNA, 23 bp, Homo sapiens
gatggagaaatggagagcgcagg

SEQ ID NO: 6961 - DNA, 23 bp, Homo sapiens
cccactgagccgctgctacgtgg

SEQ ID NO: 6962 - DNA, 23 bp, Homo sapiens
ccaactgagccgctgctacgtgg

SEQ ID NO: 6963 - DNA, 23 bp, Homo sapiens
gagaagtaaagctacaaaccagg

SEQ ID NO: 6964 - DNA, 23 bp, Homo sapiens
attactgttgacatggtcgttgg

SEQ ID NO: 6965 - DNA, 23 bp, Homo sapiens
atggagactaaatacggttctgg

SEQ ID NO: 6966 - DNA, 23 bp, Homo sapiens
gatgggggtcatttgtcttgagg

SEQ ID NO: 6967 - DNA, 23 bp, Homo sapiens
ctcctttttgcagtggacacagg

SEQ ID NO: 6968 - DNA, 23 bp, Homo sapiens
cggaatggcggatggtcaggcgg

SEQ ID NO: 6969 - DNA, 23 bp, Homo sapiens
tgcgggttcagcagctcaccagg

SEQ ID NO: 6970 - DNA, 23 bp, Homo sapiens
gatacctggcggattgttgatgg

SEQ ID NO: 6971 - DNA, 23 bp, Homo sapiens
acccagatcccctcacctgaagg

SEQ ID NO: 6972 - DNA, 23 bp, Homo sapiens
tgaagatgtggaaatcacactgg

SEQ ID NO: 6973 - DNA, 23 bp, Homo sapiens
gttgccccccgccccgctgcagg

SEQ ID NO: 6974 - DNA, 23 bp, Homo sapiens
tagctggggagttgtcaggcagg

SEQ ID NO: 6975 - DNA, 23 bp, Homo sapiens
aaggtgcggcccgcctagacggg

SEQ ID NO: 6976 - DNA, 23 bp, Homo sapiens
gaggccggcctgggctaggcagg

SEQ ID NO: 6977 - DNA, 23 bp, Homo sapiens
gttcggatgatgcttcgataggg

SEQ ID NO: 6978 - DNA, 23 bp, Homo sapiens
aatgtttgctttcctcagcctgg

SEQ ID NO: 6979 - DNA, 23 bp, Homo sapiens
ggggacacatatggaggacaagg

SEQ ID NO: 6980 - DNA, 23 bp, Homo sapiens
tcacagaagagtagatgacttgg

SEQ ID NO: 6981 - DNA, 23 bp, Homo sapiens
cactctgggtaaggggctagtgg

SEQ ID NO: 6982 - DNA, 23 bp, Homo sapiens
ggctaagtgttacaaagacatgg

SEQ ID NO: 6983 - DNA, 23 bp, Homo sapiens
agctggaaagatcagctctaagg

SEQ ID NO: 6984 - DNA, 23 bp, Homo sapiens
gacgtgtggactcatctgtgagg

SEQ ID NO: 6985 - DNA, 23 bp, Homo sapiens
ggggagaagcagcattgaagtgg

SEQ ID NO: 6986 - DNA, 23 bp, Homo sapiens
accccttagcgactgtgaggagg

SEQ ID NO: 6987 - DNA, 23 bp, Homo sapiens
ctccgtggatgaaacctcactgg

SEQ ID NO: 6988 - DNA, 23 bp, Homo sapiens
ctattcagcagtagcctttgtgg

SEQ ID NO: 6989 - DNA, 23 bp, Homo sapiens
acgcccttggaacaatcggctgg

SEQ ID NO: 6990 - DNA, 23 bp, Homo sapiens
actcctgtggagagctgaggggg

SEQ ID NO: 6991 - DNA, 23 bp, Homo sapiens
cagccttggctcctggtaatagg

SEQ ID NO: 6992 - DNA, 23 bp, Homo sapiens
ttgtttacttttcgctaggaagg

SEQ ID NO: 6993 - DNA, 23 bp, Homo sapiens
acagaagactatgttcagactgg

SEQ ID NO: 6994 - DNA, 23 bp, Homo sapiens
ttgcgcgcaaaatctacaagcgg

SEQ ID NO: 6995 - DNA, 23 bp, Homo sapiens
cctatttgttctagttcaggagg

SEQ ID NO: 6996 - DNA, 23 bp, Homo sapiens
ggtccaggtgttcatgtcagtgg

SEQ ID NO: 6997 - DNA, 23 bp, Homo sapiens
tatgttatacctcggtagtttgg

SEQ ID NO: 6998 - DNA, 23 bp, Homo sapiens
ggggctggggctgggctcagtgg

SEQ ID NO: 6999 - DNA, 23 bp, Homo sapiens
ccggcgggggtcacagctgctgg

SEQ ID NO: 7000 - DNA, 23 bp, Homo sapiens
cttcatcccggaagatctggagg

SEQ ID NO: 7001 - DNA, 23 bp, Homo sapiens
agaactcttgaagagtttgttgg

SEQ ID NO: 7002 - DNA, 23 bp, Homo sapiens
acaaaagtctctagcttttctgg

SEQ ID NO: 7003 - DNA, 23 bp, Homo sapiens
gcagcagggaagtttaaaagggg

SEQ ID NO: 7004 - DNA, 23 bp, Homo sapiens
gatagaggcagagatgatcaagg

SEQ ID NO: 7005 - DNA, 23 bp, Homo sapiens
ttctgaagttcactgaacttagg

SEQ ID NO: 7006 - DNA, 23 bp, Homo sapiens
gcatggactaattagtctcctgg

SEQ ID NO: 7007 - DNA, 23 bp, Homo sapiens
ggatcgttgtgggctcatagagg

SEQ ID NO: 7008 - DNA, 23 bp, Homo sapiens
agctgtgagaagaaggaaagcgg

SEQ ID NO: 7009 - DNA, 23 bp, Homo sapiens
ccacaaattgaccggcggtcagg

SEQ ID NO: 7010 - DNA, 23 bp, Homo sapiens
accagtggttgggtgtgaatagg

SEQ ID NO: 7011 - DNA, 23 bp, Homo sapiens
tgtcaactgggaaatcaaaatgg

SEQ ID NO: 7012 - DNA, 23 bp, Homo sapiens
gcaatcagacagccctcagaagg

SEQ ID NO: 7013 - DNA, 23 bp, Homo sapiens
atccgaaagcggcatcggtgagg

SEQ ID NO: 7014 - DNA, 23 bp, Homo sapiens
actctgtgtgattctcatggcgg

SEQ ID NO: 7015 - DNA, 23 bp, Homo sapiens
tgatattgaatggggcttctagg

SEQ ID NO: 7016 - DNA, 23 bp, Homo sapiens
ggaggagacccttcaggacgagg

SEQ ID NO: 7017 - DNA, 23 bp, Homo sapiens
tccaaagggcaaggttaggtagg

SEQ ID NO: 7018 - DNA, 23 bp, Homo sapiens
ataaagttgctgctctatgtagg

SEQ ID NO: 7019 - DNA, 23 bp, Homo sapiens
ggacccttagcctcgatcactgg

SEQ ID NO: 7020 - DNA, 23 bp, Homo sapiens
agctctgcactgtcctagtcagg

SEQ ID NO: 7021 - DNA, 23 bp, Homo sapiens
tgtgcggcaagaacgcaaggggg

SEQ ID NO: 7022 - DNA, 23 bp, Homo sapiens
tctgtagtgaagtccgaacttgg

SEQ ID NO: 7023 - DNA, 23 bp, Homo sapiens
ggtggcctgtgctgaaagctagg

SEQ ID NO: 7024 - DNA, 23 bp, Homo sapiens
gttaaaatggctcccttttctgg

SEQ ID NO: 7025 - DNA, 23 bp, Homo sapiens
ttaacttagtctagggggacagg

SEQ ID NO: 7026 - DNA, 23 bp, Homo sapiens
ttcccacttcttcagcctattgg

SEQ ID NO: 7027 - DNA, 23 bp, Homo sapiens
cgtattggggactattgctgtgg

SEQ ID NO: 7028 - DNA, 23 bp, Homo sapiens
gacccgagacaagacctagaggg

SEQ ID NO: 7029 - DNA, 23 bp, Homo sapiens
gcggctggcagtggctcagtcgg

SEQ ID NO: 7030 - DNA, 23 bp, Homo sapiens
cacggagcagctgcgcccatagg

SEQ ID NO: 7031 - DNA, 23 bp, Homo sapiens
aatctgtagaacaagagttcagg

SEQ ID NO: 7032 - DNA, 23 bp, Homo sapiens
aggttcaggatgatcatccaagg

SEQ ID NO: 7033 - DNA, 23 bp, Homo sapiens
taacacactcgcatcttccatgg

SEQ ID NO: 7034 - DNA, 23 bp, Homo sapiens
tggatagaagcatttcaggaagg

SEQ ID NO: 7035 - DNA, 23 bp, Homo sapiens
tctctttaatcagaagagactgg

SEQ ID NO: 7036 - DNA, 23 bp, Homo sapiens
tgctcactttcttccaatggtgg

SEQ ID NO: 7037 - DNA, 23 bp, Homo sapiens
gtccagggactacatttcagggg

SEQ ID NO: 7038 - DNA, 23 bp, Homo sapiens
ggaacaccaaccatgaatggagg

SEQ ID NO: 7039 - DNA, 23 bp, Homo sapiens
ctggctacgttgattcattgtgg

SEQ ID NO: 7040 - DNA, 23 bp, Homo sapiens
gttgtcttactcttgttgactgg

SEQ ID NO: 7041 - DNA, 23 bp, Homo sapiens
tatatagccatgaatggagaagg

SEQ ID NO: 7042 - DNA, 23 bp, Homo sapiens
ccagagacctctttcactatagg

SEQ ID NO: 7043 - DNA, 23 bp, Homo sapiens
ccccagcccctcacgtagtctgg

SEQ ID NO: 7044 - DNA, 23 bp, Homo sapiens
cgcggcggggtggcctaggcagg

SEQ ID NO: 7045 - DNA, 23 bp, Homo sapiens
ttggcactgctcagggagaccgg

SEQ ID NO: 7046 - DNA, 23 bp, Homo sapiens
aatcagctcttagcagacattgg

SEQ ID NO: 7047 - DNA, 23 bp, Homo sapiens
cacttcaagtgtacatcagtagg

SEQ ID NO: 7048 - DNA, 23 bp, Homo sapiens
ctggcttcaggaagcgtagctgg

SEQ ID NO: 7049 - DNA, 23 bp, Homo sapiens
cgcccacttcctgcccgtcctgg

SEQ ID NO: 7050 - DNA, 23 bp, Homo sapiens
tggtctcctgaggccctgagagg

SEQ ID NO: 7051 - DNA, 23 bp, Homo sapiens
cccttcgccaagttcatctaggg

SEQ ID NO: 7052 - DNA, 23 bp, Homo sapiens
gaggccagtgcgcactagctggg

SEQ ID NO: 7053 - DNA, 23 bp, Homo sapiens
tcctctggagggtcacagcctgg

SEQ ID NO: 7054 - DNA, 23 bp, Homo sapiens
cttgcagtcatctgtgaacttgg

SEQ ID NO: 7055 - DNA, 23 bp, Homo sapiens
tacagactcaagtttcgctttgg

SEQ ID NO: 7056 - DNA, 23 bp, Homo sapiens
catttccttcccaggatctaagg

SEQ ID NO: 7057 - DNA, 23 bp, Homo sapiens
aacagcccactttcttcctatgg

SEQ ID NO: 7058 - DNA, 23 bp, Homo sapiens
gagggccaggcagcacctatcgg

SEQ ID NO: 7059 - DNA, 23 bp, Homo sapiens
atacagttcaggtactttgtcgg

SEQ ID NO: 7060 - DNA, 23 bp, Homo sapiens
caggacacgtcatgctaatgagg

SEQ ID NO: 7061 - DNA, 23 bp, Homo sapiens
cagcttcttccgagggtgacagg

SEQ ID NO: 7062 - DNA, 23 bp, Homo sapiens
aattgacaaagaagttgcagagg

SEQ ID NO: 7063 - DNA, 23 bp, Homo sapiens
ccccgtggctattcctaggtagg

SEQ ID NO: 7064 - DNA, 23 bp, Homo sapiens
ggcgtgtgggtggcagtcagcgg

SEQ ID NO: 7065 - DNA, 23 bp, Homo sapiens
cagtgatgttgcggattatctgg

SEQ ID NO: 7066 - DNA, 23 bp, Homo sapiens
tgcagtgtttttgaaatgcaagg

SEQ ID NO: 7067 - DNA, 23 bp, Homo sapiens
ccaacagtgatttgagtctgagg

SEQ ID NO: 7068 - DNA, 23 bp, Homo sapiens
tggactggagagaaggcacttgg

SEQ ID NO: 7069 - DNA, 23 bp, Homo sapiens
cctcagtatccacacataaacgg

SEQ ID NO: 7070 - DNA, 23 bp, Homo sapiens
acgtccaccttgagtcctactgg

SEQ ID NO: 7071 - DNA, 23 bp, Homo sapiens
caagcagttggtagaagacttgg

SEQ ID NO: 7072 - DNA, 23 bp, Homo sapiens
tgggggctcgcggacgtgaaggg

SEQ ID NO: 7073 - DNA, 23 bp, Homo sapiens
ctccttccccttcgggtctgggg

SEQ ID NO: 7074 - DNA, 23 bp, Homo sapiens
catccactatcagtgctagacgg

SEQ ID NO: 7075 - DNA, 23 bp, Homo sapiens
ccacctggggggagccaaacagg

SEQ ID NO: 7076 - DNA, 23 bp, Homo sapiens
atatgactcactttaccctgagg

SEQ ID NO: 7077 - DNA, 23 bp, Homo sapiens
agttgtgttcccgagactacagg

SEQ ID NO: 7078 - DNA, 23 bp, Homo sapiens
atcatgaatgatgactgaacagg

SEQ ID NO: 7079 - DNA, 23 bp, Homo sapiens
gtggtattctctgaaatctgtgg

SEQ ID NO: 7080 - DNA, 23 bp, Homo sapiens
ctacaagtcctccttcaaagagg

SEQ ID NO: 7081 - DNA, 23 bp, Homo sapiens
gacaggctatgtctgatccccgg

SEQ ID NO: 7082 - DNA, 23 bp, Homo sapiens
gtaaaacctaaggacatgctggg

SEQ ID NO: 7083 - DNA, 23 bp, Homo sapiens
gtttctctagtactttccactgg

SEQ ID NO: 7084 - DNA, 23 bp, Homo sapiens
caatcccttacggaagtgatggg

SEQ ID NO: 7085 - DNA, 23 bp, Homo sapiens
gctgggaatacagtactcaaggg

SEQ ID NO: 7086 - DNA, 23 bp, Homo sapiens
agcagaagccgcagctctgcggg

SEQ ID NO: 7087 - DNA, 23 bp, Homo sapiens
cctgtcagtttacagctttttgg

SEQ ID NO: 7088 - DNA, 23 bp, Homo sapiens
tcacggagcattttttgcagtgg

SEQ ID NO: 7089 - DNA, 23 bp, Homo sapiens
tcagatgtctttcccacagtcgg

SEQ ID NO: 7090 - DNA, 23 bp, Homo sapiens
acagaagcagttcaggcagtagg

SEQ ID NO: 7091 - DNA, 23 bp, Homo sapiens
ccctggcttagggccctgcctgg

SEQ ID NO: 7092 - DNA, 23 bp, Homo sapiens
cggaatggacactgacatctagg

SEQ ID NO: 7093 - DNA, 23 bp, Homo sapiens
gtcctggcctggaggtgtgaagg

SEQ ID NO: 7094 - DNA, 23 bp, Homo sapiens
gtgtcacagctgcaactccgagg

SEQ ID NO: 7095 - DNA, 23 bp, Homo sapiens
gtccgggaggaccgctagactgg

SEQ ID NO: 7096 - DNA, 23 bp, Homo sapiens
gccatgggacccgactaggtcgg

SEQ ID NO: 7097 - DNA, 23 bp, Homo sapiens
ctgcgcctgtatcatgactgagg

SEQ ID NO: 7098 - DNA, 23 bp, Homo sapiens
ttctagggttagggcttcacagg

SEQ ID NO: 7099 - DNA, 23 bp, Homo sapiens
tggacctgcgctcttttcacagg

SEQ ID NO: 7100 - DNA, 23 bp, Homo sapiens
tgactcagcagttctacttctgg

SEQ ID NO: 7101 - DNA, 23 bp, Homo sapiens
tcagcctagcatatctcaaaagg

SEQ ID NO: 7102 - DNA, 23 bp, Homo sapiens
tttggttgtggaaagtaagtggg

SEQ ID NO: 7103 - DNA, 23 bp, Homo sapiens
tgtacggctccggacactgacgg

SEQ ID NO: 7104 - DNA, 23 bp, Homo sapiens
cgaatgaactccagatgaaatgg

SEQ ID NO: 7105 - DNA, 23 bp, Homo sapiens
tcggaggggggaagggctgaggg

SEQ ID NO: 7106 - DNA, 23 bp, Homo sapiens
gaaggatgttgagttcaatgagg

SEQ ID NO: 7107 - DNA, 23 bp, Homo sapiens
actgtaatttgtgattgtcgagg

SEQ ID NO: 7108 - DNA, 23 bp, Homo sapiens
cgaagctacacctgcagaatagg

SEQ ID NO: 7109 - DNA, 23 bp, Homo sapiens
tgtccaagtccaaatcctgaagg

SEQ ID NO: 7110 - DNA, 23 bp, Homo sapiens
ctttcagttatgcttgcggctgg

SEQ ID NO: 7111 - DNA, 23 bp, Homo sapiens
tcaaattcaaactacagctctgg

SEQ ID NO: 7112 - DNA, 23 bp, Homo sapiens
ctggcagtcagtccatgccccgg

SEQ ID NO: 7113 - DNA, 23 bp, Homo sapiens
ggtgacactaagtcccagaccgg

SEQ ID NO: 7114 - DNA, 23 bp, Homo sapiens
ggtccacgaggagctctgagggg

SEQ ID NO: 7115 - DNA, 23 bp, Homo sapiens
agtctccaaaaagaagctcaagg

SEQ ID NO: 7116 - DNA, 23 bp, Homo sapiens
tctcttccctaacaagttactgg

SEQ ID NO: 7117 - DNA, 23 bp, Homo sapiens
tcatcatgatgctttggtggagg

SEQ ID NO: 7118 - DNA, 23 bp, Homo sapiens
gacgatgacattgactggctggg

SEQ ID NO: 7119 - DNA, 23 bp, Homo sapiens
gcttctaaaactggaatgacagg

SEQ ID NO: 7120 - DNA, 23 bp, Homo sapiens
tggattcatgtgcacatgtctgg

SEQ ID NO: 7121 - DNA, 23 bp, Homo sapiens
agctgctcaacttagagtgaagg

SEQ ID NO: 7122 - DNA, 23 bp, Homo sapiens
ctgccccaagctcatctagcagg

SEQ ID NO: 7123 - DNA, 23 bp, Homo sapiens
tgcaaccctggtgttcgaggtgg

SEQ ID NO: 7124 - DNA, 23 bp, Homo sapiens
tgcaaaactcacttttgaagtgg

SEQ ID NO: 7125 - DNA, 23 bp, Homo sapiens
ggcagggagccagtctcaggtgg

SEQ ID NO: 7126 - DNA, 23 bp, Homo sapiens
ccttggcgtggcgtcatacgtgg

SEQ ID NO: 7127 - DNA, 23 bp, Homo sapiens
tgagatggaaaggattgcatagg

SEQ ID NO: 7128 - DNA, 23 bp, Homo sapiens
ctacagcaggagaaagttgaagg

SEQ ID NO: 7129 - DNA, 23 bp, Homo sapiens
tatgctatagttcatcgtgttgg

SEQ ID NO: 7130 - DNA, 23 bp, Homo sapiens
ccacctaggtggtcagttcctgg

SEQ ID NO: 7131 - DNA, 23 bp, Homo sapiens
ggtttagagttcatcgtgtttgg

SEQ ID NO: 7132 - DNA, 23 bp, Homo sapiens
cagggtctgcgcaagatgtttgg

SEQ ID NO: 7133 - DNA, 23 bp, Homo sapiens
ctgctgagtctgacgggaagcgg

SEQ ID NO: 7134 - DNA, 23 bp, Homo sapiens
agttggcttcaatgtattcgagg

SEQ ID NO: 7135 - DNA, 23 bp, Homo sapiens
gcctatttctgagtgggatgagg

SEQ ID NO: 7136 - DNA, 23 bp, Homo sapiens
ttccgaagtttacactgtgctgg

SEQ ID NO: 7137 - DNA, 23 bp, Homo sapiens
ctagggtgggaggtcatgtgcgg

SEQ ID NO: 7138 - DNA, 23 bp, Homo sapiens
gcccctgcattactgagatctgg

SEQ ID NO: 7139 - DNA, 23 bp, Homo sapiens
tcctgtatgaccgagggtaaggg

SEQ ID NO: 7140 - DNA, 23 bp, Homo sapiens
cacaacaatcacaccgagatcgg

SEQ ID NO: 7141 - DNA, 23 bp, Homo sapiens
gccccacagcctcggagtctcgg

SEQ ID NO: 7142 - DNA, 23 bp, Homo sapiens
aataaggacccaggtttatgtgg

SEQ ID NO: 7143 - DNA, 23 bp, Homo sapiens
tgctgtctgttgaccatgaaagg

SEQ ID NO: 7144 - DNA, 23 bp, Homo sapiens
acccacgtgccttcacacttagg

SEQ ID NO: 7145 - DNA, 23 bp, Homo sapiens
gtgccagcctgtcttaggccagg

SEQ ID NO: 7146 - DNA, 23 bp, Homo sapiens
ccatctggattcatgttttctgg

SEQ ID NO: 7147 - DNA, 23 bp, Homo sapiens
atctgtcccttgtctgattaggg

SEQ ID NO: 7148 - DNA, 23 bp, Homo sapiens
agactcagggcaccacaacgcgg

SEQ ID NO: 7149 - DNA, 23 bp, Homo sapiens
taaggcactgtgacatgaaaagg

SEQ ID NO: 7150 - DNA, 23 bp, Homo sapiens
gaggcacttttgggattcaaggg

SEQ ID NO: 7151 - DNA, 23 bp, Homo sapiens
aaggctcaggctgttctcaaagg

SEQ ID NO: 7152 - DNA, 23 bp, Homo sapiens
gccactggtgtgcaggtgtgagg

SEQ ID NO: 7153 - DNA, 23 bp, Homo sapiens
ggtgggcgggcatcatgtgtagg

SEQ ID NO: 7154 - DNA, 23 bp, Homo sapiens
gggcctctggctgtcacgtatgg

SEQ ID NO: 7155 - DNA, 23 bp, Homo sapiens
gagtgtgagtgatctgagtctgg

SEQ ID NO: 7156 - DNA, 23 bp, Homo sapiens
acaaaaaggctgttttctctcgg

SEQ ID NO: 7157 - DNA, 23 bp, Homo sapiens
cggaaggaaatggaagtagttgg

SEQ ID NO: 7158 - DNA, 23 bp, Homo sapiens
gcttcgtgtcaaactctagatgg

SEQ ID NO: 7159 - DNA, 23 bp, Homo sapiens
ggtgatgatgacgatgacgatgg

SEQ ID NO: 7160 - DNA, 23 bp, Homo sapiens
ctcaggtcgaagattcgtagagg

SEQ ID NO: 7161 - DNA, 23 bp, Homo sapiens
ctgcttgtggagcactgacctgg

SEQ ID NO: 7162 - DNA, 23 bp, Homo sapiens
tatacaatttcatggggacaagg

SEQ ID NO: 7163 - DNA, 23 bp, Homo sapiens
atagacaagaaagcggcttcagg

SEQ ID NO: 7164 - DNA, 23 bp, Homo sapiens
aagaaagtcacgcgggcagacgg

SEQ ID NO: 7165 - DNA, 23 bp, Homo sapiens
aattgctgattctgactgcttgg

SEQ ID NO: 7166 - DNA, 23 bp, Homo sapiens
gtcagaggatcatctctgagagg

SEQ ID NO: 7167 - DNA, 23 bp, Homo sapiens
ctgaaagccagcagatttatggg

SEQ ID NO: 7168 - DNA, 23 bp, Homo sapiens
ctctgcccacatcgcctcactgg

SEQ ID NO: 7169 - DNA, 23 bp, Homo sapiens
gcgcctgttgtcaaggttacagg

SEQ ID NO: 7170 - DNA, 23 bp, Homo sapiens
tcagcctggagggaagggctggg

SEQ ID NO: 7171 - DNA, 23 bp, Homo sapiens
aagggaaggagagtagaagtggg

SEQ ID NO: 7172 - DNA, 23 bp, Homo sapiens
tgtgtcttcatcttagttagtgg

SEQ ID NO: 7173 - DNA, 23 bp, Homo sapiens
ataaaaccaagacatgactctgg

SEQ ID NO: 7174 - DNA, 23 bp, Homo sapiens
agaggggcatctcttctcccagg

SEQ ID NO: 7175 - DNA, 23 bp, Homo sapiens
cagaacttgcgttctgttaatgg

SEQ ID NO: 7176 - DNA, 23 bp, Homo sapiens
tgcctccgagagggtctcagtgg

SEQ ID NO: 7177 - DNA, 23 bp, Homo sapiens
tagctttctggctttgcttgtgg

SEQ ID NO: 7178 - DNA, 23 bp, Homo sapiens
ctgactaggaccattgaagttgg

SEQ ID NO: 7179 - DNA, 23 bp, Homo sapiens
atgatgattaggtcaacacaagg

SEQ ID NO: 7180 - DNA, 23 bp, Homo sapiens
tacctagtaagtctttggcgagg

SEQ ID NO: 7181 - DNA, 23 bp, Homo sapiens
tcccggaataaaggggcctaagg

SEQ ID NO: 7182 - DNA, 23 bp, Homo sapiens
tgatgacaagagtagttgaaagg

SEQ ID NO: 7183 - DNA, 23 bp, Homo sapiens
tgccatcatttcactctgtgagg

SEQ ID NO: 7184 - DNA, 23 bp, Homo sapiens
gggctgctcagatctcgatgagg

SEQ ID NO: 7185 - DNA, 23 bp, Homo sapiens
ggtcagcaaccactcgtgaatgg

SEQ ID NO: 7186 - DNA, 23 bp, Homo sapiens
gcaagaggacgtgaggaacatgg

SEQ ID NO: 7187 - DNA, 23 bp, Homo sapiens
attaggagactcagtatccaagg

SEQ ID NO: 7188 - DNA, 23 bp, Homo sapiens
tggaaagatgatttactctcggg

SEQ ID NO: 7189 - DNA, 23 bp, Homo sapiens
tgcgaaggctgctcaagtagcgg

SEQ ID NO: 7190 - DNA, 23 bp, Homo sapiens
aggaatctggtcaagtgagcggg

SEQ ID NO: 7191 - DNA, 23 bp, Homo sapiens
ttcatatgtcgaagtctgtttgg

SEQ ID NO: 7192 - DNA, 23 bp, Homo sapiens
agttacatctatgtatgacgtgg

SEQ ID NO: 7193 - DNA, 23 bp, Homo sapiens
aaggctgaagagaaggaaaatgg

SEQ ID NO: 7194 - DNA, 23 bp, Homo sapiens
gggtctccatccctggaaagtgg

SEQ ID NO: 7195 - DNA, 23 bp, Homo sapiens
cgggcggcctcgcgcttcagggg

SEQ ID NO: 7196 - DNA, 23 bp, Homo sapiens
aaatcatctctcagacagagtgg

SEQ ID NO: 7197 - DNA, 23 bp, Homo sapiens
aaaagaaagcaaacagcacaagg

SEQ ID NO: 7198 - DNA, 23 bp, Homo sapiens
tttgcagccatcattgtgcttgg

SEQ ID NO: 7199 - DNA, 23 bp, Homo sapiens
tttcttcactcaaacgtcgatgg

SEQ ID NO: 7200 - DNA, 23 bp, Homo sapiens
caccagagcaccagggcgggggg

SEQ ID NO: 7201 - DNA, 23 bp, Homo sapiens
ccaccctgtgcctcatgctctgg

SEQ ID NO: 7202 - DNA, 23 bp, Homo sapiens
tgtcatactggcggcagaagagg

SEQ ID NO: 7203 - DNA, 23 bp, Homo sapiens
ctctggaagtacacttggaatgg

SEQ ID NO: 7204 - DNA, 23 bp, Homo sapiens
tacctatttccctgttaaggggg

SEQ ID NO: 7205 - DNA, 23 bp, Homo sapiens
cgctatactgcctcattgtgggg

SEQ ID NO: 7206 - DNA, 23 bp, Homo sapiens
aacccactttgggcacaactggg

SEQ ID NO: 7207 - DNA, 23 bp, Homo sapiens
aggagtatttgtgcaacatatgg

SEQ ID NO: 7208 - DNA, 23 bp, Homo sapiens
aagagtatttgagccacataagg

SEQ ID NO: 7209 - DNA, 23 bp, Homo sapiens
ctgtgctgtgtttgctttgaagg

SEQ ID NO: 7210 - DNA, 23 bp, Homo sapiens
tatggaccagagcatatggttgg

SEQ ID NO: 7211 - DNA, 23 bp, Homo sapiens
tttgagtgaagtagcctaagagg

SEQ ID NO: 7212 - DNA, 23 bp, Homo sapiens
gcctggccctaatgctgctgtgg

SEQ ID NO: 7213 - DNA, 23 bp, Homo sapiens
gggaggactgaactcagccaagg

SEQ ID NO: 7214 - DNA, 23 bp, Homo sapiens
atgctggggccccgtctcgtggg

SEQ ID NO: 7215 - DNA, 23 bp, Homo sapiens
tgcgctctttgcgccagctctgg

SEQ ID NO: 7216 - DNA, 23 bp, Homo sapiens
atgagaaactgtctgtccaacgg

SEQ ID NO: 7217 - DNA, 23 bp, Homo sapiens
tgaagatcttcatgtttctcagg

SEQ ID NO: 7218 - DNA, 23 bp, Homo sapiens
acgctgctggccctgtgaggggg

SEQ ID NO: 7219 - DNA, 23 bp, Homo sapiens
tctaaagagttcacagagcgagg

SEQ ID NO: 7220 - DNA, 23 bp, Homo sapiens
ccaaccctcctcgctttgtgagg

SEQ ID NO: 7221 - DNA, 23 bp, Homo sapiens
actgaccgacttcctgcaggcgg

SEQ ID NO: 7222 - DNA, 23 bp, Homo sapiens
cttgaactcccccactctgctgg

SEQ ID NO: 7223 - DNA, 23 bp, Homo sapiens
ccgggagctaggaagtgtttagg

SEQ ID NO: 7224 - DNA, 23 bp, Homo sapiens
gaagccgtcgtcttcttaagagg

SEQ ID NO: 7225 - DNA, 23 bp, Homo sapiens
ttgcttaatgcatcctagcaggg

SEQ ID NO: 7226 - DNA, 23 bp, Homo sapiens
ctccgccttgcactcggtggcgg

SEQ ID NO: 7227 - DNA, 23 bp, Homo sapiens
caagggcggctccttgcactcgg

SEQ ID NO: 7228 - DNA, 23 bp, Homo sapiens
acagtcgtagacgaaagctccgg

SEQ ID NO: 7229 - DNA, 23 bp, Homo sapiens
tcagtatttcgtgcagtcgtagg

SEQ ID NO: 7230 - DNA, 23 bp, Homo sapiens
gtgtcgagaactttactgctagg

SEQ ID NO: 7231 - DNA, 23 bp, Homo sapiens
gggcctgctgcggtcagaagtgg

SEQ ID NO: 7232 - DNA, 23 bp, Homo sapiens
gccaaatggccggcgcaataggg

SEQ ID NO: 7233 - DNA, 23 bp, Homo sapiens
cactcccacctggctctaggagg

SEQ ID NO: 7234 - DNA, 23 bp, Homo sapiens
aggcggtggcagagggctctagg

SEQ ID NO: 7235 - DNA, 23 bp, Homo sapiens
cgggcacctgtcggcctcgtcgg

SEQ ID NO: 7236 - DNA, 23 bp, Homo sapiens
cggcctcgtcggcgctgctgagg

SEQ ID NO: 7237 - DNA, 23 bp, Homo sapiens
ccactgcctgatacctcagcagg

SEQ ID NO: 7238 - DNA, 23 bp, Homo sapiens
cgtccctacgctggctcacatgg

SEQ ID NO: 7239 - DNA, 23 bp, Homo sapiens
caaggccaggaggggctcagcgg

SEQ ID NO: 7240 - DNA, 23 bp, Homo sapiens
atcaagccttgcgtgatgtgagg

SEQ ID NO: 7241 - DNA, 23 bp, Homo sapiens
taagccctgcgtcatgtgaacgg

SEQ ID NO: 7242 - DNA, 23 bp, Homo sapiens
tttacgacgggactgtctggggg

SEQ ID NO: 7243 - DNA, 23 bp, Homo sapiens
ccctgtcttaagagcctcacagg

SEQ ID NO: 7244 - DNA, 23 bp, Homo sapiens
cagggagggcaccgaggtctagg

SEQ ID NO: 7245 - DNA, 23 bp, Homo sapiens
ggaagggaccgaagtttgaaggg

SEQ ID NO: 7246 - DNA, 23 bp, Homo sapiens
tgagagtctgctctacacctcgg

SEQ ID NO: 7247 - DNA, 23 bp, Homo sapiens
cgtgggggccttcttgtaagagg

SEQ ID NO: 7248 - DNA, 23 bp, Homo sapiens
gatccctgatgacttcgactggg

SEQ ID NO: 7249 - DNA, 23 bp, Homo sapiens
tgattgggattcaattgtgtagg

SEQ ID NO: 7250 - DNA, 23 bp, Homo sapiens
gggccaggcaccggggagtgagg

SEQ ID NO: 7251 - DNA, 23 bp, Homo sapiens
gctctcccggtcgctagttctgg

SEQ ID NO: 7252 - DNA, 23 bp, Homo sapiens
cgtgccattgtttgctttactgg

SEQ ID NO: 7253 - DNA, 23 bp, Homo sapiens
cggtgggctctcagagatcgagg

SEQ ID NO: 7254 - DNA, 23 bp, Homo sapiens
tgcggtgcttggctagcaaaggg

SEQ ID NO: 7255 - DNA, 23 bp, Homo sapiens
gcagggctctactgtagctcagg

SEQ ID NO: 7256 - DNA, 23 bp, Homo sapiens
agctgggcacagctcatgccagg

SEQ ID NO: 7257 - DNA, 23 bp, Homo sapiens
gctggaattcgtacatgtttagg

SEQ ID NO: 7258 - DNA, 23 bp, Homo sapiens
aaaggggcagaaagagcaaaagg

SEQ ID NO: 7259 - DNA, 23 bp, Homo sapiens
tgaggctgacagctcaaagcagg

SEQ ID NO: 7260 - DNA, 23 bp, Homo sapiens
atagctgggtgtcaggctgaggg

SEQ ID NO: 7261 - DNA, 23 bp, Homo sapiens
agagctgggtgccaggctgaagg

SEQ ID NO: 7262 - DNA, 23 bp, Homo sapiens
catggatgagggcgagggactgg

SEQ ID NO: 7263 - DNA, 23 bp, Homo sapiens
agagctgggtgccgggctgaggg

SEQ ID NO: 7264 - DNA, 23 bp, Homo sapiens
attcaaaatggggaagggttagg

SEQ ID NO: 7265 - DNA, 23 bp, Homo sapiens
tgaaccagtaaacgaggacatgg

SEQ ID NO: 7266 - DNA, 23 bp, Homo sapiens
gcaatatgcacttacaggtttgg

SEQ ID NO: 7267 - DNA, 23 bp, Homo sapiens
agagcctttatctgaagatctgg

SEQ ID NO: 7268 - DNA, 23 bp, Homo sapiens
ttccttgatcttgaggtcagggg

SEQ ID NO: 7269 - DNA, 23 bp, Homo sapiens
cgggagaagaactgtcctaaggg

SEQ ID NO: 7270 - DNA, 23 bp, Homo sapiens
cccgcggcgctactcaggctagg

SEQ ID NO: 7271 - DNA, 23 bp, Homo sapiens
cttggggttaaagatcaaagagg

SEQ ID NO: 7272 - DNA, 23 bp, Homo sapiens
aagagagaggtcaacaactctgg

SEQ ID NO: 7273 - DNA, 23 bp, Homo sapiens
ctcagatgatgttgttctcctgg

SEQ ID NO: 7274 - DNA, 23 bp, Homo sapiens
gtccgtcgatagcaacaaagagg

SEQ ID NO: 7275 - DNA, 23 bp, Homo sapiens
tactcaaagaagaacattcctgg

SEQ ID NO: 7276 - DNA, 23 bp, Homo sapiens
caaccccgggccttggctactgg

SEQ ID NO: 7277 - DNA, 23 bp, Homo sapiens
acagcaacttatagctattcagg

SEQ ID NO: 7278 - DNA, 23 bp, Homo sapiens
atgaagatcgttttgggatgtgg

SEQ ID NO: 7279 - DNA, 23 bp, Homo sapiens
gagttacaggcaaagtgaggagg

SEQ ID NO: 7280 - DNA, 23 bp, Homo sapiens
actgagttacaggcaatgtgagg

SEQ ID NO: 7281 - DNA, 23 bp, Homo sapiens
acggagttacaagcaatgtgagg

SEQ ID NO: 7282 - DNA, 23 bp, Homo sapiens
tgtgatttttcatctgtctctgg

SEQ ID NO: 7283 - DNA, 23 bp, Homo sapiens
gaggcggcttacacgttcaaagg

SEQ ID NO: 7284 - DNA, 23 bp, Homo sapiens
ggtgtgaaatattgtggtcaagg

SEQ ID NO: 7285 - DNA, 23 bp, Homo sapiens
ccccgggcgtgttagctgccagg

SEQ ID NO: 7286 - DNA, 23 bp, Homo sapiens
aggaggcctgcgtcagagcaagg

SEQ ID NO: 7287 - DNA, 23 bp, Homo sapiens
aatggcaaacaaaagactgtagg

SEQ ID NO: 7288 - DNA, 23 bp, Homo sapiens
cttctgagctgtcattgtgatgg

SEQ ID NO: 7289 - DNA, 23 bp, Homo sapiens
actctgcttacagtccgtgatgg

SEQ ID NO: 7290 - DNA, 23 bp, Homo sapiens
gacagatactgcaagtgactggg

SEQ ID NO: 7291 - DNA, 23 bp, Homo sapiens
gactgtcagtggatcagatgagg

SEQ ID NO: 7292 - DNA, 23 bp, Homo sapiens
ggatcagatgaggctaagctggg

SEQ ID NO: 7293 - DNA, 23 bp, Homo sapiens
ctacatttgagacactgcgttgg

SEQ ID NO: 7294 - DNA, 23 bp, Homo sapiens
accacaggagtttgtggtgtagg

SEQ ID NO: 7295 - DNA, 23 bp, Homo sapiens
cacctcatcctctacatgctggg

SEQ ID NO: 7296 - DNA, 23 bp, Homo sapiens
tgctgggtctgtttactgcatgg

SEQ ID NO: 7297 - DNA, 23 bp, Homo sapiens
accaaagtactgatgaatagagg

SEQ ID NO: 7298 - DNA, 23 bp, Homo sapiens
gcagttcagactaatgttccagg

SEQ ID NO: 7299 - DNA, 23 bp, Homo sapiens
gcaacagcagcatcaggggtggg

SEQ ID NO: 7300 - DNA, 23 bp, Homo sapiens
ctgctcattgacacctgagaagg

SEQ ID NO: 7301 - DNA, 23 bp, Homo sapiens
cttctcaggtgtcaatgagcagg

SEQ ID NO: 7302 - DNA, 23 bp, Homo sapiens
ggactttacacaacaaactctgg

SEQ ID NO: 7303 - DNA, 23 bp, Homo sapiens
acacaccaactgctgaagacagg

SEQ ID NO: 7304 - DNA, 23 bp, Homo sapiens
gacagcctggagcagggctgagg

SEQ ID NO: 7305 - DNA, 23 bp, Homo sapiens
gcatccacggccctgtaaacagg

SEQ ID NO: 7306 - DNA, 23 bp, Homo sapiens
tctgtcgaaagtctggttagagg

SEQ ID NO: 7307 - DNA, 23 bp, Homo sapiens
ggcagatgccctacttaataagg

SEQ ID NO: 7308 - DNA, 23 bp, Homo sapiens
ccatcggctccccaagattaagg

SEQ ID NO: 7309 - DNA, 23 bp, Homo sapiens
gactggggtcatgtctgtagagg

SEQ ID NO: 7310 - DNA, 23 bp, Homo sapiens
ggccctgcagctgtggttagggg

SEQ ID NO: 7311 - DNA, 23 bp, Homo sapiens
caatgctttccaggctcacatgg

SEQ ID NO: 7312 - DNA, 23 bp, Homo sapiens
ggaccgggaagtccctacagagg

SEQ ID NO: 7313 - DNA, 23 bp, Homo sapiens
ttctggcactagtctctgacagg

SEQ ID NO: 7314 - DNA, 23 bp, Homo sapiens
atgggaaatatggtgagcactgg

SEQ ID NO: 7315 - DNA, 23 bp, Homo sapiens
ggatttagttgcgtgcttgccgg

SEQ ID NO: 7316 - DNA, 23 bp, Homo sapiens
agctgaaagcaattcgcttacgg

SEQ ID NO: 7317 - DNA, 23 bp, Homo sapiens
cgtcctcctgaactgtagtcagg

SEQ ID NO: 7318 - DNA, 23 bp, Homo sapiens
gcctcgctctgggagtactaggg

SEQ ID NO: 7319 - DNA, 23 bp, Homo sapiens
accgcgctttgggagtactgagg

SEQ ID NO: 7320 - DNA, 23 bp, Homo sapiens
agagtgtatctgggaattttagg

SEQ ID NO: 7321 - DNA, 23 bp, Homo sapiens
cctgcaggcctgtcgtcacctgg

SEQ ID NO: 7322 - DNA, 23 bp, Homo sapiens
ggtgcctgggggcctaggtgagg

SEQ ID NO: 7323 - DNA, 23 bp, Homo sapiens
atagttcttcagagttctccagg

SEQ ID NO: 7324 - DNA, 23 bp, Homo sapiens
tgaagtgttctcacagcacttgg

SEQ ID NO: 7325 - DNA, 23 bp, Homo sapiens
gggtgtctaaaggtacataatgg

SEQ ID NO: 7326 - DNA, 23 bp, Homo sapiens
gggcccagctactgctcctttgg

SEQ ID NO: 7327 - DNA, 23 bp, Homo sapiens
ttttgggctaaatgacttagagg

SEQ ID NO: 7328 - DNA, 23 bp, Homo sapiens
gagaactgagtttcagatgttgg

SEQ ID NO: 7329 - DNA, 23 bp, Homo sapiens
aaaagcttcagtgttcatcctgg

SEQ ID NO: 7330 - DNA, 23 bp, Homo sapiens
atataggaaagctgtagtcctgg

SEQ ID NO: 7331 - DNA, 23 bp, Homo sapiens
ctactggaagtaaagcactccgg

SEQ ID NO: 7332 - DNA, 23 bp, Homo sapiens
agcaccaaagagatctaatgagg

SEQ ID NO: 7333 - DNA, 23 bp, Homo sapiens
aggtggtgagtctgcagaagagg

SEQ ID NO: 7334 - DNA, 23 bp, Homo sapiens
gtgggtgggtgaggtatgaaggg

SEQ ID NO: 7335 - DNA, 23 bp, Homo sapiens
atttattgagtcgtccatctagg

SEQ ID NO: 7336 - DNA, 23 bp, Homo sapiens
tggagacccggcaggagtgacgg

SEQ ID NO: 7337 - DNA, 23 bp, Homo sapiens
gcaggaccttcgacgctggaagg

SEQ ID NO: 7338 - DNA, 23 bp, Homo sapiens
ggactgcttggagacccggcagg

SEQ ID NO: 7339 - DNA, 23 bp, Homo sapiens
gctgggttggtgcagcctagggg

SEQ ID NO: 7340 - DNA, 23 bp, Homo sapiens
ggtgtcacagtggaatagtgtgg

SEQ ID NO: 7341 - DNA, 23 bp, Homo sapiens
acaagcgcaaccaagcctaaagg

SEQ ID NO: 7342 - DNA, 23 bp, Homo sapiens
ggtttaacaggttctgagcatgg

SEQ ID NO: 7343 - DNA, 23 bp, Homo sapiens
tttcattatcactgtctcccagg

SEQ ID NO: 7344 - DNA, 23 bp, Homo sapiens
tctgggctcaggtgtgtttctgg

SEQ ID NO: 7345 - DNA, 23 bp, Homo sapiens
gggctcaagtctctttgacgcgg

SEQ ID NO: 7346 - DNA, 23 bp, Homo sapiens
tgggcgagtatctcttcgaaagg

SEQ ID NO: 7347 - DNA, 23 bp, Homo sapiens
tctgcttgttttcatttccaagg

SEQ ID NO: 7348 - DNA, 23 bp, Homo sapiens
tctggaagcaaaaccctagaagg

SEQ ID NO: 7349 - DNA, 23 bp, Homo sapiens
ccctcagtgccacaccctgctgg

SEQ ID NO: 7350 - DNA, 23 bp, Homo sapiens
ccaaagagcacagcaacgtaagg

SEQ ID NO: 7351 - DNA, 23 bp, Homo sapiens
acagcatcctccagcacctcagg

SEQ ID NO: 7352 - DNA, 23 bp, Homo sapiens
gcaggcgcaggcccacagccagg

SEQ ID NO: 7353 - DNA, 23 bp, Homo sapiens
gcttggactataaagctgacagg

SEQ ID NO: 7354 - DNA, 23 bp, Homo sapiens
gatgccgtgtaaatggggctggg

SEQ ID NO: 7355 - DNA, 23 bp, Homo sapiens
cagagagaagccagcttcatggg

SEQ ID NO: 7356 - DNA, 23 bp, Homo sapiens
ttgctcggacttgcatcttaagg

SEQ ID NO: 7357 - DNA, 23 bp, Homo sapiens
ctgcttggcatggcatcctaagg

SEQ ID NO: 7358 - DNA, 23 bp, Homo sapiens
gcttttgctgttgtggcaacggg

SEQ ID NO: 7359 - DNA, 23 bp, Homo sapiens
gtcttcaccaggcctacagcagg

SEQ ID NO: 7360 - DNA, 23 bp, Homo sapiens
gtgggcagtgggctcatcagagg

SEQ ID NO: 7361 - DNA, 23 bp, Homo sapiens
gggagccaggctaattaatacgg

SEQ ID NO: 7362 - DNA, 23 bp, Homo sapiens
cttgtctccactctggacattgg

SEQ ID NO: 7363 - DNA, 23 bp, Homo sapiens
gttttggggcctagtattcaagg

SEQ ID NO: 7364 - DNA, 23 bp, Homo sapiens
aacagagcagacgaaattttggg

SEQ ID NO: 7365 - DNA, 23 bp, Homo sapiens
ggccccactcggaaaaaggcagg

SEQ ID NO: 7366 - DNA, 23 bp, Homo sapiens
ccagcattagtgcttgagtaagg

SEQ ID NO: 7367 - DNA, 23 bp, Homo sapiens
agcggcttggttcacctgagagg

SEQ ID NO: 7368 - DNA, 23 bp, Homo sapiens
acttggccagctggttcgagcgg

SEQ ID NO: 7369 - DNA, 23 bp, Homo sapiens
ggaccttgagggttggtttcagg

SEQ ID NO: 7370 - DNA, 23 bp, Homo sapiens
gagctttatttctcagcctcagg

SEQ ID NO: 7371 - DNA, 23 bp, Homo sapiens
tggcttgcgatcatgtgaaaagg

SEQ ID NO: 7372 - DNA, 23 bp, Homo sapiens
ctgctaggtagtcaaagaagtgg

SEQ ID NO: 7373 - DNA, 23 bp, Homo sapiens
ctgtggctgttccatccctgagg

SEQ ID NO: 7374 - DNA, 23 bp, Homo sapiens
taaggctttagtgagctctgcgg

SEQ ID NO: 7375 - DNA, 23 bp, Homo sapiens
tgggcatcaagcatcttttccgg

SEQ ID NO: 7376 - DNA, 23 bp, Homo sapiens
caagaagcagcagtcctgaatgg

SEQ ID NO: 7377 - DNA, 23 bp, Homo sapiens
tcagttaatgaaaatgggctagg

SEQ ID NO: 7378 - DNA, 23 bp, Homo sapiens
gttgggtagtatggtgaatgggg

SEQ ID NO: 7379 - DNA, 23 bp, Homo sapiens
ccaggtgtttctaccgcctgcgg

SEQ ID NO: 7380 - DNA, 23 bp, Homo sapiens
gtgggggcaataagaagcgcagg

SEQ ID NO: 7381 - DNA, 23 bp, Homo sapiens
ggctcagcccaaagctgatgagg

SEQ ID NO: 7382 - DNA, 23 bp, Homo sapiens
tgccggaacagtatcttacccgg

SEQ ID NO: 7383 - DNA, 23 bp, Homo sapiens
tgtcctgtgatgctcacgtcagg

SEQ ID NO: 7384 - DNA, 23 bp, Homo sapiens
gtcctgtgctcagcaagtagtgg

SEQ ID NO: 7385 - DNA, 23 bp, Homo sapiens
ctgggttctcaaaggtccctggg

SEQ ID NO: 7386 - DNA, 23 bp, Homo sapiens
ggttatgccggaatcgttgcagg

SEQ ID NO: 7387 - DNA, 23 bp, Homo sapiens
cagccagcccgactcctaggagg

SEQ ID NO: 7388 - DNA, 23 bp, Homo sapiens
cacttcagttctctgctttctgg

SEQ ID NO: 7389 - DNA, 23 bp, Homo sapiens
ggcagaagattccgctgtggggg

SEQ ID NO: 7390 - DNA, 23 bp, Homo sapiens
tgttacacgccgccgccaccagg

SEQ ID NO: 7391 - DNA, 23 bp, Homo sapiens
tgtccttcggagttacctagcgg

SEQ ID NO: 7392 - DNA, 23 bp, Homo sapiens
tatcactagattttgttcggtgg

SEQ ID NO: 7393 - DNA, 23 bp, Homo sapiens
tactgaggtgctgaagctacagg

SEQ ID NO: 7394 - DNA, 23 bp, Homo sapiens
tccgcagacccgggccttacagg

SEQ ID NO: 7395 - DNA, 23 bp, Homo sapiens
ccgctttgtcaccgtgggatagg

SEQ ID NO: 7396 - DNA, 23 bp, Homo sapiens
gctcaccaacagcaaacaagggg

SEQ ID NO: 7397 - DNA, 23 bp, Homo sapiens
tcgcccacctgcgtgtgaacagg

SEQ ID NO: 7398 - DNA, 23 bp, Homo sapiens
gcctgggggcgtccctcacacgg

SEQ ID NO: 7399 - DNA, 23 bp, Homo sapiens
agacaagacaaattaagcactgg

SEQ ID NO: 7400 - DNA, 23 bp, Homo sapiens
ggcagtgagactgtggtataagg

SEQ ID NO: 7401 - DNA, 23 bp, Homo sapiens
gtccctgtcgcacgtgtaggagg

SEQ ID NO: 7402 - DNA, 23 bp, Homo sapiens
gtgagaaaagagcagggaggtgg

SEQ ID NO: 7403 - DNA, 23 bp, Homo sapiens
cagcagcaagggggagactgcgg

SEQ ID NO: 7404 - DNA, 23 bp, Homo sapiens
gccattgtcccaggtctgagcgg

SEQ ID NO: 7405 - DNA, 23 bp, Homo sapiens
cgccaggcctgtgtggctagagg

SEQ ID NO: 7406 - DNA, 23 bp, Homo sapiens
gtcctgcccggcaggtttaccgg

SEQ ID NO: 7407 - DNA, 23 bp, Homo sapiens
ggtctcccacagttcctaggagg

SEQ ID NO: 7408 - DNA, 23 bp, Homo sapiens
ctgcatgtggattttcctgttgg

SEQ ID NO: 7409 - DNA, 23 bp, Homo sapiens
tccatgaagattcactgccgtgg

SEQ ID NO: 7410 - DNA, 23 bp, Homo sapiens
caaatggagggccgcttcacagg

SEQ ID NO: 7411 - DNA, 23 bp, Homo sapiens
ggctggcattatagatgctgtgg

SEQ ID NO: 7412 - DNA, 23 bp, Homo sapiens
tcttacaacgacttcttgtgcgg

SEQ ID NO: 7413 - DNA, 23 bp, Homo sapiens
ggaaagaagagtcagtagagtgg

SEQ ID NO: 7414 - DNA, 23 bp, Homo sapiens
acacaagaagtcaggaagagtgg

SEQ ID NO: 7415 - DNA, 23 bp, Homo sapiens
tagccttcaagtggtgtgagcgg

SEQ ID NO: 7416 - DNA, 23 bp, Homo sapiens
tgcccagggctcagagcttgtgg

SEQ ID NO: 7417 - DNA, 23 bp, Homo sapiens
ctcgtcagctggtgttagccggg

SEQ ID NO: 7418 - DNA, 23 bp, Homo sapiens
tttcatttcacactcttcgctgg

SEQ ID NO: 7419 - DNA, 23 bp, Homo sapiens
gtggccctctcatcacagcttgg

SEQ ID NO: 7420 - DNA, 23 bp, Homo sapiens
aaggcaatccaaagtatgagagg

SEQ ID NO: 7421 - DNA, 23 bp, Homo sapiens
aggggcgccaagctgtgactcgg

SEQ ID NO: 7422 - DNA, 23 bp, Homo sapiens
tacagtgacgaaagtgtctacgg

SEQ ID NO: 7423 - DNA, 23 bp, Homo sapiens
gagtgtctatgggaaatgagtgg

SEQ ID NO: 7424 - DNA, 23 bp, Homo sapiens
agaacacttttggcttctgaggg

SEQ ID NO: 7425 - DNA, 23 bp, Homo sapiens
ccgaccggcttagctgtgatggg

SEQ ID NO: 7426 - DNA, 23 bp, Homo sapiens
cccaggcctcccacccttacagg

SEQ ID NO: 7427 - DNA, 23 bp, Homo sapiens
tgcttctctgcaaacggaaaagg

SEQ ID NO: 7428 - DNA, 23 bp, Homo sapiens
agaggcctacagacagaagttgg

SEQ ID NO: 7429 - DNA, 23 bp, Homo sapiens
atgactgcggcaaagcacaccgg

SEQ ID NO: 7430 - DNA, 23 bp, Homo sapiens
ttaagatgaaacagttgccatgg

SEQ ID NO: 7431 - DNA, 23 bp, Homo sapiens
tttcaccatggttgaagaggtgg

SEQ ID NO: 7432 - DNA, 23 bp, Homo sapiens
aaagatctattgatgtggtgtgg

SEQ ID NO: 7433 - DNA, 23 bp, Homo sapiens
aaacagagaacctgtattagggg

SEQ ID NO: 7434 - DNA, 23 bp, Homo sapiens
ccaccactatctactgtttgcgg

SEQ ID NO: 7435 - DNA, 23 bp, Homo sapiens
cacatttggggcatttaacatgg

SEQ ID NO: 7436 - DNA, 23 bp, Homo sapiens
agccgcctctccaaaataaccgg

SEQ ID NO: 7437 - DNA, 23 bp, Homo sapiens
actgacttccattgtatctttgg

SEQ ID NO: 7438 - DNA, 23 bp, Homo sapiens
tggctttactatgtacactgagg

SEQ ID NO: 7439 - DNA, 23 bp, Homo sapiens
ccttcttcaacatcgtctattgg

SEQ ID NO: 7440 - DNA, 23 bp, Homo sapiens
agtgaatggaaacacgatcctgg

SEQ ID NO: 7441 - DNA, 23 bp, Homo sapiens
gcctgagtcctgtgctcacatgg

SEQ ID NO: 7442 - DNA, 23 bp, Homo sapiens
gcttgtttgccttaacttgtagg

SEQ ID NO: 7443 - DNA, 23 bp, Homo sapiens
ttcaacttggtttattgggttgg

SEQ ID NO: 7444 - DNA, 23 bp, Homo sapiens
tcctacctctacctgtgaggagg

SEQ ID NO: 7445 - DNA, 23 bp, Homo sapiens
tcaaaagccagagaggcctaagg

SEQ ID NO: 7446 - DNA, 23 bp, Homo sapiens
tgagcaacacttagagatacagg

SEQ ID NO: 7447 - DNA, 23 bp, Homo sapiens
gtccctgcaagaacctgcattgg

SEQ ID NO: 7448 - DNA, 23 bp, Homo sapiens
tgctagccaatgtattttactgg

SEQ ID NO: 7449 - DNA, 23 bp, Homo sapiens
cactgggggactaatacatatgg

SEQ ID NO: 7450 - DNA, 23 bp, Homo sapiens
tgctgctggaaagatgatcctgg

SEQ ID NO: 7451 - DNA, 23 bp, Homo sapiens
attggtcagtgttttcctagggg

SEQ ID NO: 7452 - DNA, 23 bp, Homo sapiens
atgtcattgacacctattctagg

SEQ ID NO: 7453 - DNA, 23 bp, Homo sapiens
cgaaggatgattacagatcctgg

SEQ ID NO: 7454 - DNA, 23 bp, Homo sapiens
tgttggttgctacggtgatgggg

SEQ ID NO: 7455 - DNA, 23 bp, Homo sapiens
attgaagaaatagaacgccttgg

SEQ ID NO: 7456 - DNA, 23 bp, Homo sapiens
tccacattcatctcaatggaagg

SEQ ID NO: 7457 - DNA, 23 bp, Homo sapiens
ttaatctccctgaacggtgatgg

SEQ ID NO: 7458 - DNA, 23 bp, Homo sapiens
atctctcttcaggaacgctgagg

SEQ ID NO: 7459 - DNA, 23 bp, Homo sapiens
gtccccgccgggctgtcactcgg

SEQ ID NO: 7460 - DNA, 23 bp, Homo sapiens
tctggggcacccagctcctgagg

SEQ ID NO: 7461 - DNA, 23 bp, Homo sapiens
ctggatgagatagacttactggg

SEQ ID NO: 7462 - DNA, 23 bp, Homo sapiens
gaggtgaaaaggcctgaagaagg

SEQ ID NO: 7463 - DNA, 23 bp, Homo sapiens
gaagctcatagccaggaacaggg

SEQ ID NO: 7464 - DNA, 23 bp, Homo sapiens
ggaaccagcaactcaacgtcagg

SEQ ID NO: 7465 - DNA, 23 bp, Homo sapiens
gaagctgatagccaggaacaggg

SEQ ID NO: 7466 - DNA, 23 bp, Homo sapiens
ggctcccggcccctcttctgagg

SEQ ID NO: 7467 - DNA, 23 bp, Homo sapiens
cctcctcagaagacatcgagcgg

SEQ ID NO: 7468 - DNA, 23 bp, Homo sapiens
cggtgggacgtcaccaccgcagg

SEQ ID NO: 7469 - DNA, 23 bp, Homo sapiens
ccgttcctgggggcgtagagggg

SEQ ID NO: 7470 - DNA, 23 bp, Homo sapiens
tgcggagctcagggaccttgagg

SEQ ID NO: 7471 - DNA, 23 bp, Homo sapiens
tctgtagtctgatgtttatgggg

SEQ ID NO: 7472 - DNA, 23 bp, Homo sapiens
ccctgttaagtattagcgtgtgg

SEQ ID NO: 7473 - DNA, 23 bp, Homo sapiens
ggctttggcacgcaagcctgagg

SEQ ID NO: 7474 - DNA, 23 bp, Homo sapiens
gccaaggtgctgtgcttgtgagg

SEQ ID NO: 7475 - DNA, 23 bp, Homo sapiens
agtttgtttgctaccaaacctgg

SEQ ID NO: 7476 - DNA, 23 bp, Homo sapiens
tggggctttggttttgcttgagg

SEQ ID NO: 7477 - DNA, 23 bp, Homo sapiens
ttcaagttttctgtggcttaagg

SEQ ID NO: 7478 - DNA, 23 bp, Homo sapiens
tgagtctgcgcaggtgctagtgg

SEQ ID NO: 7479 - DNA, 23 bp, Homo sapiens
ggtctcagaatatttctggcagg

SEQ ID NO: 7480 - DNA, 23 bp, Homo sapiens
acacaccaactcaacagtcttgg

SEQ ID NO: 7481 - DNA, 23 bp, Homo sapiens
tggcatttggaaggttaaggtgg

SEQ ID NO: 7482 - DNA, 23 bp, Homo sapiens
ccaactcggatcatcagaaatgg

SEQ ID NO: 7483 - DNA, 23 bp, Homo sapiens
acatgatcttcatgtgcccaagg

SEQ ID NO: 7484 - DNA, 23 bp, Homo sapiens
ttgcaaagtgctatcattacagg

SEQ ID NO: 7485 - DNA, 23 bp, Homo sapiens
gggatgctatgtgctcgatgtgg

SEQ ID NO: 7486 - DNA, 23 bp, Homo sapiens
tgggacatggtgagctcttgagg

SEQ ID NO: 7487 - DNA, 23 bp, Homo sapiens
gcagattgtgaacaatgggtagg

SEQ ID NO: 7488 - DNA, 23 bp, Homo sapiens
ttttgaccagatcaatgctgtgg

SEQ ID NO: 7489 - DNA, 23 bp, Homo sapiens
agctgttgccacacacatgacgg

SEQ ID NO: 7490 - DNA, 23 bp, Homo sapiens
taagaactccatcaagtagaggg

SEQ ID NO: 7491 - DNA, 23 bp, Homo sapiens
ccccggtgggtcaggacgcgagg

SEQ ID NO: 7492 - DNA, 23 bp, Homo sapiens
ctcaacctgcagcagtaggaggg

SEQ ID NO: 7493 - DNA, 23 bp, Homo sapiens
catcagatccactccaaaaatgg

SEQ ID NO: 7494 - DNA, 23 bp, Homo sapiens
ttctcatttgtacatcaggtcgg

SEQ ID NO: 7495 - DNA, 23 bp, Homo sapiens
cagtgaagccatatcaaaagtgg

SEQ ID NO: 7496 - DNA, 23 bp, Homo sapiens
ttgaagacaccagacctgctggg

SEQ ID NO: 7497 - DNA, 23 bp, Homo sapiens
tcagttgtggctctttgtctagg

SEQ ID NO: 7498 - DNA, 23 bp, Homo sapiens
cgttttactggagtcacaattgg

SEQ ID NO: 7499 - DNA, 23 bp, Homo sapiens
cagcaccatctgaggatcactgg

SEQ ID NO: 7500 - DNA, 23 bp, Homo sapiens
gaaactggatcaaacacgcacgg

SEQ ID NO: 7501 - DNA, 23 bp, Homo sapiens
atctgtgaacagcctgtgaaagg

SEQ ID NO: 7502 - DNA, 23 bp, Homo sapiens
cctttcttctttctaggagttgg

SEQ ID NO: 7503 - DNA, 23 bp, Homo sapiens
ttgaagacatctatgacttcagg

SEQ ID NO: 7504 - DNA, 23 bp, Homo sapiens
acatgagtacaattggttgatgg

SEQ ID NO: 7505 - DNA, 23 bp, Homo sapiens
cagcatcctgacggttgatgtgg

SEQ ID NO: 7506 - DNA, 23 bp, Homo sapiens
ccaggcggcagggtttattccgg

SEQ ID NO: 7507 - DNA, 23 bp, Homo sapiens
tggtcggcgtggtcaggcgatgg

SEQ ID NO: 7508 - DNA, 23 bp, Homo sapiens
cggggtgggggctcagcctttgg

SEQ ID NO: 7509 - DNA, 23 bp, Homo sapiens
gcactgtggaaggccgaggtggg

SEQ ID NO: 7510 - DNA, 23 bp, Homo sapiens
cgtgttcattccccttgaggagg

SEQ ID NO: 7511 - DNA, 23 bp, Homo sapiens
aacatcccttgggttatcgcagg

SEQ ID NO: 7512 - DNA, 23 bp, Homo sapiens
caacattgccactgactgggagg

SEQ ID NO: 7513 - DNA, 23 bp, Homo sapiens
cagctgtgatcaagacctcccgg

SEQ ID NO: 7514 - DNA, 23 bp, Homo sapiens
tactgtttgaagacatcagaagg

SEQ ID NO: 7515 - DNA, 23 bp, Homo sapiens
ttagagttcaggcatgttcttgg

SEQ ID NO: 7516 - DNA, 23 bp, Homo sapiens
ggtccaggggtcttactccttgg

SEQ ID NO: 7517 - DNA, 23 bp, Homo sapiens
ttcagccgagacaagtgaaacgg

SEQ ID NO: 7518 - DNA, 23 bp, Homo sapiens
tcatcttgaggaacttcagaagg

SEQ ID NO: 7519 - DNA, 23 bp, Homo sapiens
gccttggtcttggtcactttcgg

SEQ ID NO: 7520 - DNA, 23 bp, Homo sapiens
ttatttgctggagtggttgctgg

SEQ ID NO: 7521 - DNA, 23 bp, Homo sapiens
ggtggtggtttcagagggagagg

SEQ ID NO: 7522 - DNA, 23 bp, Homo sapiens
tgcaattcattaatggctggagg

SEQ ID NO: 7523 - DNA, 23 bp, Homo sapiens
cagctgggcagttcagatcttgg

SEQ ID NO: 7524 - DNA, 23 bp, Homo sapiens
catcggagaaagccgtgagctgg

SEQ ID NO: 7525 - DNA, 23 bp, Homo sapiens
aaagagacaatcgaggaatgagg

SEQ ID NO: 7526 - DNA, 23 bp, Homo sapiens
aacttgcttagagttttacctgg

SEQ ID NO: 7527 - DNA, 23 bp, Homo sapiens
caagatctgttgggttaaagagg

SEQ ID NO: 7528 - DNA, 23 bp, Homo sapiens
gggcgcgagggctaaaagagcgg

SEQ ID NO: 7529 - DNA, 23 bp, Homo sapiens
tgacatgccaaatgtctatatgg

SEQ ID NO: 7530 - DNA, 23 bp, Homo sapiens
tgccagttataaggctaagaagg

SEQ ID NO: 7531 - DNA, 23 bp, Homo sapiens
agccagattcctggatgtgatgg

SEQ ID NO: 7532 - DNA, 23 bp, Homo sapiens
gaggaggagtcctgggtctgagg

SEQ ID NO: 7533 - DNA, 23 bp, Homo sapiens
tcttcctttttctttgcagtagg

SEQ ID NO: 7534 - DNA, 23 bp, Homo sapiens
cgtggagcccgccgcagcctagg

SEQ ID NO: 7535 - DNA, 23 bp, Homo sapiens
gtggacatggagatctagatggg

SEQ ID NO: 7536 - DNA, 23 bp, Homo sapiens
ccccaggggggcagctacgtcgg

SEQ ID NO: 7537 - DNA, 23 bp, Homo sapiens
cttcggccgccgcagtgctgagg

SEQ ID NO: 7538 - DNA, 23 bp, Homo sapiens
tggctccgctcagctcatgaggg

SEQ ID NO: 7539 - DNA, 23 bp, Homo sapiens
atggtgaccgccatgggctaggg

SEQ ID NO: 7540 - DNA, 23 bp, Homo sapiens
tcgagcagggctctaacccatgg

SEQ ID NO: 7541 - DNA, 23 bp, Homo sapiens
ggtcttggccgacagtcacgggg

SEQ ID NO: 7542 - DNA, 23 bp, Homo sapiens
gtgtgcgctggccttggcctagg

SEQ ID NO: 7543 - DNA, 23 bp, Homo sapiens
tggcggcgtgggctcaggccagg

SEQ ID NO: 7544 - DNA, 23 bp, Homo sapiens
gctacatatggactcatgttggg

SEQ ID NO: 7545 - DNA, 23 bp, Homo sapiens
tggctcgcactatttccacgtgg

SEQ ID NO: 7546 - DNA, 23 bp, Homo sapiens
gcgttatttctgtccactgatgg

SEQ ID NO: 7547 - DNA, 23 bp, Homo sapiens
acaatgacagcttcttctccagg

SEQ ID NO: 7548 - DNA, 23 bp, Homo sapiens
gaatgagctactcagctgtgtgg

SEQ ID NO: 7549 - DNA, 23 bp, Homo sapiens
tgctcttcctctgtggcagccgg

SEQ ID NO: 7550 - DNA, 23 bp, Homo sapiens
gcccaccctggtgccctcaccgg

SEQ ID NO: 7551 - DNA, 23 bp, Homo sapiens
cagtcctacttggactgaacagg

SEQ ID NO: 7552 - DNA, 23 bp, Homo sapiens
gttcaccatcctgtggtcagtgg

SEQ ID NO: 7553 - DNA, 23 bp, Homo sapiens
ttgagtatctgctccatcactgg

SEQ ID NO: 7554 - DNA, 23 bp, Homo sapiens
agtggaagtggctcttcagaggg

SEQ ID NO: 7555 - DNA, 23 bp, Homo sapiens
acagttcagacggctcactctgg

SEQ ID NO: 7556 - DNA, 23 bp, Homo sapiens
tggccttgaagcacatctgtagg

SEQ ID NO: 7557 - DNA, 23 bp, Homo sapiens
gtggatctgccgaattgaagagg

SEQ ID NO: 7558 - DNA, 23 bp, Homo sapiens
cccacctctgaggtcaactaagg

SEQ ID NO: 7559 - DNA, 23 bp, Homo sapiens
agatgaagtgacggttcaggtgg

SEQ ID NO: 7560 - DNA, 23 bp, Homo sapiens
agctccgtggtcagctcctcagg

SEQ ID NO: 7561 - DNA, 23 bp, Homo sapiens
aggctctggtctttagcttatgg

SEQ ID NO: 7562 - DNA, 23 bp, Homo sapiens
ccagatgagaagcaaatcattgg

SEQ ID NO: 7563 - DNA, 23 bp, Homo sapiens
aaacagaaaaacgaaccacaagg

SEQ ID NO: 7564 - DNA, 23 bp, Homo sapiens
gaagttgggtactttcaccttgg

SEQ ID NO: 7565 - DNA, 23 bp, Homo sapiens
ggagtagggacaaaatatcttgg

SEQ ID NO: 7566 - DNA, 23 bp, Homo sapiens
catcgttattaacagtcctctgg

SEQ ID NO: 7567 - DNA, 23 bp, Homo sapiens
aagcataagctccccttttaagg

SEQ ID NO: 7568 - DNA, 23 bp, Homo sapiens
tgtaataggctgagaaatcctgg

SEQ ID NO: 7569 - DNA, 23 bp, Homo sapiens
aacaaatggagcagggggcccgg

SEQ ID NO: 7570 - DNA, 23 bp, Homo sapiens
gagcgatgtggactacagctcgg

SEQ ID NO: 7571 - DNA, 23 bp, Homo sapiens
tagaacaggcccggccctgaggg

SEQ ID NO: 7572 - DNA, 23 bp, Homo sapiens
taaacatgcttcaggactacagg

SEQ ID NO: 7573 - DNA, 23 bp, Homo sapiens
aaagagaccacttgcaacaaggg

SEQ ID NO: 7574 - DNA, 23 bp, Homo sapiens
ggaagtggggcgactgcacgggg

SEQ ID NO: 7575 - DNA, 23 bp, Homo sapiens
tggcatcatctcttgccagaagg

SEQ ID NO: 7576 - DNA, 23 bp, Homo sapiens
tagttggtctggacttcgatagg

SEQ ID NO: 7577 - DNA, 23 bp, Homo sapiens
cgtaggtgttcacggcctccagg

SEQ ID NO: 7578 - DNA, 23 bp, Homo sapiens
tgatggagcggctcacttgctgg

SEQ ID NO: 7579 - DNA, 23 bp, Homo sapiens
gatggctgaggaatcaagtatgg

SEQ ID NO: 7580 - DNA, 23 bp, Homo sapiens
taggtgatgctctcctatgaagg

SEQ ID NO: 7581 - DNA, 23 bp, Homo sapiens
ttcagaccaaaatcactgacagg

SEQ ID NO: 7582 - DNA, 23 bp, Homo sapiens
gggtcccagcagggttcagaagg

SEQ ID NO: 7583 - DNA, 23 bp, Homo sapiens
aagagttcctgactctcattagg

SEQ ID NO: 7584 - DNA, 23 bp, Homo sapiens
gcctgctggagtcggggtagtgg

SEQ ID NO: 7585 - DNA, 23 bp, Homo sapiens
ttcttcttgccacctttttgtgg

SEQ ID NO: 7586 - DNA, 23 bp, Homo sapiens
gctggtgtggtgtctgcacaagg

SEQ ID NO: 7587 - DNA, 23 bp, Homo sapiens
cttgcggccactgctctcactgg

SEQ ID NO: 7588 - DNA, 23 bp, Homo sapiens
acatgggttcactgaacgtcagg

SEQ ID NO: 7589 - DNA, 23 bp, Homo sapiens
agttacttggatcagcatttagg

SEQ ID NO: 7590 - DNA, 23 bp, Homo sapiens
tcggtcattgtgaaaagtagagg

SEQ ID NO: 7591 - DNA, 23 bp, Homo sapiens
aaagatttgggtcatctcaaagg

SEQ ID NO: 7592 - DNA, 23 bp, Homo sapiens
gtcagttactcagacagagtggg

SEQ ID NO: 7593 - DNA, 23 bp, Homo sapiens
cgacaccatcctgacatgagagg

SEQ ID NO: 7594 - DNA, 23 bp, Homo sapiens
acacagcaaatggtcacacgtgg

SEQ ID NO: 7595 - DNA, 23 bp, Homo sapiens
gcatttgagacacaaagctttgg

SEQ ID NO: 7596 - DNA, 23 bp, Homo sapiens
aatagctcaaaaataccagctgg

SEQ ID NO: 7597 - DNA, 23 bp, Homo sapiens
tcaaagttcagtcccatagatgg

SEQ ID NO: 7598 - DNA, 23 bp, Homo sapiens
ttgaagaacagcagagagactgg

SEQ ID NO: 7599 - DNA, 23 bp, Homo sapiens
agaaagcaaacactccctagcgg

SEQ ID NO: 7600 - DNA, 23 bp, Homo sapiens
tgggctgtgatcttctacccagg

SEQ ID NO: 7601 - DNA, 23 bp, Homo sapiens
tccagccacttcactataaatgg

SEQ ID NO: 7602 - DNA, 23 bp, Homo sapiens
attatctcctgcgaaaactcagg

SEQ ID NO: 7603 - DNA, 23 bp, Homo sapiens
gcagcttgaggattttagtgtgg

SEQ ID NO: 7604 - DNA, 23 bp, Homo sapiens
gaagctcttgcagaaaatccagg

SEQ ID NO: 7605 - DNA, 23 bp, Homo sapiens
accatggaacattaaggaaatgg

SEQ ID NO: 7606 - DNA, 23 bp, Homo sapiens
accatttccttaatgttccatgg

SEQ ID NO: 7607 - DNA, 23 bp, Homo sapiens
ccgagggtcttacactgagctgg

SEQ ID NO: 7608 - DNA, 23 bp, Homo sapiens
acccagaccaaattatttctagg

SEQ ID NO: 7609 - DNA, 23 bp, Homo sapiens
ttttttcttgaggtaccagtagg

SEQ ID NO: 7610 - DNA, 23 bp, Homo sapiens
aagatggcaggtcacaaatctgg

SEQ ID NO: 7611 - DNA, 23 bp, Homo sapiens
aagttctccctcacctggtatgg

SEQ ID NO: 7612 - DNA, 23 bp, Homo sapiens
accgtgaaagtctagaagtgagg

SEQ ID NO: 7613 - DNA, 23 bp, Homo sapiens
ccaccctggagtggtctcaccgg

SEQ ID NO: 7614 - DNA, 23 bp, Homo sapiens
cgctgtggctgctcttaaggtgg

SEQ ID NO: 7615 - DNA, 23 bp, Homo sapiens
ccaggactgctcatatgcagtgg

SEQ ID NO: 7616 - DNA, 23 bp, Homo sapiens
gcgtggcagagtgtgggtgcagg

SEQ ID NO: 7617 - DNA, 23 bp, Homo sapiens
cgatgaatgtgggtgtgggtagg

SEQ ID NO: 7618 - DNA, 23 bp, Homo sapiens
tcgtggagtcgtgtggctgcagg

SEQ ID NO: 7619 - DNA, 23 bp, Homo sapiens
gtgttctctctagatgaccgagg

SEQ ID NO: 7620 - DNA, 23 bp, Homo sapiens
agtcgtgcggctgcaggtagcgg

SEQ ID NO: 7621 - DNA, 23 bp, Homo sapiens
tggtggaggcctgcggctgcagg

SEQ ID NO: 7622 - DNA, 23 bp, Homo sapiens
gaggaccatttgttaacgacagg

SEQ ID NO: 7623 - DNA, 23 bp, Homo sapiens
cgcaaacagaacgacgtctttgg

SEQ ID NO: 7624 - DNA, 23 bp, Homo sapiens
cgcaagaagaatgacatctatgg

SEQ ID NO: 7625 - DNA, 23 bp, Homo sapiens
aagcattccgctaaaaggtgtgg

SEQ ID NO: 7626 - DNA, 23 bp, Homo sapiens
agactatccaacaaagcttaggg

SEQ ID NO: 7627 - DNA, 23 bp, Homo sapiens
gaggcattcaagtaagtttctgg

SEQ ID NO: 7628 - DNA, 23 bp, Homo sapiens
tgaaggccattgcagctatttgg

SEQ ID NO: 7629 - DNA, 23 bp, Homo sapiens
aaacagcagtgctgctgacaagg

SEQ ID NO: 7630 - DNA, 23 bp, Homo sapiens
tcgaggcttctggacttaggagg

SEQ ID NO: 7631 - DNA, 23 bp, Homo sapiens
tcagagtggaagtaagaatgagg

SEQ ID NO: 7632 - DNA, 23 bp, Homo sapiens
agaccctcatagagcggagtggg

SEQ ID NO: 7633 - DNA, 23 bp, Homo sapiens
agaagtattattgctcttcctgg

SEQ ID NO: 7634 - DNA, 23 bp, Homo sapiens
ccatgacctctctgtactctagg

SEQ ID NO: 7635 - DNA, 23 bp, Homo sapiens
agagatcagctacatcaagatgg

SEQ ID NO: 7636 - DNA, 23 bp, Homo sapiens
ctctgaagtgaggctcttagtgg

SEQ ID NO: 7637 - DNA, 23 bp, Homo sapiens
aagatgagcagcttctgacttgg

SEQ ID NO: 7638 - DNA, 23 bp, Homo sapiens
aaattcacatacagaaggtctgg

SEQ ID NO: 7639 - DNA, 23 bp, Homo sapiens
cacacttcctggcctctcattgg

SEQ ID NO: 7640 - DNA, 23 bp, Homo sapiens
tcccataggtgtgcaagcagagg

SEQ ID NO: 7641 - DNA, 23 bp, Homo sapiens
tgccctgagctcagaacttcagg

SEQ ID NO: 7642 - DNA, 23 bp, Homo sapiens
agttttaatctctggcgtaaagg

SEQ ID NO: 7643 - DNA, 23 bp, Homo sapiens
cccatcgagctggactgaactgg

SEQ ID NO: 7644 - DNA, 23 bp, Homo sapiens
gagcacaaggatgtgatgtgagg

SEQ ID NO: 7645 - DNA, 23 bp, Homo sapiens
gcaggcagctaaccgcgagccgg

SEQ ID NO: 7646 - DNA, 23 bp, Homo sapiens
ggagcgctgcagtgtcacgaagg

SEQ ID NO: 7647 - DNA, 23 bp, Homo sapiens
ggatggctcctgtgactagaggg

SEQ ID NO: 7648 - DNA, 23 bp, Homo sapiens
ggcaccgggagacgcagcatggg

SEQ ID NO: 7649 - DNA, 23 bp, Homo sapiens
agccagcacaatctcaagtgagg

SEQ ID NO: 7650 - DNA, 23 bp, Homo sapiens
attaatgacgtcttcttgtgtgg

SEQ ID NO: 7651 - DNA, 23 bp, Homo sapiens
gtttgtgcctgctgtagaaaagg

SEQ ID NO: 7652 - DNA, 23 bp, Homo sapiens
acactgctcaaccggagaagtgg

SEQ ID NO: 7653 - DNA, 23 bp, Homo sapiens
tctaagcagccaggtataaatgg

SEQ ID NO: 7654 - DNA, 23 bp, Homo sapiens
ttagacaggctgcatccctaagg

SEQ ID NO: 7655 - DNA, 23 bp, Homo sapiens
tcaatctgtgctaacagtagagg

SEQ ID NO: 7656 - DNA, 23 bp, Homo sapiens
gcccaggaaggagagctcagagg

SEQ ID NO: 7657 - DNA, 23 bp, Homo sapiens
gagcccaggtgcaggctcatagg

SEQ ID NO: 7658 - DNA, 23 bp, Homo sapiens
aaatctgtgactgtagagtgagg

SEQ ID NO: 7659 - DNA, 23 bp, Homo sapiens
aagtctgtaactgtggaatgagg

SEQ ID NO: 7660 - DNA, 23 bp, Homo sapiens
agataatagggtggacagagcgg

SEQ ID NO: 7661 - DNA, 23 bp, Homo sapiens
ctcggttcccacagcctacaagg

SEQ ID NO: 7662 - DNA, 23 bp, Homo sapiens
gctcctgagcctatggtagctgg

SEQ ID NO: 7663 - DNA, 23 bp, Homo sapiens
ctcccggccctgctctgattagg

SEQ ID NO: 7664 - DNA, 23 bp, Homo sapiens
ctaatgaatcagagttctccagg

SEQ ID NO: 7665 - DNA, 23 bp, Homo sapiens
cacgaagttgttggggagcgtgg

SEQ ID NO: 7666 - DNA, 23 bp, Homo sapiens
ccccagcccctctgttctagagg

SEQ ID NO: 7667 - DNA, 23 bp, Homo sapiens
ttcccagacctggctgtcttggg

SEQ ID NO: 7668 - DNA, 23 bp, Homo sapiens
cctactgactacctcttgcttgg

SEQ ID NO: 7669 - DNA, 23 bp, Homo sapiens
acagcgtcctctggggtcatagg

SEQ ID NO: 7670 - DNA, 23 bp, Homo sapiens
ccccgggagaacagataaggggg

SEQ ID NO: 7671 - DNA, 23 bp, Homo sapiens
aacttctcttgatactccagcgg

SEQ ID NO: 7672 - DNA, 23 bp, Homo sapiens
tgaagacatcatcaaaaaggggg

SEQ ID NO: 7673 - DNA, 23 bp, Homo sapiens
gtccactcagagttctgaagggg

SEQ ID NO: 7674 - DNA, 23 bp, Homo sapiens
gaactgtgggaaatattgactgg

SEQ ID NO: 7675 - DNA, 23 bp, Homo sapiens
aatgcggttttcacagcattagg

SEQ ID NO: 7676 - DNA, 23 bp, Homo sapiens
ttgagccgactacactcagttgg

SEQ ID NO: 7677 - DNA, 23 bp, Homo sapiens
agtggctggttgacaacggctgg

SEQ ID NO: 7678 - DNA, 23 bp, Homo sapiens
tttactaaggctactagctcagg

SEQ ID NO: 7679 - DNA, 23 bp, Homo sapiens
ctcctggagcactcagtagccgg

SEQ ID NO: 7680 - DNA, 23 bp, Homo sapiens
agcagtgtcttagtagcctgcgg

SEQ ID NO: 7681 - DNA, 23 bp, Homo sapiens
ctgccaccttggctcccaagtgg

SEQ ID NO: 7682 - DNA, 23 bp, Homo sapiens
ccccttccaggggttctaacagg

SEQ ID NO: 7683 - DNA, 23 bp, Homo sapiens
ggggcaggcccaggcactagtgg

SEQ ID NO: 7684 - DNA, 23 bp, Homo sapiens
agacatctactttctccacgtgg

SEQ ID NO: 7685 - DNA, 23 bp, Homo sapiens
gccccaccccgctgctctacagg

SEQ ID NO: 7686 - DNA, 23 bp, Homo sapiens
tggagcaatcagtagccagcagg

SEQ ID NO: 7687 - DNA, 23 bp, Homo sapiens
cgctctgtggagggcagctgtgg

SEQ ID NO: 7688 - DNA, 23 bp, Homo sapiens
ttttattaggacaaggctggtgg

SEQ ID NO: 7689 - DNA, 23 bp, Homo sapiens
ttttgtgtcaaacttgctgtagg

SEQ ID NO: 7690 - DNA, 23 bp, Homo sapiens
aggtgtttgtggcgctgaggggg

SEQ ID NO: 7691 - DNA, 23 bp, Homo sapiens
ccagtgtctgcaggagagggtgg

SEQ ID NO: 7692 - DNA, 23 bp, Homo sapiens
gcaactatgctggcaactggagg

SEQ ID NO: 7693 - DNA, 23 bp, Homo sapiens
aaggcatgattttgttcagttgg

SEQ ID NO: 7694 - DNA, 23 bp, Homo sapiens
catgtaaattggctcatctgagg

SEQ ID NO: 7695 - DNA, 23 bp, Homo sapiens
acaggaggaatcttcatccctgg

SEQ ID NO: 7696 - DNA, 23 bp, Homo sapiens
ggtgctgacatctatgtgctagg

SEQ ID NO: 7697 - DNA, 23 bp, Homo sapiens
gcttgtgggcgatcacttgtcgg

SEQ ID NO: 7698 - DNA, 23 bp, Homo sapiens
agagagaagggagaaggcacagg

SEQ ID NO: 7699 - DNA, 23 bp, Homo sapiens
aagatgaaagttctcgggcctgg

SEQ ID NO: 7700 - DNA, 23 bp, Homo sapiens
ctgttctgaaccgttgtcaccgg

SEQ ID NO: 7701 - DNA, 23 bp, Homo sapiens
acgcaagcgcaggcgctacttgg

SEQ ID NO: 7702 - DNA, 23 bp, Homo sapiens
tcgttagtactgtgtgaaattgg

SEQ ID NO: 7703 - DNA, 23 bp, Homo sapiens
ttctggtgagatcgagagcgtgg

SEQ ID NO: 7704 - DNA, 23 bp, Homo sapiens
catgggtgaaatcgagacgttgg

SEQ ID NO: 7705 - DNA, 23 bp, Homo sapiens
taggacctgcgctgtcagtcagg

SEQ ID NO: 7706 - DNA, 23 bp, Homo sapiens
gcatcaagtgtttgactctgagg

SEQ ID NO: 7707 - DNA, 23 bp, Homo sapiens
gggatctgtaactataacctagg

SEQ ID NO: 7708 - DNA, 23 bp, Homo sapiens
tattttgttacgtctgttcgcgg

SEQ ID NO: 7709 - DNA, 23 bp, Homo sapiens
caagtccagcacaggctcaaagg

SEQ ID NO: 7710 - DNA, 23 bp, Homo sapiens
tgctttcagaaatatggcatagg

SEQ ID NO: 7711 - DNA, 23 bp, Homo sapiens
ttttaaggagtttttcggcttgg

SEQ ID NO: 7712 - DNA, 23 bp, Homo sapiens
tagaatttagcagcgttttcagg

SEQ ID NO: 7713 - DNA, 23 bp, Homo sapiens
tctgttggactcttcaaaccagg

SEQ ID NO: 7714 - DNA, 23 bp, Homo sapiens
aggttttcagctcttttctctgg

SEQ ID NO: 7715 - DNA, 23 bp, Homo sapiens
cctcggcgcatggtcatgacagg

SEQ ID NO: 7716 - DNA, 23 bp, Homo sapiens
tctggagagtactcagtctcagg

SEQ ID NO: 7717 - DNA, 23 bp, Homo sapiens
tcttcttgtaattctgaacgagg

SEQ ID NO: 7718 - DNA, 23 bp, Homo sapiens
attgcacctctggttgcatctgg

SEQ ID NO: 7719 - DNA, 23 bp, Homo sapiens
agacaaacctctgcaggctcagg

SEQ ID NO: 7720 - DNA, 23 bp, Homo sapiens
tccgggggcagtcctagtagcgg

SEQ ID NO: 7721 - DNA, 23 bp, Homo sapiens
attggtgatgccaaacgaagagg

SEQ ID NO: 7722 - DNA, 23 bp, Homo sapiens
taccgcggggggccgtagcttgg

SEQ ID NO: 7723 - DNA, 23 bp, Homo sapiens
gttggaaagttactgctaggggg

SEQ ID NO: 7724 - DNA, 23 bp, Homo sapiens
gaggtcactgcttcttctctcgg

SEQ ID NO: 7725 - DNA, 23 bp, Homo sapiens
aaagagaacaacaactgacaagg

SEQ ID NO: 7726 - DNA, 23 bp, Homo sapiens
caagatacagcagctaatgaagg

SEQ ID NO: 7727 - DNA, 23 bp, Homo sapiens
ccactgcaagcaaaacaaaccgg

SEQ ID NO: 7728 - DNA, 23 bp, Homo sapiens
aagcctgtatctagatctccagg

SEQ ID NO: 7729 - DNA, 23 bp, Homo sapiens
atggagggggagattatttatgg

SEQ ID NO: 7730 - DNA, 23 bp, Homo sapiens
gcaggcacccgggcactagatgg

SEQ ID NO: 7731 - DNA, 23 bp, Homo sapiens
cttcttagaagcagagctgctgg

SEQ ID NO: 7732 - DNA, 23 bp, Homo sapiens
taaaggagggtcacactgatagg

SEQ ID NO: 7733 - DNA, 23 bp, Homo sapiens
tacggttagatcgtctgacctgg

SEQ ID NO: 7734 - DNA, 23 bp, Homo sapiens
tgtttagatctgaagatctgtgg

SEQ ID NO: 7735 - DNA, 23 bp, Homo sapiens
gcctggtatgtggcatcagcagg

SEQ ID NO: 7736 - DNA, 23 bp, Homo sapiens
aactgggcaatgcgttaaactgg

SEQ ID NO: 7737 - DNA, 23 bp, Homo sapiens
acccctgccctgtggtcagatgg

SEQ ID NO: 7738 - DNA, 23 bp, Homo sapiens
cggccccagtggatgcaggtggg

SEQ ID NO: 7739 - DNA, 23 bp, Homo sapiens
gaagaaaaccatcttgtgagggg

SEQ ID NO: 7740 - DNA, 23 bp, Homo sapiens
agtggtcaaaatgcaatcacagg

SEQ ID NO: 7741 - DNA, 23 bp, Homo sapiens
gctgtggcactcacacactgagg

SEQ ID NO: 7742 - DNA, 23 bp, Homo sapiens
ccgccaggattaaatccagacgg

SEQ ID NO: 7743 - DNA, 23 bp, Homo sapiens
agaccaccgtgtggatctgaggg

SEQ ID NO: 7744 - DNA, 23 bp, Homo sapiens
ggacccagagatgcctgagttgg

SEQ ID NO: 7745 - DNA, 23 bp, Homo sapiens
gactctgcctatgtgtgagaggg

SEQ ID NO: 7746 - DNA, 23 bp, Homo sapiens
aggcggtgcccgcccctagatgg

SEQ ID NO: 7747 - DNA, 23 bp, Homo sapiens
gagagccaggaagtctgagtggg

SEQ ID NO: 7748 - DNA, 23 bp, Homo sapiens
acaactcaatctccagaaagtgg

SEQ ID NO: 7749 - DNA, 23 bp, Homo sapiens
atcggagcaaggtacatctcagg

SEQ ID NO: 7750 - DNA, 23 bp, Homo sapiens
attggagcaagatatatctcggg

SEQ ID NO: 7751 - DNA, 23 bp, Homo sapiens
cagtgaaacgctccatgaattgg

SEQ ID NO: 7752 - DNA, 23 bp, Homo sapiens
gctaatgtaatcacctacactgg

SEQ ID NO: 7753 - DNA, 23 bp, Homo sapiens
ttccttctgtggagacacggtgg

SEQ ID NO: 7754 - DNA, 23 bp, Homo sapiens
ctgtgcagacattcatgtttagg

SEQ ID NO: 7755 - DNA, 23 bp, Homo sapiens
ctgaagcaaaacagtgcctgtgg

SEQ ID NO: 7756 - DNA, 23 bp, Homo sapiens
caggctttcatcatcatacatgg

SEQ ID NO: 7757 - DNA, 23 bp, Homo sapiens
ggagttaagtgggcactgaaagg

SEQ ID NO: 7758 - DNA, 23 bp, Homo sapiens
gaaccagtacattaagtgagcgg

SEQ ID NO: 7759 - DNA, 23 bp, Homo sapiens
tcagacacagttttacagcgtgg

SEQ ID NO: 7760 - DNA, 23 bp, Homo sapiens
catagttctgagcagagatgtgg

SEQ ID NO: 7761 - DNA, 23 bp, Homo sapiens
aagctaccttaaaggcagcaggg

SEQ ID NO: 7762 - DNA, 23 bp, Homo sapiens
gggctgctttatggcgaatgtgg

SEQ ID NO: 7763 - DNA, 23 bp, Homo sapiens
gccctcttttgttcagaaaatgg

SEQ ID NO: 7764 - DNA, 23 bp, Homo sapiens
tgcagcacatcactgatttaagg

SEQ ID NO: 7765 - DNA, 23 bp, Homo sapiens
ggactactttcccaggtatcagg

SEQ ID NO: 7766 - DNA, 23 bp, Homo sapiens
gtgacatcaggagcgccagaagg

SEQ ID NO: 7767 - DNA, 23 bp, Homo sapiens
agtgtgcagaaaggtcaggctgg

SEQ ID NO: 7768 - DNA, 23 bp, Homo sapiens
tgacacgagagctcaaggacagg

SEQ ID NO: 7769 - DNA, 23 bp, Homo sapiens
ctctttaggcactagagttgagg

SEQ ID NO: 7770 - DNA, 23 bp, Homo sapiens
tcctgaacatgatgacctagagg

SEQ ID NO: 7771 - DNA, 23 bp, Homo sapiens
attccttgcagttatgcaatagg

SEQ ID NO: 7772 - DNA, 23 bp, Homo sapiens
gtgcactaccgcgagtagccggg

SEQ ID NO: 7773 - DNA, 23 bp, Homo sapiens
gtacttgtgctgtaccaaaatgg

SEQ ID NO: 7774 - DNA, 23 bp, Homo sapiens
gcctttaatccattcagcttagg

SEQ ID NO: 7775 - DNA, 23 bp, Homo sapiens
aaaagaaaagatggaggaagagg

SEQ ID NO: 7776 - DNA, 23 bp, Homo sapiens
acgagaagaccttatgaaccagg

SEQ ID NO: 7777 - DNA, 23 bp, Homo sapiens
aggcctgggctgcctagcagagg

SEQ ID NO: 7778 - DNA, 23 bp, Homo sapiens
ttaacaagttacttcttcggcgg

SEQ ID NO: 7779 - DNA, 23 bp, Homo sapiens
ccatctacacagacacctgaagg

SEQ ID NO: 7780 - DNA, 23 bp, Homo sapiens
tgggctcagttcaccacagccgg

SEQ ID NO: 7781 - DNA, 23 bp, Homo sapiens
ccaagagagcttttagccttcgg

SEQ ID NO: 7782 - DNA, 23 bp, Homo sapiens
tgaaagtgttctagctcgagtgg

SEQ ID NO: 7783 - DNA, 23 bp, Homo sapiens
agagagcgggccttaatttatgg

SEQ ID NO: 7784 - DNA, 23 bp, Homo sapiens
aggcccgctctctggagggaagg

SEQ ID NO: 7785 - DNA, 23 bp, Homo sapiens
attctcacagcactacattaagg

SEQ ID NO: 7786 - DNA, 23 bp, Homo sapiens
aacccaaagcttcaggttaacgg

SEQ ID NO: 7787 - DNA, 23 bp, Homo sapiens
gaggtccagcctccatcacgagg

SEQ ID NO: 7788 - DNA, 23 bp, Homo sapiens
ggcgctggagtctcagctgcagg

SEQ ID NO: 7789 - DNA, 23 bp, Homo sapiens
gaagagagtgagatctagggtgg

SEQ ID NO: 7790 - DNA, 23 bp, Homo sapiens
caacctttcagacccttcactgg

SEQ ID NO: 7791 - DNA, 23 bp, Homo sapiens
tagggcacatctatttcttgtgg

SEQ ID NO: 7792 - DNA, 23 bp, Homo sapiens
caaaaaagctaatgggaagcagg

SEQ ID NO: 7793 - DNA, 23 bp, Homo sapiens
aaccacgcggaaactctacgtgg

SEQ ID NO: 7794 - DNA, 23 bp, Homo sapiens
tcttctcaaccttaaatccaagg

SEQ ID NO: 7795 - DNA, 23 bp, Homo sapiens
agtgctgccagagtgcccctggg

SEQ ID NO: 7796 - DNA, 23 bp, Homo sapiens
ttgaagaacaagaagcagaaagg

SEQ ID NO: 7797 - DNA, 23 bp, Homo sapiens
ctgacgcggctaaagcagattgg

SEQ ID NO: 7798 - DNA, 23 bp, Homo sapiens
actcataggcttcacaaagaagg

SEQ ID NO: 7799 - DNA, 23 bp, Homo sapiens
gaattgctgcctatactgagagg

SEQ ID NO: 7800 - DNA, 23 bp, Homo sapiens
aggacttggccgccctcacttgg

SEQ ID NO: 7801 - DNA, 23 bp, Homo sapiens
agtgtcacctgagtcaaatgagg

SEQ ID NO: 7802 - DNA, 23 bp, Homo sapiens
accgtccataagaatcttgatgg

SEQ ID NO: 7803 - DNA, 23 bp, Homo sapiens
agtacttgaagttggaggagtgg

SEQ ID NO: 7804 - DNA, 23 bp, Homo sapiens
tttctaagttctctttggacagg

SEQ ID NO: 7805 - DNA, 23 bp, Homo sapiens
aaggaagcactgaagattgaggg

SEQ ID NO: 7806 - DNA, 23 bp, Homo sapiens
tgctggtgataacagctaggtgg

SEQ ID NO: 7807 - DNA, 23 bp, Homo sapiens
ttgagatctcggtatatcttcgg

SEQ ID NO: 7808 - DNA, 23 bp, Homo sapiens
gggtagagttatatcagctatgg

SEQ ID NO: 7809 - DNA, 23 bp, Homo sapiens
tgagcttaactacaaggtgtagg

SEQ ID NO: 7810 - DNA, 23 bp, Homo sapiens
ctgctccagctggcctaagacgg

SEQ ID NO: 7811 - DNA, 23 bp, Homo sapiens
tggtgtgaccttcacatagatgg

SEQ ID NO: 7812 - DNA, 23 bp, Homo sapiens
gtactggaagggctcatcgccgg

SEQ ID NO: 7813 - DNA, 23 bp, Homo sapiens
gttcaggattggcatcacagagg

SEQ ID NO: 7814 - DNA, 23 bp, Homo sapiens
ttatcaaactcacatggccttgg

SEQ ID NO: 7815 - DNA, 23 bp, Homo sapiens
agcagcttcattgtctaaaatgg

SEQ ID NO: 7816 - DNA, 23 bp, Homo sapiens
gtccttgtggctggcatcagtgg

SEQ ID NO: 7817 - DNA, 23 bp, Homo sapiens
gcagttttttactgggctagagg

SEQ ID NO: 7818 - DNA, 23 bp, Homo sapiens
tggcccatgggggtcagagtcgg

SEQ ID NO: 7819 - DNA, 23 bp, Homo sapiens
tgttcctgcggcctcggtgatgg

SEQ ID NO: 7820 - DNA, 23 bp, Homo sapiens
gtcgacagcttagtgtatgtagg

SEQ ID NO: 7821 - DNA, 23 bp, Homo sapiens
ggcaagcagccctgacctaaggg

SEQ ID NO: 7822 - DNA, 23 bp, Homo sapiens
tctctaaagggcatataacatgg

SEQ ID NO: 7823 - DNA, 23 bp, Homo sapiens
tggtgatgaacttggacagcagg

SEQ ID NO: 7824 - DNA, 23 bp, Homo sapiens
ccgaggcgctgctcaggcattgg

SEQ ID NO: 7825 - DNA, 23 bp, Homo sapiens
gtggtcttagaggattaactggg

SEQ ID NO: 7826 - DNA, 23 bp, Homo sapiens
ctgtcggctacttccgctcgtgg

SEQ ID NO: 7827 - DNA, 23 bp, Homo sapiens
gaatggttacgtgagaaacttgg

SEQ ID NO: 7828 - DNA, 23 bp, Homo sapiens
agacaacttttcttggagccagg

SEQ ID NO: 7829 - DNA, 23 bp, Homo sapiens
ggtgccagggtggtcagagatgg

SEQ ID NO: 7830 - DNA, 23 bp, Homo sapiens
gtcagcaatatattgccatgagg

SEQ ID NO: 7831 - DNA, 23 bp, Homo sapiens
aggggtcactaagactgcttagg

SEQ ID NO: 7832 - DNA, 23 bp, Homo sapiens
acatggctttgcatccgtagagg

SEQ ID NO: 7833 - DNA, 23 bp, Homo sapiens
aaccagatcatcctctgagtagg

SEQ ID NO: 7834 - DNA, 23 bp, Homo sapiens
gcctcgtatcatcatgtgagggg

SEQ ID NO: 7835 - DNA, 23 bp, Homo sapiens
tccccagggttagctgaacacgg

SEQ ID NO: 7836 - DNA, 23 bp, Homo sapiens
ggtgaatccaatcttcagtgagg

SEQ ID NO: 7837 - DNA, 23 bp, Homo sapiens
gcccccaggaactactgagtggg

SEQ ID NO: 7838 - DNA, 23 bp, Homo sapiens
tgggcctgggcgctcagaccagg

SEQ ID NO: 7839 - DNA, 23 bp, Homo sapiens
actgcagcatgatgtccttcagg

SEQ ID NO: 7840 - DNA, 23 bp, Homo sapiens
actgtagcataagctgcttgagg

SEQ ID NO: 7841 - DNA, 23 bp, Homo sapiens
tgggcagcagcttttagacaagg

SEQ ID NO: 7842 - DNA, 23 bp, Homo sapiens
ggtggggcctgggtcacagcagg

SEQ ID NO: 7843 - DNA, 23 bp, Homo sapiens
ctgcacattcttagtatctgtgg

SEQ ID NO: 7844 - DNA, 23 bp, Homo sapiens
ggactgcggcctcttctgagggg

SEQ ID NO: 7845 - DNA, 23 bp, Homo sapiens
ctgcacattcttcgtgtctgtgg

SEQ ID NO: 7846 - DNA, 23 bp, Homo sapiens
aagcagtatgagctcttgtgagg

SEQ ID NO: 7847 - DNA, 23 bp, Homo sapiens
gccaaaaacctgcggggctgtgg

SEQ ID NO: 7848 - DNA, 23 bp, Homo sapiens
gccaacaacctccggggctgcgg

SEQ ID NO: 7849 - DNA, 23 bp, Homo sapiens
gaacctgaaggagtacaatctgg

SEQ ID NO: 7850 - DNA, 23 bp, Homo sapiens
gctgcaaggagcaacagcgatgg

SEQ ID NO: 7851 - DNA, 23 bp, Homo sapiens
cagtacgagctgctctaagaagg

SEQ ID NO: 7852 - DNA, 23 bp, Homo sapiens
gatcctcatctgcttcacaatgg

SEQ ID NO: 7853 - DNA, 23 bp, Homo sapiens
aaagactgtggcctcttctgagg

SEQ ID NO: 7854 - DNA, 23 bp, Homo sapiens
ggaatggtgaggattagaagagg

SEQ ID NO: 7855 - DNA, 23 bp, Homo sapiens
attttgggtgtcagtagcacagg

SEQ ID NO: 7856 - DNA, 23 bp, Homo sapiens
aagtacattggcctttgctgagg

SEQ ID NO: 7857 - DNA, 23 bp, Homo sapiens
gggatagcttcctcaagatctgg

SEQ ID NO: 7858 - DNA, 23 bp, Homo sapiens
gagtgggtgagtcatgcgcgtgg

SEQ ID NO: 7859 - DNA, 23 bp, Homo sapiens
tcctcaagatctggaactaatgg

SEQ ID NO: 7860 - DNA, 23 bp, Homo sapiens
ctcaaaatctggaactgaggagg

SEQ ID NO: 7861 - DNA, 23 bp, Homo sapiens
gggacagttttcttagaatctgg

SEQ ID NO: 7862 - DNA, 23 bp, Homo sapiens
tgctttctgctctggatcatggg

SEQ ID NO: 7863 - DNA, 23 bp, Homo sapiens
ttctggactacacaacacgcagg

SEQ ID NO: 7864 - DNA, 23 bp, Homo sapiens
gagtcttcagagtaaagcacagg

SEQ ID NO: 7865 - DNA, 23 bp, Homo sapiens
acagctgcctttttctttaaagg

SEQ ID NO: 7866 - DNA, 23 bp, Homo sapiens
ttcaaatctcaccctttgagagg

SEQ ID NO: 7867 - DNA, 23 bp, Homo sapiens
gggccgggtgcggggctcacagg

SEQ ID NO: 7868 - DNA, 23 bp, Homo sapiens
tggcattgccctgggttcatagg

SEQ ID NO: 7869 - DNA, 23 bp, Homo sapiens
ggcccctctcaaagacttaaagg

SEQ ID NO: 7870 - DNA, 23 bp, Homo sapiens
gaagggacaggggagctcagagg

SEQ ID NO: 7871 - DNA, 23 bp, Homo sapiens
tccctggacattgctaccagtgg

SEQ ID NO: 7872 - DNA, 23 bp, Homo sapiens
gtttcaagtctgcagctgcctgg

SEQ ID NO: 7873 - DNA, 23 bp, Homo sapiens
tgactctgaaggactctgggagg

SEQ ID NO: 7874 - DNA, 23 bp, Homo sapiens
cacaaaagaggcgcttgtcgcgg

SEQ ID NO: 7875 - DNA, 23 bp, Homo sapiens
cccttcaaggagctcaaaggagg

SEQ ID NO: 7876 - DNA, 23 bp, Homo sapiens
tttccctctactctcatcctagg

SEQ ID NO: 7877 - DNA, 23 bp, Homo sapiens
cccttatgccctgctgggtgagg

SEQ ID NO: 7878 - DNA, 23 bp, Homo sapiens
aagaagaccaatgactcagaggg

SEQ ID NO: 7879 - DNA, 23 bp, Homo sapiens
ctgtctgaggagactacagcagg

SEQ ID NO: 7880 - DNA, 23 bp, Homo sapiens
ggcaatgctgatgatggtgttgg

SEQ ID NO: 7881 - DNA, 23 bp, Homo sapiens
gacaaggtgagagggctcagagg

SEQ ID NO: 7882 - DNA, 23 bp, Homo sapiens
acttcatccacgtgctcaagagg

SEQ ID NO: 7883 - DNA, 23 bp, Homo sapiens
tattaaagttttgcagtggctgg

SEQ ID NO: 7884 - DNA, 23 bp, Homo sapiens
agcacaggctaatcgctgtatgg

SEQ ID NO: 7885 - DNA, 23 bp, Homo sapiens
gcatgtgcacaataaacttgtgg

SEQ ID NO: 7886 - DNA, 23 bp, Homo sapiens
aagaaaactacatgtgtcggagg

SEQ ID NO: 7887 - DNA, 23 bp, Homo sapiens
ttctttgtgtatcctccttctgg

SEQ ID NO: 7888 - DNA, 23 bp, Homo sapiens
ggggtgacccaggactgcgtggg

SEQ ID NO: 7889 - DNA, 23 bp, Homo sapiens
gtctgattgaagaggaaactggg

SEQ ID NO: 7890 - DNA, 23 bp, Homo sapiens
ccatcctccaataaagtgtgagg

SEQ ID NO: 7891 - DNA, 23 bp, Homo sapiens
atgtcctaggaatttggtattgg

SEQ ID NO: 7892 - DNA, 23 bp, Homo sapiens
tgctttgatccacttatctatgg

SEQ ID NO: 7893 - DNA, 23 bp, Homo sapiens
aggtcgctacagaagatgtttgg

SEQ ID NO: 7894 - DNA, 23 bp, Homo sapiens
cggataccatggtcctagagggg

SEQ ID NO: 7895 - DNA, 23 bp, Homo sapiens
ccgggctgacgagaatgatgagg

SEQ ID NO: 7896 - DNA, 23 bp, Homo sapiens
gtccacagcagtcactctcccgg

SEQ ID NO: 7897 - DNA, 23 bp, Homo sapiens
gccagaggccgacggtcagaagg

SEQ ID NO: 7898 - DNA, 23 bp, Homo sapiens
actcagaagataccactgcgagg

SEQ ID NO: 7899 - DNA, 23 bp, Homo sapiens
ttttggaaagagaagatgctcgg

SEQ ID NO: 7900 - DNA, 23 bp, Homo sapiens
ggcttggttcatttgccatatgg

SEQ ID NO: 7901 - DNA, 23 bp, Homo sapiens
tcctgtcatgcaggacacctagg

SEQ ID NO: 7902 - DNA, 23 bp, Homo sapiens
ttacaaagaactttggagggagg

SEQ ID NO: 7903 - DNA, 23 bp, Homo sapiens
cttgtcatgtgctcattagatgg

SEQ ID NO: 7904 - DNA, 23 bp, Homo sapiens
ggagaagatgcaggaacactagg

SEQ ID NO: 7905 - DNA, 23 bp, Homo sapiens
cttgacccgctcttagatgatgg

SEQ ID NO: 7906 - DNA, 23 bp, Homo sapiens
gaagacagaggcatgagcagtgg

SEQ ID NO: 7907 - DNA, 23 bp, Homo sapiens
catgcctctgtcttcataaatgg

SEQ ID NO: 7908 - DNA, 23 bp, Homo sapiens
tcagatctgaatttgagctctgg

SEQ ID NO: 7909 - DNA, 23 bp, Homo sapiens
gggcttggctgccgagaagaagg

SEQ ID NO: 7910 - DNA, 23 bp, Homo sapiens
tgccattcttttgctgggcttgg

SEQ ID NO: 7911 - DNA, 23 bp, Homo sapiens
tgccattgttgtgctgggcttgg

SEQ ID NO: 7912 - DNA, 23 bp, Homo sapiens
tgccattcttgtgctgggcttgg

SEQ ID NO: 7913 - DNA, 23 bp, Homo sapiens
tgccattattttgttgggcttgg

SEQ ID NO: 7914 - DNA, 23 bp, Homo sapiens
ctgctcattctgtgttttacggg

SEQ ID NO: 7915 - DNA, 23 bp, Homo sapiens
atcgaagagctgaaatgtagcgg

SEQ ID NO: 7916 - DNA, 23 bp, Homo sapiens
tacttgatcagcgtgaaaagcgg

SEQ ID NO: 7917 - DNA, 23 bp, Homo sapiens
tcaccccgagcagagttacttgg

SEQ ID NO: 7918 - DNA, 23 bp, Homo sapiens
agaaatgatctgggctgtgctgg

SEQ ID NO: 7919 - DNA, 23 bp, Homo sapiens
acttcaaggcactagctcgatgg

SEQ ID NO: 7920 - DNA, 23 bp, Homo sapiens
agttggagaaagcaacaatatgg

SEQ ID NO: 7921 - DNA, 23 bp, Homo sapiens
cctgcttgcttgctgcactatgg

SEQ ID NO: 7922 - DNA, 23 bp, Homo sapiens
ccttctgtctgaagaggagctgg

SEQ ID NO: 7923 - DNA, 23 bp, Homo sapiens
tcgatggaccatctgcaaaacgg

SEQ ID NO: 7924 - DNA, 23 bp, Homo sapiens
agtgaaactccgctagatgacgg

SEQ ID NO: 7925 - DNA, 23 bp, Homo sapiens
aagaataccagaacttcatgtgg

SEQ ID NO: 7926 - DNA, 23 bp, Homo sapiens
tattcatacgctcggtgagttgg

SEQ ID NO: 7927 - DNA, 23 bp, Homo sapiens
cagcccagggtgttattctgtgg

SEQ ID NO: 7928 - DNA, 23 bp, Homo sapiens
ttaaggtgactcagaagcattgg

SEQ ID NO: 7929 - DNA, 23 bp, Homo sapiens
ccctgaagatgtcccatcaatgg

SEQ ID NO: 7930 - DNA, 23 bp, Homo sapiens
actttggaggaaggtctgcaggg

SEQ ID NO: 7931 - DNA, 23 bp, Homo sapiens
agttactaaactgttggatgagg

SEQ ID NO: 7932 - DNA, 23 bp, Homo sapiens
gagcgtggctggctcatgtcagg

SEQ ID NO: 7933 - DNA, 23 bp, Homo sapiens
tcaggcttggatttgaactctgg

SEQ ID NO: 7934 - DNA, 23 bp, Homo sapiens
gacgggtggtgtttcttcactgg

SEQ ID NO: 7935 - DNA, 23 bp, Homo sapiens
ctcagagatgtgtcttccaaagg

SEQ ID NO: 7936 - DNA, 23 bp, Homo sapiens
ctcgcaccagggacattacttgg

SEQ ID NO: 7937 - DNA, 23 bp, Homo sapiens
cccaaacctcccaccctcagagg

SEQ ID NO: 7938 - DNA, 23 bp, Homo sapiens
gccggaaccgacgagtcctgagg

SEQ ID NO: 7939 - DNA, 23 bp, Homo sapiens
gctctcagaacagccaagccagg

SEQ ID NO: 7940 - DNA, 23 bp, Homo sapiens
ttttcccattggtttacccaagg

SEQ ID NO: 7941 - DNA, 23 bp, Homo sapiens
caacgtgctatgatcaaatcagg

SEQ ID NO: 7942 - DNA, 23 bp, Homo sapiens
ctgggggcctggctcaatccagg

SEQ ID NO: 7943 - DNA, 23 bp, Homo sapiens
ctctgctgctggcctgtcactgg

SEQ ID NO: 7944 - DNA, 23 bp, Homo sapiens
ttttctggaatgtgctcttctgg

SEQ ID NO: 7945 - DNA, 23 bp, Homo sapiens
accagattttcacacggcaaagg

SEQ ID NO: 7946 - DNA, 23 bp, Homo sapiens
tctgagttttgtggtgctgtagg

SEQ ID NO: 7947 - DNA, 23 bp, Homo sapiens
tttaccaaagtcagaactcgagg

SEQ ID NO: 7948 - DNA, 23 bp, Homo sapiens
ctggaccttcagagacctagggg

SEQ ID NO: 7949 - DNA, 23 bp, Homo sapiens
tctagctacaaatgaactgccgg

SEQ ID NO: 7950 - DNA, 23 bp, Homo sapiens
caatggatctctcagctaagagg

SEQ ID NO: 7951 - DNA, 23 bp, Homo sapiens
gctggaggcaggctcaggagcgg

SEQ ID NO: 7952 - DNA, 23 bp, Homo sapiens
tgaaaagtcttccactaagaagg

SEQ ID NO: 7953 - DNA, 23 bp, Homo sapiens
tagtcatgatctgcagaagttgg

SEQ ID NO: 7954 - DNA, 23 bp, Homo sapiens
ggtttataggggaatctcactgg

SEQ ID NO: 7955 - DNA, 23 bp, Homo sapiens
tcttctttgcttttcttaggcgg

SEQ ID NO: 7956 - DNA, 23 bp, Homo sapiens
catgtccattgctggatgaatgg

SEQ ID NO: 7957 - DNA, 23 bp, Homo sapiens
cctgctctctagctgtatccagg

SEQ ID NO: 7958 - DNA, 23 bp, Homo sapiens
gctcaaagaggtgagttctgagg

SEQ ID NO: 7959 - DNA, 23 bp, Homo sapiens
ggagtgactcatggagaatatgg

SEQ ID NO: 7960 - DNA, 23 bp, Homo sapiens
tgcagctaattcctctttgtagg

SEQ ID NO: 7961 - DNA, 23 bp, Homo sapiens
tgcagtcttgttcatcacactgg

SEQ ID NO: 7962 - DNA, 23 bp, Homo sapiens
ttgagcatgtaccgtgtgccagg

SEQ ID NO: 7963 - DNA, 23 bp, Homo sapiens
ccctcattgcctgactgaccggg

SEQ ID NO: 7964 - DNA, 23 bp, Homo sapiens
gagagcagagcatgcagtgatgg

SEQ ID NO: 7965 - DNA, 23 bp, Homo sapiens
cccagccatggcacgtgagttgg

SEQ ID NO: 7966 - DNA, 23 bp, Homo sapiens
tcgacctggacttgaactaaagg

SEQ ID NO: 7967 - DNA, 23 bp, Homo sapiens
cagatgacgacgatgtgtgaagg

SEQ ID NO: 7968 - DNA, 23 bp, Homo sapiens
agatgacgatgcctggaagtagg

SEQ ID NO: 7969 - DNA, 23 bp, Homo sapiens
cttggggcagttaccgccaccgg

SEQ ID NO: 7970 - DNA, 23 bp, Homo sapiens
ctgcttggacctcgataacgggg

SEQ ID NO: 7971 - DNA, 23 bp, Homo sapiens
caccaggcagtcagtgcaccagg

SEQ ID NO: 7972 - DNA, 23 bp, Homo sapiens
tcctggttatgcagagagagtgg

SEQ ID NO: 7973 - DNA, 23 bp, Homo sapiens
agagttcagttaccaaatcccgg

SEQ ID NO: 7974 - DNA, 23 bp, Homo sapiens
tgcacagtctctgcagtgccagg

SEQ ID NO: 7975 - DNA, 23 bp, Homo sapiens
tgccaacggcattgataacgtgg

SEQ ID NO: 7976 - DNA, 23 bp, Homo sapiens
catccagaacatatgtgagtggg

SEQ ID NO: 7977 - DNA, 23 bp, Homo sapiens
cactttatgtatgctctggatgg

SEQ ID NO: 7978 - DNA, 23 bp, Homo sapiens
ccagtggaccgtagttgtggagg

SEQ ID NO: 7979 - DNA, 23 bp, Homo sapiens
tgcggccaaggctgtctacacgg

SEQ ID NO: 7980 - DNA, 23 bp, Homo sapiens
ggatgggctagtagcgagagagg

SEQ ID NO: 7981 - DNA, 23 bp, Homo sapiens
gagcagctagcggcctcagatgg

SEQ ID NO: 7982 - DNA, 23 bp, Homo sapiens
tggtcattggacggctatgatgg

SEQ ID NO: 7983 - DNA, 23 bp, Homo sapiens
gcagatgagcacgagtttattgg

SEQ ID NO: 7984 - DNA, 23 bp, Homo sapiens
ccatcaccaagacggtggagggg

SEQ ID NO: 7985 - DNA, 23 bp, Homo sapiens
ggccgtgggtcagggtctcctgg

SEQ ID NO: 7986 - DNA, 23 bp, Homo sapiens
cagtcatcatctgtgtcactagg

SEQ ID NO: 7987 - DNA, 23 bp, Homo sapiens
gaaatcttcaatctgagccaagg

SEQ ID NO: 7988 - DNA, 23 bp, Homo sapiens
gtatgcattgagccgctctttgg

SEQ ID NO: 7989 - DNA, 23 bp, Homo sapiens
gttgttcttttgaccgagactgg

SEQ ID NO: 7990 - DNA, 23 bp, Homo sapiens
tagccatcatgtagatcagcagg

SEQ ID NO: 7991 - DNA, 23 bp, Homo sapiens
aagaatcgatggcacaatactgg

SEQ ID NO: 7992 - DNA, 23 bp, Homo sapiens
accttgttgctacagctgcatgg

SEQ ID NO: 7993 - DNA, 23 bp, Homo sapiens
agtaaactcttcattcatcctgg

SEQ ID NO: 7994 - DNA, 23 bp, Homo sapiens
tgagtagcggatccttttcctgg

SEQ ID NO: 7995 - DNA, 23 bp, Homo sapiens
taacttattgagctgtttccagg

SEQ ID NO: 7996 - DNA, 23 bp, Homo sapiens
aggaaaagtagcagaatcgtagg

SEQ ID NO: 7997 - DNA, 23 bp, Homo sapiens
ggaagaagaagacttggaaatgg

SEQ ID NO: 7998 - DNA, 23 bp, Homo sapiens
tcagggtcggctctgtcacacgg

SEQ ID NO: 7999 - DNA, 23 bp, Homo sapiens
caacaaaacagccagcgggcggg

SEQ ID NO: 8000 - DNA, 23 bp, Homo sapiens
tcagagtttgatggctaagacgg

SEQ ID NO: 8001 - DNA, 23 bp, Homo sapiens
gcaagggtgctacacatcactgg

SEQ ID NO: 8002 - DNA, 23 bp, Homo sapiens
tgccacacagtgggctcagcagg

SEQ ID NO: 8003 - DNA, 23 bp, Homo sapiens
ggggataccagcctctaagacgg

SEQ ID NO: 8004 - DNA, 23 bp, Homo sapiens
cttgtgccgtccccctaggatgg

SEQ ID NO: 8005 - DNA, 23 bp, Homo sapiens
tggtgccatcgggcgtgagccgg

SEQ ID NO: 8006 - DNA, 23 bp, Homo sapiens
agggagggggatcacgtctgtgg

SEQ ID NO: 8007 - DNA, 23 bp, Homo sapiens
ctgttaactgatgctacccaagg

SEQ ID NO: 8008 - DNA, 23 bp, Homo sapiens
tggtgatgctgtcagttttgtgg

SEQ ID NO: 8009 - DNA, 23 bp, Homo sapiens
tgccacacctatggaatcacggg

SEQ ID NO: 8010 - DNA, 23 bp, Homo sapiens
atactgtagtttgtggctaacgg

SEQ ID NO: 8011 - DNA, 23 bp, Homo sapiens
gcctccgggactccccacagggg

SEQ ID NO: 8012 - DNA, 23 bp, Homo sapiens
acccatggagacctatgaagggg

SEQ ID NO: 8013 - DNA, 23 bp, Homo sapiens
gcagcaggtgctggcgtaggcgg

SEQ ID NO: 8014 - DNA, 23 bp, Homo sapiens
gactcaagaactctaggaaatgg

SEQ ID NO: 8015 - DNA, 23 bp, Homo sapiens
agaaagcaagggtagttagtggg

SEQ ID NO: 8016 - DNA, 23 bp, Homo sapiens
gaggtctgtgtcactctaaaggg

SEQ ID NO: 8017 - DNA, 23 bp, Homo sapiens
ctgaccaccaagcacctagaagg

SEQ ID NO: 8018 - DNA, 23 bp, Homo sapiens
gaagatcaagagacaggggaagg

SEQ ID NO: 8019 - DNA, 23 bp, Homo sapiens
cgggcgcaggccccacgtgaggg

SEQ ID NO: 8020 - DNA, 23 bp, Homo sapiens
ctcgctgggctccgcgtcctagg

SEQ ID NO: 8021 - DNA, 23 bp, Homo sapiens
ccctgcataatttaggtcttagg

SEQ ID NO: 8022 - DNA, 23 bp, Homo sapiens
tgttgcttttcacaccagcgtgg

SEQ ID NO: 8023 - DNA, 23 bp, Homo sapiens
caggtgcttggaagttcccctgg

SEQ ID NO: 8024 - DNA, 23 bp, Homo sapiens
gcctaggaaagaagagatctggg

SEQ ID NO: 8025 - DNA, 23 bp, Homo sapiens
ctttggatccatttgtcaactgg

SEQ ID NO: 8026 - DNA, 23 bp, Homo sapiens
tagctgccgagcagagatgaggg

SEQ ID NO: 8027 - DNA, 23 bp, Homo sapiens
gcaggcctgcttgggctcacagg

SEQ ID NO: 8028 - DNA, 23 bp, Homo sapiens
gccaagtcagagctgtgagcggg

SEQ ID NO: 8029 - DNA, 23 bp, Homo sapiens
tgcctcacctaaagagaccaagg

SEQ ID NO: 8030 - DNA, 23 bp, Homo sapiens
cctgcttcacatgacacagtagg

SEQ ID NO: 8031 - DNA, 23 bp, Homo sapiens
ttagcataattcaggtgtcatgg

SEQ ID NO: 8032 - DNA, 23 bp, Homo sapiens
ccaaaggtggattcctagcaagg

SEQ ID NO: 8033 - DNA, 23 bp, Homo sapiens
cactgtctatccttgggattggg

SEQ ID NO: 8034 - DNA, 23 bp, Homo sapiens
gtttccgatctggtagtctacgg

SEQ ID NO: 8035 - DNA, 23 bp, Homo sapiens
ctaccactgaccatatcatctgg

SEQ ID NO: 8036 - DNA, 23 bp, Homo sapiens
agtctggcctctacctcagctgg

SEQ ID NO: 8037 - DNA, 23 bp, Homo sapiens
tcactttccatttgaagacttgg

SEQ ID NO: 8038 - DNA, 23 bp, Homo sapiens
ccaaggaaaaaaagcttgcttgg

SEQ ID NO: 8039 - DNA, 23 bp, Homo sapiens
gagccctgctgactaagcctcgg

SEQ ID NO: 8040 - DNA, 23 bp, Homo sapiens
aatggatgtcatatctgaagtgg

SEQ ID NO: 8041 - DNA, 23 bp, Homo sapiens
ctctagtctgtgacaacctgagg

SEQ ID NO: 8042 - DNA, 23 bp, Homo sapiens
agcggcccggggcagctaccagg

SEQ ID NO: 8043 - DNA, 23 bp, Homo sapiens
ttctgccggtgtctgagtgaagg

SEQ ID NO: 8044 - DNA, 23 bp, Homo sapiens
tgaaaggcattggtttatgaggg

SEQ ID NO: 8045 - DNA, 23 bp, Homo sapiens
aagactcagctagacatcactgg

SEQ ID NO: 8046 - DNA, 23 bp, Homo sapiens
gagtctctggggttgaaatctgg

SEQ ID NO: 8047 - DNA, 23 bp, Homo sapiens
gcaacgccccccgggaatgatgg

SEQ ID NO: 8048 - DNA, 23 bp, Homo sapiens
tgttggggagaatttcaaaaagg

SEQ ID NO: 8049 - DNA, 23 bp, Homo sapiens
ctccctgcatgatacatctgtgg

SEQ ID NO: 8050 - DNA, 23 bp, Homo sapiens
gtgcgtgaccctcgcctaagagg

SEQ ID NO: 8051 - DNA, 23 bp, Homo sapiens
ctgtcggaactcattgctgaagg

SEQ ID NO: 8052 - DNA, 23 bp, Homo sapiens
cccctactggggcctcagcaagg

SEQ ID NO: 8053 - DNA, 23 bp, Homo sapiens
tgctgcagagaatggttttcagg

SEQ ID NO: 8054 - DNA, 23 bp, Homo sapiens
ccactcggggttcattgtgctgg

SEQ ID NO: 8055 - DNA, 23 bp, Homo sapiens
ggtggcctgtgctgaaaactagg

SEQ ID NO: 8056 - DNA, 23 bp, Homo sapiens
aaaccagtctgcggtttaggggg

SEQ ID NO: 8057 - DNA, 23 bp, Homo sapiens
tgaagatgatcctgatgaaatgg

SEQ ID NO: 8058 - DNA, 23 bp, Homo sapiens
actatgtagctctcttcaaatgg

SEQ ID NO: 8059 - DNA, 23 bp, Homo sapiens
ccacgatctcccggggctaacgg

SEQ ID NO: 8060 - DNA, 23 bp, Homo sapiens
gtctcccagcgaggtctgaaggg

SEQ ID NO: 8061 - DNA, 23 bp, Homo sapiens
accccggctggagtcatgatggg

SEQ ID NO: 8062 - DNA, 23 bp, Homo sapiens
gagagttctctctcctgagcagg

SEQ ID NO: 8063 - DNA, 23 bp, Homo sapiens
gtgtggggaacatcggacggtgg

SEQ ID NO: 8064 - DNA, 23 bp, Homo sapiens
aacatccttggttctactcaagg

SEQ ID NO: 8065 - DNA, 23 bp, Homo sapiens
acgggcaggttggcctagcctgg

SEQ ID NO: 8066 - DNA, 23 bp, Homo sapiens
atagcctccatgactttaaacgg

SEQ ID NO: 8067 - DNA, 23 bp, Homo sapiens
gcctgcagcagacacactgaggg

SEQ ID NO: 8068 - DNA, 23 bp, Homo sapiens
tcagcacatatgcaatcatatgg

SEQ ID NO: 8069 - DNA, 23 bp, Homo sapiens
cttctaactcatcgtcacaatgg

SEQ ID NO: 8070 - DNA, 23 bp, Homo sapiens
gactagggtcacagttctaatgg

SEQ ID NO: 8071 - DNA, 23 bp, Homo sapiens
ctccctcatataacacagtaagg

SEQ ID NO: 8072 - DNA, 23 bp, Homo sapiens
actgcaaagtgtgagaagatcgg

SEQ ID NO: 8073 - DNA, 23 bp, Homo sapiens
cccggctaggttaccagtgctgg

SEQ ID NO: 8074 - DNA, 23 bp, Homo sapiens
acaggcaccagagaagcaaatgg

SEQ ID NO: 8075 - DNA, 23 bp, Homo sapiens
taattttcttggtccccttcagg

SEQ ID NO: 8076 - DNA, 23 bp, Homo sapiens
taactttgttgtcccacctcagg

SEQ ID NO: 8077 - DNA, 23 bp, Homo sapiens
tcatagtctttgtaagggctcgg

SEQ ID NO: 8078 - DNA, 23 bp, Homo sapiens
gtcacacaggaagacacctttgg

SEQ ID NO: 8079 - DNA, 23 bp, Homo sapiens
ctttagaaacccctacgtgtggg

SEQ ID NO: 8080 - DNA, 23 bp, Homo sapiens
agcccccagcaagatgcaggagg

SEQ ID NO: 8081 - DNA, 23 bp, Homo sapiens
agcatttgcacacatatgcaggg

SEQ ID NO: 8082 - DNA, 23 bp, Homo sapiens
ctgctcgcgggcgggacccacgg

SEQ ID NO: 8083 - DNA, 23 bp, Homo sapiens
aagggccacagctcctcactcgg

SEQ ID NO: 8084 - DNA, 23 bp, Homo sapiens
ttcaatctaacacagaagacggg

SEQ ID NO: 8085 - DNA, 23 bp, Homo sapiens
gatgagcaccaacatgtgagggg

SEQ ID NO: 8086 - DNA, 23 bp, Homo sapiens
tataatctgatggtcacttgtgg

SEQ ID NO: 8087 - DNA, 23 bp, Homo sapiens
agatgggccccaggggcctgagg

SEQ ID NO: 8088 - DNA, 23 bp, Homo sapiens
tcagggacagcacaggcctgagg

SEQ ID NO: 8089 - DNA, 23 bp, Homo sapiens
tgccagcctggtgcgagctaagg

SEQ ID NO: 8090 - DNA, 23 bp, Homo sapiens
agacactgactttgggctaaagg

SEQ ID NO: 8091 - DNA, 23 bp, Homo sapiens
gttggggctcaagtctcagcagg

SEQ ID NO: 8092 - DNA, 23 bp, Homo sapiens
ggggtgctcaggagtactcgagg

SEQ ID NO: 8093 - DNA, 23 bp, Homo sapiens
ttcctggagaagtacgcgtgagg

SEQ ID NO: 8094 - DNA, 23 bp, Homo sapiens
caagggcccagctgtgcctaggg

SEQ ID NO: 8095 - DNA, 23 bp, Homo sapiens
caggaacttctcaaagttccagg

SEQ ID NO: 8096 - DNA, 23 bp, Homo sapiens
ttgagcagttcacatctatatgg

SEQ ID NO: 8097 - DNA, 23 bp, Homo sapiens
ttactaatatttggaggcagtgg

SEQ ID NO: 8098 - DNA, 23 bp, Homo sapiens
ccttccaccggcactcatgacgg

SEQ ID NO: 8099 - DNA, 23 bp, Homo sapiens
ttacttcggtcttgcctcactgg

SEQ ID NO: 8100 - DNA, 23 bp, Homo sapiens
cgacgggcacatggttaacctgg

SEQ ID NO: 8101 - DNA, 23 bp, Homo sapiens
cttaactccaccttcctatttgg

SEQ ID NO: 8102 - DNA, 23 bp, Homo sapiens
tttgagaaaggggatgtgaatgg

SEQ ID NO: 8103 - DNA, 23 bp, Homo sapiens
ctgagctgccaagcctcaatagg

SEQ ID NO: 8104 - DNA, 23 bp, Homo sapiens
ataagtcttctcgcttcagtagg

SEQ ID NO: 8105 - DNA, 23 bp, Homo sapiens
aacttcacaacttgaccctcagg

SEQ ID NO: 8106 - DNA, 23 bp, Homo sapiens
caggcctgacatagcagctctgg

SEQ ID NO: 8107 - DNA, 23 bp, Homo sapiens
cccgatgacagcttttcctgagg

SEQ ID NO: 8108 - DNA, 23 bp, Homo sapiens
aggaatcgctatcattgacaagg

SEQ ID NO: 8109 - DNA, 23 bp, Homo sapiens
caagcatcactatggagtctcgg

SEQ ID NO: 8110 - DNA, 23 bp, Homo sapiens
atgacccagtccctgggcacagg

SEQ ID NO: 8111 - DNA, 23 bp, Homo sapiens
ttacagaagttgcttgagaatgg

SEQ ID NO: 8112 - DNA, 23 bp, Homo sapiens
ctcagcggcagcgtctggcgggg

SEQ ID NO: 8113 - DNA, 23 bp, Homo sapiens
gacggccttggactgaacgtggg

SEQ ID NO: 8114 - DNA, 23 bp, Homo sapiens
tcggccgccgggctgctcacagg

SEQ ID NO: 8115 - DNA, 23 bp, Homo sapiens
ctgtcccctgaagagtttatcgg

SEQ ID NO: 8116 - DNA, 23 bp, Homo sapiens
caaaatcacacagcagattgggg

SEQ ID NO: 8117 - DNA, 23 bp, Homo sapiens
aggaggagagccagctgtagggg

SEQ ID NO: 8118 - DNA, 23 bp, Homo sapiens
agaggacatctgcggtcataagg

SEQ ID NO: 8119 - DNA, 23 bp, Homo sapiens
tacagatctaatacagctggtgg

SEQ ID NO: 8120 - DNA, 23 bp, Homo sapiens
ttcttgactcttagacgttccgg

SEQ ID NO: 8121 - DNA, 23 bp, Homo sapiens
acgcgggtggccctctgaccagg

SEQ ID NO: 8122 - DNA, 23 bp, Homo sapiens
gataatgcttcactttctgcagg

SEQ ID NO: 8123 - DNA, 23 bp, Homo sapiens
ctgacgggacgacacatctgagg

SEQ ID NO: 8124 - DNA, 23 bp, Homo sapiens
aattgtctggtttatacgtccgg

SEQ ID NO: 8125 - DNA, 23 bp, Homo sapiens
atcgccccggagcttatgagagg

SEQ ID NO: 8126 - DNA, 23 bp, Homo sapiens
aagcctctctactttcttactgg

SEQ ID NO: 8127 - DNA, 23 bp, Homo sapiens
tcgttgcatatccatcgatttgg

SEQ ID NO: 8128 - DNA, 23 bp, Homo sapiens
gtccgtgaacctgagcgactcgg

SEQ ID NO: 8129 - DNA, 23 bp, Homo sapiens
tcaccctgacggagatctaaagg

SEQ ID NO: 8130 - DNA, 23 bp, Homo sapiens
gggcttcaaggtcacgctcatgg

SEQ ID NO: 8131 - DNA, 23 bp, Homo sapiens
cctgcacttcactgtaaactcgg

SEQ ID NO: 8132 - DNA, 23 bp, Homo sapiens
atcatccttaaggagctgtaagg

SEQ ID NO: 8133 - DNA, 23 bp, Homo sapiens
ggctacagcttgagttcactagg

SEQ ID NO: 8134 - DNA, 23 bp, Homo sapiens
gggagccacgggattgtaactgg

SEQ ID NO: 8135 - DNA, 23 bp, Homo sapiens
aaggaaggttacaacgtatatgg

SEQ ID NO: 8136 - DNA, 23 bp, Homo sapiens
aactgggcctattgtatctgggg

SEQ ID NO: 8137 - DNA, 23 bp, Homo sapiens
acagagagtgttaagatctaggg

SEQ ID NO: 8138 - DNA, 23 bp, Homo sapiens
agagaaggttacaacgtatatgg

SEQ ID NO: 8139 - DNA, 23 bp, Homo sapiens
aggattggctgtcattgcatcgg

SEQ ID NO: 8140 - DNA, 23 bp, Homo sapiens
tgctattgagaacagaacagtgg

SEQ ID NO: 8141 - DNA, 23 bp, Homo sapiens
gggcaggcggcgcagtcagatgg

SEQ ID NO: 8142 - DNA, 23 bp, Homo sapiens
tttgtttgatgctcatatggagg

SEQ ID NO: 8143 - DNA, 23 bp, Homo sapiens
gcggtgtggccactgtcaccagg

SEQ ID NO: 8144 - DNA, 23 bp, Homo sapiens
ccaagaggggcctgagctggggg

SEQ ID NO: 8145 - DNA, 23 bp, Homo sapiens
aactcagagaaaagagactgtgg

SEQ ID NO: 8146 - DNA, 23 bp, Homo sapiens
caaagaggaaggaactgaaaagg

SEQ ID NO: 8147 - DNA, 23 bp, Homo sapiens
tgattacacagtatgaactgagg

SEQ ID NO: 8148 - DNA, 23 bp, Homo sapiens
attactaaacagtgtctggatgg

SEQ ID NO: 8149 - DNA, 23 bp, Homo sapiens
ggcctcccagctttatgccatgg

SEQ ID NO: 8150 - DNA, 23 bp, Homo sapiens
tgatgacaacactgtagaaatgg

SEQ ID NO: 8151 - DNA, 23 bp, Homo sapiens
cccaccccagctgtgcctagggg

SEQ ID NO: 8152 - DNA, 23 bp, Homo sapiens
ctgtggcctccgggactactcgg

SEQ ID NO: 8153 - DNA, 23 bp, Homo sapiens
ctggacaaagctacccaaagagg

SEQ ID NO: 8154 - DNA, 23 bp, Homo sapiens
gagaccgggaatttcagacatgg

SEQ ID NO: 8155 - DNA, 23 bp, Homo sapiens
cgccggcccccgggagctggcgg

SEQ ID NO: 8156 - DNA, 23 bp, Homo sapiens
agtctcagctctccctatgacgg

SEQ ID NO: 8157 - DNA, 23 bp, Homo sapiens
tcggtcagcaccgtggtgtgagg

SEQ ID NO: 8158 - DNA, 23 bp, Homo sapiens
gatagctgtcattcaccgcctgg

SEQ ID NO: 8159 - DNA, 23 bp, Homo sapiens
gtacacgcgtctattgctgcagg

SEQ ID NO: 8160 - DNA, 23 bp, Homo sapiens
ctcataaacatgcccattgctgg

SEQ ID NO: 8161 - DNA, 23 bp, Homo sapiens
cacacaggccaaagttttaaggg

SEQ ID NO: 8162 - DNA, 23 bp, Homo sapiens
tcacacttctgactccagactgg

SEQ ID NO: 8163 - DNA, 23 bp, Homo sapiens
ctcgagtccgaggtatgacgcgg

SEQ ID NO: 8164 - DNA, 23 bp, Homo sapiens
aagtcggacttgtgagtcctagg

SEQ ID NO: 8165 - DNA, 23 bp, Homo sapiens
ccggggagccaggaatgaggcgg

SEQ ID NO: 8166 - DNA, 23 bp, Homo sapiens
gctggagctcggctactccttgg

SEQ ID NO: 8167 - DNA, 23 bp, Homo sapiens
gcctagccacggtggtaatttgg

SEQ ID NO: 8168 - DNA, 23 bp, Homo sapiens
catgctgacttcagagcatccgg

SEQ ID NO: 8169 - DNA, 23 bp, Homo sapiens
gcagcctgcaggtctttagctgg

SEQ ID NO: 8170 - DNA, 23 bp, Homo sapiens
agggatgtgtctggtttcctagg

SEQ ID NO: 8171 - DNA, 23 bp, Homo sapiens
aaggcgggtgggcgggtcagagg

SEQ ID NO: 8172 - DNA, 23 bp, Homo sapiens
tccctgtttctgggtgctagagg

SEQ ID NO: 8173 - DNA, 23 bp, Homo sapiens
ccggggtgctcagcattgcttgg

SEQ ID NO: 8174 - DNA, 23 bp, Homo sapiens
gagccgaaactagctgcttccgg

SEQ ID NO: 8175 - DNA, 23 bp, Homo sapiens
agagactcttcagtcgccaaagg

SEQ ID NO: 8176 - DNA, 23 bp, Homo sapiens
aggcccccaccagcagttggcgg

SEQ ID NO: 8177 - DNA, 23 bp, Homo sapiens
ggcctcgggctgggggctagagg

SEQ ID NO: 8178 - DNA, 23 bp, Homo sapiens
taacaaacacacgccagacttgg

SEQ ID NO: 8179 - DNA, 23 bp, Homo sapiens
agctcttccaccctgtaaggggg

SEQ ID NO: 8180 - DNA, 23 bp, Homo sapiens
caaagctgcacatgtgccgacgg

SEQ ID NO: 8181 - DNA, 23 bp, Homo sapiens
gcacgtgaagaccaatgagacgg

SEQ ID NO: 8182 - DNA, 23 bp, Homo sapiens
ttgcaatggccgtgaggtggtgg

SEQ ID NO: 8183 - DNA, 23 bp, Homo sapiens
aattcacaatcacagagatgagg

SEQ ID NO: 8184 - DNA, 23 bp, Homo sapiens
catggactcgctagattgcatgg

SEQ ID NO: 8185 - DNA, 23 bp, Homo sapiens
cagggacattcacaacgacgagg

SEQ ID NO: 8186 - DNA, 23 bp, Homo sapiens
gcagaggcccacaagtagcaggg

SEQ ID NO: 8187 - DNA, 23 bp, Homo sapiens
atggaacaggttagataaccagg

SEQ ID NO: 8188 - DNA, 23 bp, Homo sapiens
gcagtcaaaagctatactgttgg

SEQ ID NO: 8189 - DNA, 23 bp, Homo sapiens
aaatgacagaccaaatggcgagg

SEQ ID NO: 8190 - DNA, 23 bp, Homo sapiens
agtttccgatggtcaagagcggg

SEQ ID NO: 8191 - DNA, 23 bp, Homo sapiens
ccttgagacagctgctgtgaggg

SEQ ID NO: 8192 - DNA, 23 bp, Homo sapiens
attatcattgctggttcagctgg

SEQ ID NO: 8193 - DNA, 23 bp, Homo sapiens
gaggccatcattatcattgctgg

SEQ ID NO: 8194 - DNA, 23 bp, Homo sapiens
cgccctggtgggggtggtgaagg

SEQ ID NO: 8195 - DNA, 23 bp, Homo sapiens
tctcagagaagactgtgaagagg

SEQ ID NO: 8196 - DNA, 23 bp, Homo sapiens
atggaaacatctgtcacgagcgg

SEQ ID NO: 8197 - DNA, 23 bp, Homo sapiens
ttcctgaattcatgtccaaaagg

SEQ ID NO: 8198 - DNA, 23 bp, Homo sapiens
agttggtccagtgtcaactctgg

SEQ ID NO: 8199 - DNA, 23 bp, Homo sapiens
gacgggcaccagtgggcataggg

SEQ ID NO: 8200 - DNA, 23 bp, Homo sapiens
gggcccggctgctggcacagggg

SEQ ID NO: 8201 - DNA, 23 bp, Homo sapiens
ttccgcaccatcagcgtctgagg

SEQ ID NO: 8202 - DNA, 23 bp, Homo sapiens
taagaactgtgctggttaattgg

SEQ ID NO: 8203 - DNA, 23 bp, Homo sapiens
tattgattgcaaatctggcaagg

SEQ ID NO: 8204 - DNA, 23 bp, Homo sapiens
tgtggatgcagaatttgtagagg

SEQ ID NO: 8205 - DNA, 23 bp, Homo sapiens
aaacacaccgcgatgcttttagg

SEQ ID NO: 8206 - DNA, 23 bp, Homo sapiens
atttggactcggacagctgacgg

SEQ ID NO: 8207 - DNA, 23 bp, Homo sapiens
gcgtcaagaagtccccgaagggg

SEQ ID NO: 8208 - DNA, 23 bp, Homo sapiens
gacgtaaaaggcaaattaggagg

SEQ ID NO: 8209 - DNA, 23 bp, Homo sapiens
ttgtagttaggaagagacagagg

SEQ ID NO: 8210 - DNA, 23 bp, Homo sapiens
gttgctgcagcagctggctgagg

SEQ ID NO: 8211 - DNA, 23 bp, Homo sapiens
catgcccgggcacaggctagtgg

SEQ ID NO: 8212 - DNA, 23 bp, Homo sapiens
gtgcaagggaaaccgtcacctgg

SEQ ID NO: 8213 - DNA, 23 bp, Homo sapiens
cacgtacaccaggatggtgctgg

SEQ ID NO: 8214 - DNA, 23 bp, Homo sapiens
tgtagaggaagagcagtgttagg

SEQ ID NO: 8215 - DNA, 23 bp, Homo sapiens
gtgctgggtcttggggcactggg

SEQ ID NO: 8216 - DNA, 23 bp, Homo sapiens
tgaatagatggatgcacagctgg

SEQ ID NO: 8217 - DNA, 23 bp, Homo sapiens
tagcatatggacaccttgcctgg

SEQ ID NO: 8218 - DNA, 23 bp, Homo sapiens
tgcttggtggggccctcaggagg

SEQ ID NO: 8219 - DNA, 23 bp, Homo sapiens
gctgctcgggactgttcaggtgg

SEQ ID NO: 8220 - DNA, 23 bp, Homo sapiens
ctggaagctttgaaaagagatgg

SEQ ID NO: 8221 - DNA, 23 bp, Homo sapiens
gctgagctggctgcctgaggagg

SEQ ID NO: 8222 - DNA, 23 bp, Homo sapiens
gagggtaagaccattgcaattgg

SEQ ID NO: 8223 - DNA, 23 bp, Homo sapiens
aaaattgcttagtccttctctgg

SEQ ID NO: 8224 - DNA, 23 bp, Homo sapiens
ccctacctcttcagaagagctgg

SEQ ID NO: 8225 - DNA, 23 bp, Homo sapiens
acaacccataccctgtgtgaggg

SEQ ID NO: 8226 - DNA, 23 bp, Homo sapiens
aagaagcaaggaagattttcagg

SEQ ID NO: 8227 - DNA, 23 bp, Homo sapiens
aaagatttctcatccatgggagg

SEQ ID NO: 8228 - DNA, 23 bp, Homo sapiens
aagaagccagaaagattttcagg

SEQ ID NO: 8229 - DNA, 23 bp, Homo sapiens
gaaccgtctacaacatctttagg

SEQ ID NO: 8230 - DNA, 23 bp, Homo sapiens
tttttgggagagcagctctctgg

SEQ ID NO: 8231 - DNA, 23 bp, Homo sapiens
ctccgggcaatcttaaagtctgg

SEQ ID NO: 8232 - DNA, 23 bp, Homo sapiens
gctgtctggggcaacaagtaggg

SEQ ID NO: 8233 - DNA, 23 bp, Homo sapiens
atcgggagatgaagtccttcagg

SEQ ID NO: 8234 - DNA, 23 bp, Homo sapiens
aacaagcctgtatgctgagcagg

SEQ ID NO: 8235 - DNA, 23 bp, Homo sapiens
tacacaagggtggctgtctgggg

SEQ ID NO: 8236 - DNA, 23 bp, Homo sapiens
tttcctgtggcataatgtgatgg

SEQ ID NO: 8237 - DNA, 23 bp, Homo sapiens
gctacatggaacagcaaataggg

SEQ ID NO: 8238 - DNA, 23 bp, Homo sapiens
tgtgactatgggctctgaagggg

SEQ ID NO: 8239 - DNA, 23 bp, Homo sapiens
accctaatgcctttgactttggg

SEQ ID NO: 8240 - DNA, 23 bp, Homo sapiens
atggcaacgggaaacagtgaggg

SEQ ID NO: 8241 - DNA, 23 bp, Homo sapiens
ccccatcccagacccttcagggg

SEQ ID NO: 8242 - DNA, 23 bp, Homo sapiens
agatacacccactgagctgaggg

SEQ ID NO: 8243 - DNA, 23 bp, Homo sapiens
ggatcttacggtcactccctagg

SEQ ID NO: 8244 - DNA, 23 bp, Homo sapiens
ggaggaggccctccctcataagg

SEQ ID NO: 8245 - DNA, 23 bp, Homo sapiens
acattgtctggcctcacaggtgg

SEQ ID NO: 8246 - DNA, 23 bp, Homo sapiens
atctgtcacaaatcttccctagg

SEQ ID NO: 8247 - DNA, 23 bp, Homo sapiens
ctggtctcttgcagaaattctgg

SEQ ID NO: 8248 - DNA, 23 bp, Homo sapiens
aagccattggagatgcagaatgg

SEQ ID NO: 8249 - DNA, 23 bp, Homo sapiens
gtgaaaattgtagcctgtgatgg

SEQ ID NO: 8250 - DNA, 23 bp, Homo sapiens
gctgcctcaatttatagctgtgg

SEQ ID NO: 8251 - DNA, 23 bp, Homo sapiens
tagggaaagctcactcaaagagg

SEQ ID NO: 8252 - DNA, 23 bp, Homo sapiens
tgacattacttccagcaaatagg

SEQ ID NO: 8253 - DNA, 23 bp, Homo sapiens
tgtcagttttctgtggatgaagg

SEQ ID NO: 8254 - DNA, 23 bp, Homo sapiens
cacttctccctcaaggagtgagg

SEQ ID NO: 8255 - DNA, 23 bp, Homo sapiens
ccagagtacagacactatcaagg

SEQ ID NO: 8256 - DNA, 23 bp, Homo sapiens
ctgatgaagaaaacgtgaggtgg

SEQ ID NO: 8257 - DNA, 23 bp, Homo sapiens
tgctggaatcaaacacctgaagg

SEQ ID NO: 8258 - DNA, 23 bp, Homo sapiens
aaactgaaagtgtctgcctgagg

SEQ ID NO: 8259 - DNA, 23 bp, Homo sapiens
acgtcaagcgcttttggaagcgg

SEQ ID NO: 8260 - DNA, 23 bp, Homo sapiens
gcattcctctcataaagcaaggg

SEQ ID NO: 8261 - DNA, 23 bp, Homo sapiens
ggaagtaccagcagaaggttagg

SEQ ID NO: 8262 - DNA, 23 bp, Homo sapiens
gagggaagaggtctaccacgtgg

SEQ ID NO: 8263 - DNA, 23 bp, Homo sapiens
actgaggtctagtaattaagagg

SEQ ID NO: 8264 - DNA, 23 bp, Homo sapiens
cccaatctcaaaaggatcgcagg

SEQ ID NO: 8265 - DNA, 23 bp, Homo sapiens
tactccacatcgcaacgtgatgg

SEQ ID NO: 8266 - DNA, 23 bp, Homo sapiens
agcagtgcagttcttagccaagg

SEQ ID NO: 8267 - DNA, 23 bp, Homo sapiens
gacgcccacaggggtcctagagg

SEQ ID NO: 8268 - DNA, 23 bp, Homo sapiens
tgtgggccaaggctagggagtgg

SEQ ID NO: 8269 - DNA, 23 bp, Homo sapiens
agatatcacagtgaagttgatgg

SEQ ID NO: 8270 - DNA, 23 bp, Homo sapiens
caaaagcgtttgagccattccgg

SEQ ID NO: 8271 - DNA, 23 bp, Homo sapiens
aagacaggagaatcacagaaagg

SEQ ID NO: 8272 - DNA, 23 bp, Homo sapiens
attctggactacgtgtgacaggg

SEQ ID NO: 8273 - DNA, 23 bp, Homo sapiens
gatataccttctgagacagaagg

SEQ ID NO: 8274 - DNA, 23 bp, Homo sapiens
ggggaaggttcagcagccgctgg

SEQ ID NO: 8275 - DNA, 23 bp, Homo sapiens
tgctgttactacttccaaaatgg

SEQ ID NO: 8276 - DNA, 23 bp, Homo sapiens
aagggttcagaagcccatgttgg

SEQ ID NO: 8277 - DNA, 23 bp, Homo sapiens
cttctgtgtgggcaagtgacggg

SEQ ID NO: 8278 - DNA, 23 bp, Homo sapiens
ggaaagctggtaaaaaggacagg

SEQ ID NO: 8279 - DNA, 23 bp, Homo sapiens
gaagctctttccaggatgaacgg

SEQ ID NO: 8280 - DNA, 23 bp, Homo sapiens
taacaggaagtcttgactaatgg

SEQ ID NO: 8281 - DNA, 23 bp, Homo sapiens
agacatcactaccatctctatgg

SEQ ID NO: 8282 - DNA, 23 bp, Homo sapiens
ttggttcggcttagaacttgagg

SEQ ID NO: 8283 - DNA, 23 bp, Homo sapiens
ctctgccgtatgttctgccatgg

SEQ ID NO: 8284 - DNA, 23 bp, Homo sapiens
cagctggcagtttactgtcctgg

SEQ ID NO: 8285 - DNA, 23 bp, Homo sapiens
agccgggcggtgcactcagccgg

SEQ ID NO: 8286 - DNA, 23 bp, Homo sapiens
cggaaaagtgccatgttctgagg

SEQ ID NO: 8287 - DNA, 23 bp, Homo sapiens
tgacaaggctggtctagggaagg

SEQ ID NO: 8288 - DNA, 23 bp, Homo sapiens
gcctgtaccggatgctagggggg

SEQ ID NO: 8289 - DNA, 23 bp, Homo sapiens
ggtacccagggctatctcagagg

SEQ ID NO: 8290 - DNA, 23 bp, Homo sapiens
ggacatcctctttgtctacttgg

SEQ ID NO: 8291 - DNA, 23 bp, Homo sapiens
tctctccaggctcagtcctgcgg

SEQ ID NO: 8292 - DNA, 23 bp, Homo sapiens
tgatctgtagcaggtctcagagg

SEQ ID NO: 8293 - DNA, 23 bp, Homo sapiens
atgcttccaaaagaaagatgtgg

SEQ ID NO: 8294 - DNA, 23 bp, Homo sapiens
atgtcagcccaacaacttacagg

SEQ ID NO: 8295 - DNA, 23 bp, Homo sapiens
tggttcttttttgcccttcatgg

SEQ ID NO: 8296 - DNA, 23 bp, Homo sapiens
gcagctgaataccacagacaagg

SEQ ID NO: 8297 - DNA, 23 bp, Homo sapiens
gcctcacttctcaagagaactgg

SEQ ID NO: 8298 - DNA, 23 bp, Homo sapiens
ttggtgagaaacaagccataagg

SEQ ID NO: 8299 - DNA, 23 bp, Homo sapiens
cagaagggaaaaaaaagctgagg

SEQ ID NO: 8300 - DNA, 23 bp, Homo sapiens
gctcaaaggaccggcgcctgagg

SEQ ID NO: 8301 - DNA, 23 bp, Homo sapiens
gctgggtcgggggtcaccccagg

SEQ ID NO: 8302 - DNA, 23 bp, Homo sapiens
ccttttgacccatttaactgtgg

SEQ ID NO: 8303 - DNA, 23 bp, Homo sapiens
gtctcgacccgttagacagtagg

SEQ ID NO: 8304 - DNA, 23 bp, Homo sapiens
tcagtcttgctcaagtaaacagg

SEQ ID NO: 8305 - DNA, 23 bp, Homo sapiens
cacatcttccttatcaccacagg

SEQ ID NO: 8306 - DNA, 23 bp, Homo sapiens
accaagaatcacttttcctttgg

SEQ ID NO: 8307 - DNA, 23 bp, Homo sapiens
aaatattcagtgcatctggttgg

SEQ ID NO: 8308 - DNA, 23 bp, Homo sapiens
cagaaacaaggcttgtgaagtgg

SEQ ID NO: 8309 - DNA, 23 bp, Homo sapiens
aaatgcagtgtttctactggagg

SEQ ID NO: 8310 - DNA, 23 bp, Homo sapiens
gaccggttcctgcagtaatccgg

SEQ ID NO: 8311 - DNA, 23 bp, Homo sapiens
cttaaaggcacgtctgtgtcagg

SEQ ID NO: 8312 - DNA, 23 bp, Homo sapiens
tgtgtgatggctggtattattgg

SEQ ID NO: 8313 - DNA, 23 bp, Homo sapiens
gacctccacccccaccataatgg

SEQ ID NO: 8314 - DNA, 23 bp, Homo sapiens
ttcctcctcccagaacacctagg

SEQ ID NO: 8315 - DNA, 23 bp, Homo sapiens
gaggtgatgcttgttgttgttgg

SEQ ID NO: 8316 - DNA, 23 bp, Homo sapiens
cttagttacgctcctcgcccagg

SEQ ID NO: 8317 - DNA, 23 bp, Homo sapiens
catgggaagaaaaagctgcatgg

SEQ ID NO: 8318 - DNA, 23 bp, Homo sapiens
cagctcgctaagctcactgatgg

SEQ ID NO: 8319 - DNA, 23 bp, Homo sapiens
gcttcactctttgagcaacatgg

SEQ ID NO: 8320 - DNA, 23 bp, Homo sapiens
tctcaaagaaacacctcaactgg

SEQ ID NO: 8321 - DNA, 23 bp, Homo sapiens
ctgtagttagtagcgtttcatgg

SEQ ID NO: 8322 - DNA, 23 bp, Homo sapiens
agtctcatgcctgctgttagagg

SEQ ID NO: 8323 - DNA, 23 bp, Homo sapiens
aatttgtatgaggcgggacaagg

SEQ ID NO: 8324 - DNA, 23 bp, Homo sapiens
ccccagggcatcaggccgatcgg

SEQ ID NO: 8325 - DNA, 23 bp, Homo sapiens
gcctcccaggagtactaagaggg

SEQ ID NO: 8326 - DNA, 23 bp, Homo sapiens
gacaacagaagactgtctaaagg

SEQ ID NO: 8327 - DNA, 23 bp, Homo sapiens
acgacgccttcctgggatgaggg

SEQ ID NO: 8328 - DNA, 23 bp, Homo sapiens
catggcaagagggtcaccccagg

SEQ ID NO: 8329 - DNA, 23 bp, Homo sapiens
aaaagtgaaagtggcttctaagg

SEQ ID NO: 8330 - DNA, 23 bp, Homo sapiens
gggctctttcaagacagcgcagg

SEQ ID NO: 8331 - DNA, 23 bp, Homo sapiens
tggagaggtgattgtagaaaagg

SEQ ID NO: 8332 - DNA, 23 bp, Homo sapiens
tgtgttcttcagtatgagaaagg

SEQ ID NO: 8333 - DNA, 23 bp, Homo sapiens
aaacagcgcagacggcgctatgg

SEQ ID NO: 8334 - DNA, 23 bp, Homo sapiens
ttttaatgggaaagattccgagg

SEQ ID NO: 8335 - DNA, 23 bp, Homo sapiens
tggcagctatggttacacaatgg

SEQ ID NO: 8336 - DNA, 23 bp, Homo sapiens
acaagccacacggaaggcccagg

SEQ ID NO: 8337 - DNA, 23 bp, Homo sapiens
ttcggcaagaagactggagaagg

SEQ ID NO: 8338 - DNA, 23 bp, Homo sapiens
aagaagttctaccagtgagcagg

SEQ ID NO: 8339 - DNA, 23 bp, Homo sapiens
aagcttccactatcatagcatgg

SEQ ID NO: 8340 - DNA, 23 bp, Homo sapiens
cactctcatgaaggggttgtagg

SEQ ID NO: 8341 - DNA, 23 bp, Homo sapiens
ttcaagatgccccgggactgagg

SEQ ID NO: 8342 - DNA, 23 bp, Homo sapiens
aagctttattcatagttcggagg

SEQ ID NO: 8343 - DNA, 23 bp, Homo sapiens
gtctgggtggctcagtcgtgtgg

SEQ ID NO: 8344 - DNA, 23 bp, Homo sapiens
acctggtgcgctctgttgtaagg

SEQ ID NO: 8345 - DNA, 23 bp, Homo sapiens
ttcatgacaaagcccattaaagg

SEQ ID NO: 8346 - DNA, 23 bp, Homo sapiens
gctgtcatcgatcaaagtgtggg

SEQ ID NO: 8347 - DNA, 23 bp, Homo sapiens
cggcgcgggcctcggctcactgg

SEQ ID NO: 8348 - DNA, 23 bp, Homo sapiens
ctggagctcaagcagtgaggagg

SEQ ID NO: 8349 - DNA, 23 bp, Homo sapiens
tattgtgcactgtcagatcttgg

SEQ ID NO: 8350 - DNA, 23 bp, Homo sapiens
ggcccttttttcttacagcctgg

SEQ ID NO: 8351 - DNA, 23 bp, Homo sapiens
tatccaccctctcttttcatcgg

SEQ ID NO: 8352 - DNA, 23 bp, Homo sapiens
gaggctgcagtgcgcttcgtggg

SEQ ID NO: 8353 - DNA, 23 bp, Homo sapiens
ctactgctacgccgagaattagg

SEQ ID NO: 8354 - DNA, 23 bp, Homo sapiens
agggccccaggtcctagtgctgg

SEQ ID NO: 8355 - DNA, 23 bp, Homo sapiens
acccctctgcacgtctaggctgg

SEQ ID NO: 8356 - DNA, 23 bp, Homo sapiens
agaggctgaccgtattcgtcagg

SEQ ID NO: 8357 - DNA, 23 bp, Homo sapiens
gttcagttcagcagatgcagagg

SEQ ID NO: 8358 - DNA, 23 bp, Homo sapiens
ttcagtggccagcagagaggagg

SEQ ID NO: 8359 - DNA, 23 bp, Homo sapiens
cgcgtggctggactcacacctgg

SEQ ID NO: 8360 - DNA, 23 bp, Homo sapiens
gaagggacaacaatatgacatgg

SEQ ID NO: 8361 - DNA, 23 bp, Homo sapiens
ctcactgctctctagaaacgtgg

SEQ ID NO: 8362 - DNA, 23 bp, Homo sapiens
gcttttgctgaggtgtgacatgg

SEQ ID NO: 8363 - DNA, 23 bp, Homo sapiens
cttacttaaacagactgtgctgg

SEQ ID NO: 8364 - DNA, 23 bp, Homo sapiens
caagtcgttcaataacacgccgg

SEQ ID NO: 8365 - DNA, 23 bp, Homo sapiens
tacaagaagagtagacatgatgg

SEQ ID NO: 8366 - DNA, 23 bp, Homo sapiens
tggcagagaatatactcaagtgg

SEQ ID NO: 8367 - DNA, 23 bp, Homo sapiens
agtgttttgggagactgaaacgg

SEQ ID NO: 8368 - DNA, 23 bp, Homo sapiens
catcagcaagaatatcagtgagg

SEQ ID NO: 8369 - DNA, 23 bp, Homo sapiens
ctggccctgccagagctcaacgg

SEQ ID NO: 8370 - DNA, 23 bp, Homo sapiens
ttcagctgcacagcttctgcagg

SEQ ID NO: 8371 - DNA, 23 bp, Homo sapiens
cttcatcttgtcaagtcagacgg

SEQ ID NO: 8372 - DNA, 23 bp, Homo sapiens
ggcgagcagatctgctggggtgg

SEQ ID NO: 8373 - DNA, 23 bp, Homo sapiens
ctctctctctcgttcagggaggg

SEQ ID NO: 8374 - DNA, 23 bp, Homo sapiens
caccactgggtcttagtccgtgg

SEQ ID NO: 8375 - DNA, 23 bp, Homo sapiens
tccaacatgtcagtgatactggg

SEQ ID NO: 8376 - DNA, 23 bp, Homo sapiens
attgcaaagcgacaacccaaagg

SEQ ID NO: 8377 - DNA, 23 bp, Homo sapiens
ctgagggttaacaaggctaccgg

SEQ ID NO: 8378 - DNA, 23 bp, Homo sapiens
acctccaaataccgttaagctgg

SEQ ID NO: 8379 - DNA, 23 bp, Homo sapiens
agcgagcttagtgatacttgtgg

SEQ ID NO: 8380 - DNA, 23 bp, Homo sapiens
gaaacagtccaggatctcaatgg

SEQ ID NO: 8381 - DNA, 23 bp, Homo sapiens
caaactggaagagaactcagtgg

SEQ ID NO: 8382 - DNA, 23 bp, Homo sapiens
tgagcacaagtctctctcagtgg

SEQ ID NO: 8383 - DNA, 23 bp, Homo sapiens
atcatgggcagtgagctcagtgg

SEQ ID NO: 8384 - DNA, 23 bp, Homo sapiens
ctgcgcagcacagggctcagcgg

SEQ ID NO: 8385 - DNA, 23 bp, Homo sapiens
taaatcctgactgttggaagagg

SEQ ID NO: 8386 - DNA, 23 bp, Homo sapiens
gccacccacccacagttcagcgg

SEQ ID NO: 8387 - DNA, 23 bp, Homo sapiens
aatggtgttattgctacaagtgg

SEQ ID NO: 8388 - DNA, 23 bp, Homo sapiens
ggtggttctacaatagctgctgg

SEQ ID NO: 8389 - DNA, 23 bp, Homo sapiens
gtcccggaggcggcgctcagcgg

SEQ ID NO: 8390 - DNA, 23 bp, Homo sapiens
gggatccccacattgttgagtgg

SEQ ID NO: 8391 - DNA, 23 bp, Homo sapiens
tggcatggttatttaaggagagg

SEQ ID NO: 8392 - DNA, 23 bp, Homo sapiens
gcatctctggagaaacagttggg

SEQ ID NO: 8393 - DNA, 23 bp, Homo sapiens
atctgaaacagtgctttacgagg

SEQ ID NO: 8394 - DNA, 23 bp, Homo sapiens
taaggccgatggtcagtgagagg

SEQ ID NO: 8395 - DNA, 23 bp, Homo sapiens
aaccccagctggggacataatgg

SEQ ID NO: 8396 - DNA, 23 bp, Homo sapiens
acacaagttcggtggcttcaagg

SEQ ID NO: 8397 - DNA, 23 bp, Homo sapiens
tgactgaagtagttcacagaagg

SEQ ID NO: 8398 - DNA, 23 bp, Homo sapiens
taccaacagcagccatgataggg

SEQ ID NO: 8399 - DNA, 23 bp, Homo sapiens
tgcaaattatgtcaagcttctgg

SEQ ID NO: 8400 - DNA, 23 bp, Homo sapiens
aatcgtggcttttctgcgtctgg

SEQ ID NO: 8401 - DNA, 23 bp, Homo sapiens
ggtcggcgagggtcacaagttgg

SEQ ID NO: 8402 - DNA, 23 bp, Homo sapiens
tttacatgttggcagaaagctgg

SEQ ID NO: 8403 - DNA, 23 bp, Homo sapiens
ctgccatccaatctatgagctgg

SEQ ID NO: 8404 - DNA, 23 bp, Homo sapiens
ccgaagaacgactcagatcccgg

SEQ ID NO: 8405 - DNA, 23 bp, Homo sapiens
cctcgctcagggcagcactgtgg

SEQ ID NO: 8406 - DNA, 23 bp, Homo sapiens
gagcaggaccacttcaaaactgg

SEQ ID NO: 8407 - DNA, 23 bp, Homo sapiens
caggagggtcagcccctgcctgg

SEQ ID NO: 8408 - DNA, 23 bp, Homo sapiens
ggaggtcaagttggcctgaatgg

SEQ ID NO: 8409 - DNA, 23 bp, Homo sapiens
ttggccgatttcaagccaccagg

SEQ ID NO: 8410 - DNA, 23 bp, Homo sapiens
agcaagggtcagggcactgcagg

SEQ ID NO: 8411 - DNA, 23 bp, Homo sapiens
ggtgagactgtcaaattcagggg

SEQ ID NO: 8412 - DNA, 23 bp, Homo sapiens
caatgacaaggaaagcgatgtgg

SEQ ID NO: 8413 - DNA, 23 bp, Homo sapiens
cagcttcgagggagtgctacagg

SEQ ID NO: 8414 - DNA, 23 bp, Homo sapiens
gatgggggccggggcgtcacagg

SEQ ID NO: 8415 - DNA, 23 bp, Homo sapiens
ccgtattctggggcttagtgtgg

SEQ ID NO: 8416 - DNA, 23 bp, Homo sapiens
tgatgttggttcacaggtgaagg

SEQ ID NO: 8417 - DNA, 23 bp, Homo sapiens
ccagagccttagagattcatagg

SEQ ID NO: 8418 - DNA, 23 bp, Homo sapiens
caattaactggtctggagggtgg

SEQ ID NO: 8419 - DNA, 23 bp, Homo sapiens
gctgcggcagctgcttctacagg

SEQ ID NO: 8420 - DNA, 23 bp, Homo sapiens
tgatgtagttgaggatttgttgg

SEQ ID NO: 8421 - DNA, 23 bp, Homo sapiens
tgtgtatgtggcactttacaagg

SEQ ID NO: 8422 - DNA, 23 bp, Homo sapiens
ataggcaaagatttagctccagg

SEQ ID NO: 8423 - DNA, 23 bp, Homo sapiens
cagcattcatattcgggctttgg

SEQ ID NO: 8424 - DNA, 23 bp, Homo sapiens
gaggtcaatgtgtgtgaagttgg

SEQ ID NO: 8425 - DNA, 23 bp, Homo sapiens
gggggacttggcacttcacaagg

SEQ ID NO: 8426 - DNA, 23 bp, Homo sapiens
aaggccctgtgtctaaaccatgg

SEQ ID NO: 8427 - DNA, 23 bp, Homo sapiens
tagagagtgtctcaggagtgtgg

SEQ ID NO: 8428 - DNA, 23 bp, Homo sapiens
cctgaatcgctgcaccccagagg

SEQ ID NO: 8429 - DNA, 23 bp, Homo sapiens
agcatctgttcaagcagcggggg

SEQ ID NO: 8430 - DNA, 23 bp, Homo sapiens
cttgaaacattggtggctacagg

SEQ ID NO: 8431 - DNA, 23 bp, Homo sapiens
ctggaaacgctggtaactacagg

SEQ ID NO: 8432 - DNA, 23 bp, Homo sapiens
cggctcagctctcctcgtccagg

SEQ ID NO: 8433 - DNA, 23 bp, Homo sapiens
acttgcagaaaaccagtgaaggg

SEQ ID NO: 8434 - DNA, 23 bp, Homo sapiens
acaataggtgctgcagaatgtgg

SEQ ID NO: 8435 - DNA, 23 bp, Homo sapiens
ggctcaactccagggctttgagg

SEQ ID NO: 8436 - DNA, 23 bp, Homo sapiens
agggctgggctttggagtgaggg

SEQ ID NO: 8437 - DNA, 23 bp, Homo sapiens
ggcatggggcctagagcatgagg

SEQ ID NO: 8438 - DNA, 23 bp, Homo sapiens
cattatcgtttggggccccaagg

SEQ ID NO: 8439 - DNA, 23 bp, Homo sapiens
acactgaatgaggtatcatcagg

SEQ ID NO: 8440 - DNA, 23 bp, Homo sapiens
tcttagaaatagctctggagtgg

SEQ ID NO: 8441 - DNA, 23 bp, Homo sapiens
tgctctgaaagaattccagccgg

SEQ ID NO: 8442 - DNA, 23 bp, Homo sapiens
tcttctccctctggaaagaaagg

SEQ ID NO: 8443 - DNA, 23 bp, Homo sapiens
agaggaaactggtctttaattgg

SEQ ID NO: 8444 - DNA, 23 bp, Homo sapiens
aattgttggtgcagaatgtatgg

SEQ ID NO: 8445 - DNA, 23 bp, Homo sapiens
cttcactgatttgttaaccctgg

SEQ ID NO: 8446 - DNA, 23 bp, Homo sapiens
tggcaatttcagcaaggacccgg

SEQ ID NO: 8447 - DNA, 23 bp, Homo sapiens
acggacggcgcaatgagatctgg

SEQ ID NO: 8448 - DNA, 23 bp, Homo sapiens
agctacgtggagcctggttcagg

SEQ ID NO: 8449 - DNA, 23 bp, Homo sapiens
ttctcattcgttttctttggtgg

SEQ ID NO: 8450 - DNA, 23 bp, Homo sapiens
ataagcttcgagaactttgaagg

SEQ ID NO: 8451 - DNA, 23 bp, Homo sapiens
ctagctgctacaatggagaaagg

SEQ ID NO: 8452 - DNA, 23 bp, Homo sapiens
tcccccctacaagagcaaaaagg

SEQ ID NO: 8453 - DNA, 23 bp, Homo sapiens
ttaacaccattgaagactctggg

SEQ ID NO: 8454 - DNA, 23 bp, Homo sapiens
atgagcccttgggaggagtgagg

SEQ ID NO: 8455 - DNA, 23 bp, Homo sapiens
agaccccctcagtggctgatggg

SEQ ID NO: 8456 - DNA, 23 bp, Homo sapiens
agcacctttggacttgagtgagg

SEQ ID NO: 8457 - DNA, 23 bp, Homo sapiens
acttttggacttgagtgacctgg

SEQ ID NO: 8458 - DNA, 23 bp, Homo sapiens
tttcatcactgatgaaagacggg

SEQ ID NO: 8459 - DNA, 23 bp, Homo sapiens
ggtgggcttgaaaagttgcctgg

SEQ ID NO: 8460 - DNA, 23 bp, Homo sapiens
aggaccaattaaagagaagatgg

SEQ ID NO: 8461 - DNA, 23 bp, Homo sapiens
gacctttatgcccaattcaaggg

SEQ ID NO: 8462 - DNA, 23 bp, Homo sapiens
atagcttcatgctttgtcagtgg

SEQ ID NO: 8463 - DNA, 23 bp, Homo sapiens
gcgagtgggcgtcagagcaccgg

SEQ ID NO: 8464 - DNA, 23 bp, Homo sapiens
gggagctcatctggcagcaatgg

SEQ ID NO: 8465 - DNA, 23 bp, Homo sapiens
gtggagagggctcttcaggaagg

SEQ ID NO: 8466 - DNA, 23 bp, Homo sapiens
tgactctcattcagaattgctgg

SEQ ID NO: 8467 - DNA, 23 bp, Homo sapiens
cggaggtctgggccatagcatgg

SEQ ID NO: 8468 - DNA, 23 bp, Homo sapiens
cagtgatggttctgcagtggtgg

SEQ ID NO: 8469 - DNA, 23 bp, Homo sapiens
gctcaggcgctgatctccaccgg

SEQ ID NO: 8470 - DNA, 23 bp, Homo sapiens
actctggatggtcttgctgctgg

SEQ ID NO: 8471 - DNA, 23 bp, Homo sapiens
gaagcttgaagctgtcatccagg

SEQ ID NO: 8472 - DNA, 23 bp, Homo sapiens
gatggttcacagagcatccgtgg

SEQ ID NO: 8473 - DNA, 23 bp, Homo sapiens
ggcatgtcctggctacacagcgg

SEQ ID NO: 8474 - DNA, 23 bp, Homo sapiens
gcacggtcagtagtcagtgtcgg

SEQ ID NO: 8475 - DNA, 23 bp, Homo sapiens
ggatgtcgactcctttgcttcgg

SEQ ID NO: 8476 - DNA, 23 bp, Homo sapiens
ctggtaagaatgattgtctctgg

SEQ ID NO: 8477 - DNA, 23 bp, Homo sapiens
gaagggtttagtttggcctgagg

SEQ ID NO: 8478 - DNA, 23 bp, Homo sapiens
ccagtccacaggaggtggtgagg

SEQ ID NO: 8479 - DNA, 23 bp, Homo sapiens
tttcccaggccggagtgcaatgg

SEQ ID NO: 8480 - DNA, 23 bp, Homo sapiens
atcaacaacaacagaggatttgg

SEQ ID NO: 8481 - DNA, 23 bp, Homo sapiens
tgattatgactgtgtgagcatgg

SEQ ID NO: 8482 - DNA, 23 bp, Homo sapiens
ccccagccatcgcaaactgatgg

SEQ ID NO: 8483 - DNA, 23 bp, Homo sapiens
gggtcctgatttacaacgtcagg

SEQ ID NO: 8484 - DNA, 23 bp, Homo sapiens
gcacagtttttcaggtcaattgg

SEQ ID NO: 8485 - DNA, 23 bp, Homo sapiens
aggccgtggcggaactgaggggg

SEQ ID NO: 8486 - DNA, 23 bp, Homo sapiens
gatcggccgaggggctaccacgg

SEQ ID NO: 8487 - DNA, 23 bp, Homo sapiens
ccggggatgacctgaactgaagg

SEQ ID NO: 8488 - DNA, 23 bp, Homo sapiens
tggaggccgtggctgcgctgagg

SEQ ID NO: 8489 - DNA, 23 bp, Homo sapiens
ctctggcggccctggtgacccgg

SEQ ID NO: 8490 - DNA, 23 bp, Homo sapiens
ctggctggcattggtcaccaagg

SEQ ID NO: 8491 - DNA, 23 bp, Homo sapiens
ccccccaaggctcagggccaagg

SEQ ID NO: 8492 - DNA, 23 bp, Homo sapiens
atcggcgtgcaaaactgaaaagg

SEQ ID NO: 8493 - DNA, 23 bp, Homo sapiens
caatgtaggcttctgtgagcagg

SEQ ID NO: 8494 - DNA, 23 bp, Homo sapiens
gctgcacaacctctttatgctgg

SEQ ID NO: 8495 - DNA, 23 bp, Homo sapiens
cacacatgcagatcacaaagcgg

SEQ ID NO: 8496 - DNA, 23 bp, Homo sapiens
ggcatgagctctcccctcagggg

SEQ ID NO: 8497 - DNA, 23 bp, Homo sapiens
ttcagtctagtctccaaacttgg

SEQ ID NO: 8498 - DNA, 23 bp, Homo sapiens
atgaggagccgggtacctagggg

SEQ ID NO: 8499 - DNA, 23 bp, Homo sapiens
agaccttgggggacggagatcgg

SEQ ID NO: 8500 - DNA, 23 bp, Homo sapiens
cgaccctgggggacagaagttgg

SEQ ID NO: 8501 - DNA, 23 bp, Homo sapiens
ctctgaaatcactgaaatcgggg

SEQ ID NO: 8502 - DNA, 23 bp, Homo sapiens
agctaagacgtagtgccccatgg

SEQ ID NO: 8503 - DNA, 23 bp, Homo sapiens
aggagtcctcttccaaaaatagg

SEQ ID NO: 8504 - DNA, 23 bp, Homo sapiens
tttgtcgtcatcttgttcattgg

SEQ ID NO: 8505 - DNA, 23 bp, Homo sapiens
gtggctttgcattcagtaagggg

SEQ ID NO: 8506 - DNA, 23 bp, Homo sapiens
atttcatcagcttcatcatcagg

SEQ ID NO: 8507 - DNA, 23 bp, Homo sapiens
ccccacacacacactgcaggggg

SEQ ID NO: 8508 - DNA, 23 bp, Homo sapiens
gcaatgttccagtctcaattagg

SEQ ID NO: 8509 - DNA, 23 bp, Homo sapiens
acttacttcagctatgactgtgg

SEQ ID NO: 8510 - DNA, 23 bp, Homo sapiens
gacattcctcagtgttcagaagg

SEQ ID NO: 8511 - DNA, 23 bp, Homo sapiens
taattgcacagtactcccagcgg

SEQ ID NO: 8512 - DNA, 23 bp, Homo sapiens
tgtcccgctggagggtcaggagg

SEQ ID NO: 8513 - DNA, 23 bp, Homo sapiens
ccggctgcaggggcctcaggtgg

SEQ ID NO: 8514 - DNA, 23 bp, Homo sapiens
gtcagtcgaatgaaatgagctgg

SEQ ID NO: 8515 - DNA, 23 bp, Homo sapiens
tgtaggcaatgagcacccagagg

SEQ ID NO: 8516 - DNA, 23 bp, Homo sapiens
ggcccaacagcattagtccgtgg

SEQ ID NO: 8517 - DNA, 23 bp, Homo sapiens
aaagagaagccggagtaggaggg

SEQ ID NO: 8518 - DNA, 23 bp, Homo sapiens
gatcaggaagtggacattgaggg

SEQ ID NO: 8519 - DNA, 23 bp, Homo sapiens
tgacatgacatcttacttgctgg

SEQ ID NO: 8520 - DNA, 23 bp, Homo sapiens
agccgttcattttacagtggtgg

SEQ ID NO: 8521 - DNA, 23 bp, Homo sapiens
ggcagcggcgtgttgcctacagg

SEQ ID NO: 8522 - DNA, 23 bp, Homo sapiens
caccttgaccaataggtcaaggg

SEQ ID NO: 8523 - DNA, 23 bp, Homo sapiens
aatatctgcaagtctgtgtgagg

SEQ ID NO: 8524 - DNA, 23 bp, Homo sapiens
gcctctttcaggaaaagtatagg

SEQ ID NO: 8525 - DNA, 23 bp, Homo sapiens
agaccccaagagagcattcttgg

SEQ ID NO: 8526 - DNA, 23 bp, Homo sapiens
ggggatatgatggctttgcttgg

SEQ ID NO: 8527 - DNA, 23 bp, Homo sapiens
ggccaaagggcacactcagaagg

SEQ ID NO: 8528 - DNA, 23 bp, Homo sapiens
agatcagctggtttccattttgg

SEQ ID NO: 8529 - DNA, 23 bp, Homo sapiens
cactaaggcaactcatggagggg

SEQ ID NO: 8530 - DNA, 23 bp, Homo sapiens
ctggcgaggggcgctctaggtgg

SEQ ID NO: 8531 - DNA, 23 bp, Homo sapiens
gcgggtctttggcttctaggagg

SEQ ID NO: 8532 - DNA, 23 bp, Homo sapiens
tttgagatacagcgggtgtgagg

SEQ ID NO: 8533 - DNA, 23 bp, Homo sapiens
ggttcactttttcaagcagtagg

SEQ ID NO: 8534 - DNA, 23 bp, Homo sapiens
tgaagaattactcagagctttgg

SEQ ID NO: 8535 - DNA, 23 bp, Homo sapiens
ccctggcaggctagttgtatcgg

SEQ ID NO: 8536 - DNA, 23 bp, Homo sapiens
tcagcccaggctgactgagccgg

SEQ ID NO: 8537 - DNA, 23 bp, Homo sapiens
tttcactttgtcacccagtctgg

SEQ ID NO: 8538 - DNA, 23 bp, Homo sapiens
catctcttcttctaaggcttagg

SEQ ID NO: 8539 - DNA, 23 bp, Homo sapiens
acaggatgctggagagaagtagg

SEQ ID NO: 8540 - DNA, 23 bp, Homo sapiens
ttggactcactgaagaatcgtgg

SEQ ID NO: 8541 - DNA, 23 bp, Homo sapiens
cgcagccatcttgctgggtctgg

SEQ ID NO: 8542 - DNA, 23 bp, Homo sapiens
tcaagaccctgggctcagggtgg

SEQ ID NO: 8543 - DNA, 23 bp, Homo sapiens
tagcacagaaccctctcttttgg

SEQ ID NO: 8544 - DNA, 23 bp, Homo sapiens
gtttaatgcacaggtgtgagtgg

SEQ ID NO: 8545 - DNA, 23 bp, Homo sapiens
cagagatccagatggtttgaagg

SEQ ID NO: 8546 - DNA, 23 bp, Homo sapiens
tggctatatgcggctgcagctgg

SEQ ID NO: 8547 - DNA, 23 bp, Homo sapiens
tccccaaaacgtgcttaaccagg

SEQ ID NO: 8548 - DNA, 23 bp, Homo sapiens
atcagttggcaggttcaacctgg

SEQ ID NO: 8549 - DNA, 23 bp, Homo sapiens
gcttggcttcttatccaagttgg

SEQ ID NO: 8550 - DNA, 23 bp, Homo sapiens
tccacctacactgcaagaagtgg

SEQ ID NO: 8551 - DNA, 23 bp, Homo sapiens
agctcaactcgtgaactactagg

SEQ ID NO: 8552 - DNA, 23 bp, Homo sapiens
ccagacggcagtgaactcagtgg

SEQ ID NO: 8553 - DNA, 23 bp, Homo sapiens
catgctcaccaactataagtagg

SEQ ID NO: 8554 - DNA, 23 bp, Homo sapiens
tggagaaccctgcttctggctgg

SEQ ID NO: 8555 - DNA, 23 bp, Homo sapiens
ccctccagtgtttatatgtaagg

SEQ ID NO: 8556 - DNA, 23 bp, Homo sapiens
ggatactggctgagttttgttgg

SEQ ID NO: 8557 - DNA, 23 bp, Homo sapiens
aggggtggaatcaccatcagtgg

SEQ ID NO: 8558 - DNA, 23 bp, Homo sapiens
gggcaggctacttgtccctcagg

SEQ ID NO: 8559 - DNA, 23 bp, Homo sapiens
cgtggcatcatcagcagtgatgg

SEQ ID NO: 8560 - DNA, 23 bp, Homo sapiens
ggcggcgcccaagaagaaatagg

SEQ ID NO: 8561 - DNA, 23 bp, Homo sapiens
ggcagccaagccaaagaaggcgg

SEQ ID NO: 8562 - DNA, 23 bp, Homo sapiens
acaaagctaagggcaagtaaggg

SEQ ID NO: 8563 - DNA, 23 bp, Homo sapiens
ccgcggtgggcgggctcacttgg

SEQ ID NO: 8564 - DNA, 23 bp, Homo sapiens
tcgccgcattcgcggagagaggg

SEQ ID NO: 8565 - DNA, 23 bp, Homo sapiens
acgtcgtatccgcggcgagaggg

SEQ ID NO: 8566 - DNA, 23 bp, Homo sapiens
cgcactctgtatggcttcggcgg

SEQ ID NO: 8567 - DNA, 23 bp, Homo sapiens
cgcactctttatggcttcggcgg

SEQ ID NO: 8568 - DNA, 23 bp, Homo sapiens
ctttacggcttcggtggctaagg

SEQ ID NO: 8569 - DNA, 23 bp, Homo sapiens
cgcaccctctacggtttcggtgg

SEQ ID NO: 8570 - DNA, 23 bp, Homo sapiens
cacaaggcaaagggcaagtgagg

SEQ ID NO: 8571 - DNA, 23 bp, Homo sapiens
ccgccgcatccgtggagagcggg

SEQ ID NO: 8572 - DNA, 23 bp, Homo sapiens
cctgtacggcttcggaggctagg

SEQ ID NO: 8573 - DNA, 23 bp, Homo sapiens
cacaaggccaagggcaagtgagg

SEQ ID NO: 8574 - DNA, 23 bp, Homo sapiens
acgccgaggaacgcctcacttgg

SEQ ID NO: 8575 - DNA, 23 bp, Homo sapiens
ggcttgtgatagcaacctgatgg

SEQ ID NO: 8576 - DNA, 23 bp, Homo sapiens
agctgactcttttctgatgaagg

SEQ ID NO: 8577 - DNA, 23 bp, Homo sapiens
gttggagagaggctaagcgttgg

SEQ ID NO: 8578 - DNA, 23 bp, Homo sapiens
agagaacacgtcttacaggatgg

SEQ ID NO: 8579 - DNA, 23 bp, Homo sapiens
gggcgtgcggttacgcacagagg

SEQ ID NO: 8580 - DNA, 23 bp, Homo sapiens
gcctgccgcatccgtgaggctgg

SEQ ID NO: 8581 - DNA, 23 bp, Homo sapiens
gcgcagttgactcgtgtctgagg

SEQ ID NO: 8582 - DNA, 23 bp, Homo sapiens
gcaggcacagaaggagaactagg

SEQ ID NO: 8583 - DNA, 23 bp, Homo sapiens
agacatcagaggacacactcagg

SEQ ID NO: 8584 - DNA, 23 bp, Homo sapiens
aacaccactgtattccagcctgg

SEQ ID NO: 8585 - DNA, 23 bp, Homo sapiens
tgagagactcatcagagccctgg

SEQ ID NO: 8586 - DNA, 23 bp, Homo sapiens
tacttccggaagccttgctcagg

SEQ ID NO: 8587 - DNA, 23 bp, Homo sapiens
cctgggtccaattattcagaagg

SEQ ID NO: 8588 - DNA, 23 bp, Homo sapiens
catatgtgtccagtgtccccagg

SEQ ID NO: 8589 - DNA, 23 bp, Homo sapiens
ctgctccctcagtcatgctaagg

SEQ ID NO: 8590 - DNA, 23 bp, Homo sapiens
cagtatttcacagggtcccctgg

SEQ ID NO: 8591 - DNA, 23 bp, Homo sapiens
caacgaggatctgcataaacagg

SEQ ID NO: 8592 - DNA, 23 bp, Homo sapiens
ttccaggatgggattcacaatgg

SEQ ID NO: 8593 - DNA, 23 bp, Homo sapiens
atgggattcataagagcccttgg

SEQ ID NO: 8594 - DNA, 23 bp, Homo sapiens
atccgtcaaaggagtcagaaagg

SEQ ID NO: 8595 - DNA, 23 bp, Homo sapiens
cctcaagggcctccaccagcagg

SEQ ID NO: 8596 - DNA, 23 bp, Homo sapiens
gggctgatcttcctcgggctggg

SEQ ID NO: 8597 - DNA, 23 bp, Homo sapiens
aagtcctcaggagtcagtgcagg

SEQ ID NO: 8598 - DNA, 23 bp, Homo sapiens
cacctccatgtgccttacagagg

SEQ ID NO: 8599 - DNA, 23 bp, Homo sapiens
atctacttcaggaatcagaaagg

SEQ ID NO: 8600 - DNA, 23 bp, Homo sapiens
ggtcatctgcatttcagctcagg

SEQ ID NO: 8601 - DNA, 23 bp, Homo sapiens
cactctggacttcagccaacagg

SEQ ID NO: 8602 - DNA, 23 bp, Homo sapiens
cactctggacttcacccaacagg

SEQ ID NO: 8603 - DNA, 23 bp, Homo sapiens
agctgtgagactcagacccctgg

SEQ ID NO: 8604 - DNA, 23 bp, Homo sapiens
aaacagagggagctactctcagg

SEQ ID NO: 8605 - DNA, 23 bp, Homo sapiens
ttggcaccatcttatgaaaaggg

SEQ ID NO: 8606 - DNA, 23 bp, Homo sapiens
ctgcggtcgctgctgtgctgtgg

SEQ ID NO: 8607 - DNA, 23 bp, Homo sapiens
cgcccggcattaccgccgtttgg

SEQ ID NO: 8608 - DNA, 23 bp, Homo sapiens
aggcacgggcccctgtaggatgg

SEQ ID NO: 8609 - DNA, 23 bp, Homo sapiens
tgtttcatttcgtcagcatttgg

SEQ ID NO: 8610 - DNA, 23 bp, Homo sapiens
gagccagcccaaggcgcgcttgg

SEQ ID NO: 8611 - DNA, 23 bp, Homo sapiens
ggcacccgctgggcattacatgg

SEQ ID NO: 8612 - DNA, 23 bp, Homo sapiens
cgggaaccagtacagggtcttgg

SEQ ID NO: 8613 - DNA, 23 bp, Homo sapiens
ggcatcagcatcgaaggggctgg

SEQ ID NO: 8614 - DNA, 23 bp, Homo sapiens
aactccgtatcaaagagctttgg

SEQ ID NO: 8615 - DNA, 23 bp, Homo sapiens
agaaggtagaagaagagaggagg

SEQ ID NO: 8616 - DNA, 23 bp, Homo sapiens
gccctggatgatgactgatcagg

SEQ ID NO: 8617 - DNA, 23 bp, Homo sapiens
gtgccccacaaaccagttaatgg

SEQ ID NO: 8618 - DNA, 23 bp, Homo sapiens
ctctgaaagtcctgtgtcactgg

SEQ ID NO: 8619 - DNA, 23 bp, Homo sapiens
ctttggagagttccttagtatgg

SEQ ID NO: 8620 - DNA, 23 bp, Homo sapiens
tccccctacccctactaaacggg

SEQ ID NO: 8621 - DNA, 23 bp, Homo sapiens
gtgaacagactcgatcgttaggg

SEQ ID NO: 8622 - DNA, 23 bp, Homo sapiens
tgggcccgcccactcctcacagg

SEQ ID NO: 8623 - DNA, 23 bp, Homo sapiens
ctcgcaggagtcctcggaggagg

SEQ ID NO: 8624 - DNA, 23 bp, Homo sapiens
aagaggcagacctaggaaatggg

SEQ ID NO: 8625 - DNA, 23 bp, Homo sapiens
gacaattcagtgactccttttgg

SEQ ID NO: 8626 - DNA, 23 bp, Homo sapiens
gatatataagattgcccgggtgg

SEQ ID NO: 8627 - DNA, 23 bp, Homo sapiens
gtctgccgaagaggactaggggg

SEQ ID NO: 8628 - DNA, 23 bp, Homo sapiens
tgaagaggatgaggaggaggagg

SEQ ID NO: 8629 - DNA, 23 bp, Homo sapiens
agatgaagatgaggaggaagagg

SEQ ID NO: 8630 - DNA, 23 bp, Homo sapiens
ggaagatgaagaagaggaggagg

SEQ ID NO: 8631 - DNA, 23 bp, Homo sapiens
aaagagtcaggcagagctgatgg

SEQ ID NO: 8632 - DNA, 23 bp, Homo sapiens
gcaaggggctcagagtttacagg

SEQ ID NO: 8633 - DNA, 23 bp, Homo sapiens
ccattcaagtcaagcattgaagg

SEQ ID NO: 8634 - DNA, 23 bp, Homo sapiens
ggctattcaggctgtcttcttgg

SEQ ID NO: 8635 - DNA, 23 bp, Homo sapiens
agcagctgtcattagtaatgggg

SEQ ID NO: 8636 - DNA, 23 bp, Homo sapiens
atgcccggcgtcccgtctaaagg

SEQ ID NO: 8637 - DNA, 23 bp, Homo sapiens
cttaacattccacagatgggggg

SEQ ID NO: 8638 - DNA, 23 bp, Homo sapiens
aggtttagcagacaacctcgcgg

SEQ ID NO: 8639 - DNA, 23 bp, Homo sapiens
ccagcacactgtcagtaaagggg

SEQ ID NO: 8640 - DNA, 23 bp, Homo sapiens
aaagacactgattcaatcagtgg

SEQ ID NO: 8641 - DNA, 23 bp, Homo sapiens
aagcaggaagctggaaaggaagg

SEQ ID NO: 8642 - DNA, 23 bp, Homo sapiens
actgaatctgtagataacgaggg

SEQ ID NO: 8643 - DNA, 23 bp, Homo sapiens
aagtaatatggaggaacagttgg

SEQ ID NO: 8644 - DNA, 23 bp, Homo sapiens
agaagaggaagaaggaaaagagg

SEQ ID NO: 8645 - DNA, 23 bp, Homo sapiens
cctggcttattctgccactgcgg

SEQ ID NO: 8646 - DNA, 23 bp, Homo sapiens
attctttgctgtcacagtcccgg

SEQ ID NO: 8647 - DNA, 23 bp, Homo sapiens
gcatgtttggaagtcggaattgg

SEQ ID NO: 8648 - DNA, 23 bp, Homo sapiens
ctatggagtgtcaagaatcatgg

SEQ ID NO: 8649 - DNA, 23 bp, Homo sapiens
ccagcatgcctgcattcacatgg

SEQ ID NO: 8650 - DNA, 23 bp, Homo sapiens
ggtgcttcacatgtagtaccagg

SEQ ID NO: 8651 - DNA, 23 bp, Homo sapiens
tgggttgctgataaaactaaagg

SEQ ID NO: 8652 - DNA, 23 bp, Homo sapiens
cactgctccacgcggtcactcgg

SEQ ID NO: 8653 - DNA, 23 bp, Homo sapiens
cggcaggcggggctcacaccagg

SEQ ID NO: 8654 - DNA, 23 bp, Homo sapiens
caacaagctcgactactgaccgg

SEQ ID NO: 8655 - DNA, 23 bp, Homo sapiens
ttccgtgccgctgctacggccgg

SEQ ID NO: 8656 - DNA, 23 bp, Homo sapiens
ggcccaggtgccgtggttactgg

SEQ ID NO: 8657 - DNA, 23 bp, Homo sapiens
agtggtgtgtgggcatcaccagg

SEQ ID NO: 8658 - DNA, 23 bp, Homo sapiens
gcaggtgctggtcaggtcactgg

SEQ ID NO: 8659 - DNA, 23 bp, Homo sapiens
gttaagcaacttgcccaaagcgg

SEQ ID NO: 8660 - DNA, 23 bp, Homo sapiens
ttgctagataacttcctgcttgg

SEQ ID NO: 8661 - DNA, 23 bp, Homo sapiens
gcttttgtttggagagatgctgg

SEQ ID NO: 8662 - DNA, 23 bp, Homo sapiens
aagaagctgccaggcataatagg

SEQ ID NO: 8663 - DNA, 23 bp, Homo sapiens
tctgagtttcatagtgattgagg

SEQ ID NO: 8664 - DNA, 23 bp, Homo sapiens
tgacacttaaaagaggatgaagg

SEQ ID NO: 8665 - DNA, 23 bp, Homo sapiens
ggcggtgggggtggctatggagg

SEQ ID NO: 8666 - DNA, 23 bp, Homo sapiens
tccagcagcagcagtagctatgg

SEQ ID NO: 8667 - DNA, 23 bp, Homo sapiens
aataggaagaagctcagtatcgg

SEQ ID NO: 8668 - DNA, 23 bp, Homo sapiens
gtggtggatatggtagcagaagg

SEQ ID NO: 8669 - DNA, 23 bp, Homo sapiens
aactacaagccatactgaggcgg

SEQ ID NO: 8670 - DNA, 23 bp, Homo sapiens
cagagacagcgccaatggcgagg

SEQ ID NO: 8671 - DNA, 23 bp, Homo sapiens
tatgtgcttaagagtcatcctgg

SEQ ID NO: 8672 - DNA, 23 bp, Homo sapiens
gggaaggtatccaggcgaggtgg

SEQ ID NO: 8673 - DNA, 23 bp, Homo sapiens
acaattaccagccatactaaagg

SEQ ID NO: 8674 - DNA, 23 bp, Homo sapiens
agtgggcagaacagcatgggtgg

SEQ ID NO: 8675 - DNA, 23 bp, Homo sapiens
tggagttttcctgtaaaacttgg

SEQ ID NO: 8676 - DNA, 23 bp, Homo sapiens
gctccttctctacctaagcaagg

SEQ ID NO: 8677 - DNA, 23 bp, Homo sapiens
tgagtggaggtggatggcgtggg

SEQ ID NO: 8678 - DNA, 23 bp, Homo sapiens
aatactgtgcattctgtatctgg

SEQ ID NO: 8679 - DNA, 23 bp, Homo sapiens
aagcagtatgcagatgttgaagg

SEQ ID NO: 8680 - DNA, 23 bp, Homo sapiens
gctcagcacgcctcctaattagg

SEQ ID NO: 8681 - DNA, 23 bp, Homo sapiens
aagcttcaatgtatagggattgg

SEQ ID NO: 8682 - DNA, 23 bp, Homo sapiens
caattcgaacgtcaatctctcgg

SEQ ID NO: 8683 - DNA, 23 bp, Homo sapiens
aggatacttatgggcaacagtgg

SEQ ID NO: 8684 - DNA, 23 bp, Homo sapiens
tggagtcagcattatcaccaagg

SEQ ID NO: 8685 - DNA, 23 bp, Homo sapiens
tactccgggaacacacagggtgg

SEQ ID NO: 8686 - DNA, 23 bp, Homo sapiens
actacgggtaccaagggtatcgg

SEQ ID NO: 8687 - DNA, 23 bp, Homo sapiens
ccagcaacggctggctctgaggg

SEQ ID NO: 8688 - DNA, 23 bp, Homo sapiens
aagctactagaatgcagctaagg

SEQ ID NO: 8689 - DNA, 23 bp, Homo sapiens
atgcattgccattttcacatagg

SEQ ID NO: 8690 - DNA, 23 bp, Homo sapiens
aagctgggcaccgataactaggg

SEQ ID NO: 8691 - DNA, 23 bp, Homo sapiens
gctgaggctgcgccctgagccgg

SEQ ID NO: 8692 - DNA, 23 bp, Homo sapiens
gtgatcatacaagactgagtggg

SEQ ID NO: 8693 - DNA, 23 bp, Homo sapiens
agagagatttcttctggtgttgg

SEQ ID NO: 8694 - DNA, 23 bp, Homo sapiens
ggtctgtcagtgcttgtcagtgg

SEQ ID NO: 8695 - DNA, 23 bp, Homo sapiens
acaacttctctaccttgctgtgg

SEQ ID NO: 8696 - DNA, 23 bp, Homo sapiens
aagtaatcgaaagccaagcacgg

SEQ ID NO: 8697 - DNA, 23 bp, Homo sapiens
tgcagatccgtcacagactaagg

SEQ ID NO: 8698 - DNA, 23 bp, Homo sapiens
gtcaagagtcagtgccaaaaagg

SEQ ID NO: 8699 - DNA, 23 bp, Homo sapiens
ttagggatgaagaccttcactgg

SEQ ID NO: 8700 - DNA, 23 bp, Homo sapiens
ggagccggtgggcttctcagtgg

SEQ ID NO: 8701 - DNA, 23 bp, Homo sapiens
ctgactacctcccactgaggcgg

SEQ ID NO: 8702 - DNA, 23 bp, Homo sapiens
ctccagcgcagacttttgactgg

SEQ ID NO: 8703 - DNA, 23 bp, Homo sapiens
taaagttggctgtgagctcccgg

SEQ ID NO: 8704 - DNA, 23 bp, Homo sapiens
tccagccgctggagtcttagagg

SEQ ID NO: 8705 - DNA, 23 bp, Homo sapiens
aatctggttccagaacaggaggg

SEQ ID NO: 8706 - DNA, 23 bp, Homo sapiens
cagatgctgcaagtcgattgtgg

SEQ ID NO: 8707 - DNA, 23 bp, Homo sapiens
agccccaagcccactatcacagg

SEQ ID NO: 8708 - DNA, 23 bp, Homo sapiens
tctagaagattatatggaggagg

SEQ ID NO: 8709 - DNA, 23 bp, Homo sapiens
aacgctcagatactcagggacgg

SEQ ID NO: 8710 - DNA, 23 bp, Homo sapiens
gaggactcagaggcaaaggcggg

SEQ ID NO: 8711 - DNA, 23 bp, Homo sapiens
ggaagacgaggaggaatgagggg

SEQ ID NO: 8712 - DNA, 23 bp, Homo sapiens
ggcatcactcgtcttttgctcgg

SEQ ID NO: 8713 - DNA, 23 bp, Homo sapiens
gtggctaggttcagttcaggagg

SEQ ID NO: 8714 - DNA, 23 bp, Homo sapiens
caggcaaggagatctcttaaggg

SEQ ID NO: 8715 - DNA, 23 bp, Homo sapiens
aaacaggttagggaaactgcagg

SEQ ID NO: 8716 - DNA, 23 bp, Homo sapiens
cgttcgccctttcccatcacagg

SEQ ID NO: 8717 - DNA, 23 bp, Homo sapiens
tcgtatataaagtgtgggggagg

SEQ ID NO: 8718 - DNA, 23 bp, Homo sapiens
cctctgggcgggctcagggctgg

SEQ ID NO: 8719 - DNA, 23 bp, Homo sapiens
ccctttccagcaccttcactcgg

SEQ ID NO: 8720 - DNA, 23 bp, Homo sapiens
aggaggaagaggaagagtgaggg

SEQ ID NO: 8721 - DNA, 23 bp, Homo sapiens
gcagaagggcgacaagaagtagg

SEQ ID NO: 8722 - DNA, 23 bp, Homo sapiens
ttttcttcattttcatccgccgg

SEQ ID NO: 8723 - DNA, 23 bp, Homo sapiens
taaaattggaggtcagttcccgg

SEQ ID NO: 8724 - DNA, 23 bp, Homo sapiens
cggtctgcaggttacagcagagg

SEQ ID NO: 8725 - DNA, 23 bp, Homo sapiens
caagctctctccttcttttaagg

SEQ ID NO: 8726 - DNA, 23 bp, Homo sapiens
gcagcgggtgggtggtcaggtgg

SEQ ID NO: 8727 - DNA, 23 bp, Homo sapiens
aacgggcagaggacattaccagg

SEQ ID NO: 8728 - DNA, 23 bp, Homo sapiens
aaagcaaagaggctctttagagg

SEQ ID NO: 8729 - DNA, 23 bp, Homo sapiens
gagaagcagaaagagtgaccagg

SEQ ID NO: 8730 - DNA, 23 bp, Homo sapiens
ggaggaaaaggaagaaaacaagg

SEQ ID NO: 8731 - DNA, 23 bp, Homo sapiens
ggtttaggactgctccttgtcgg

SEQ ID NO: 8732 - DNA, 23 bp, Homo sapiens
cccaagtaccggcctcacgaagg

SEQ ID NO: 8733 - DNA, 23 bp, Homo sapiens
cgccaacctcacgttttcttagg

SEQ ID NO: 8734 - DNA, 23 bp, Homo sapiens
ttcctggagctctcaaaataagg

SEQ ID NO: 8735 - DNA, 23 bp, Homo sapiens
ggtgcttcgggagcaggcgctgg

SEQ ID NO: 8736 - DNA, 23 bp, Homo sapiens
aaagatactgtctcctgatgtgg

SEQ ID NO: 8737 - DNA, 23 bp, Homo sapiens
ccaaactgacgcatctgtagcgg

SEQ ID NO: 8738 - DNA, 23 bp, Homo sapiens
ccagggtccccacttctataagg

SEQ ID NO: 8739 - DNA, 23 bp, Homo sapiens
aagttaatttgtcaggccttcgg

SEQ ID NO: 8740 - DNA, 23 bp, Homo sapiens
tgccccaaaggagactgacccgg

SEQ ID NO: 8741 - DNA, 23 bp, Homo sapiens
cttgcattagttctcagctatgg

SEQ ID NO: 8742 - DNA, 23 bp, Homo sapiens
cactctgaaagacttcttcatgg

SEQ ID NO: 8743 - DNA, 23 bp, Homo sapiens
cagcgcctcccagttctgagagg

SEQ ID NO: 8744 - DNA, 23 bp, Homo sapiens
gccgctcgctcagaactgactgg

SEQ ID NO: 8745 - DNA, 23 bp, Homo sapiens
acactgcagcagcaacacaatgg

SEQ ID NO: 8746 - DNA, 23 bp, Homo sapiens
ggtgggcggggcttacatgccgg

SEQ ID NO: 8747 - DNA, 23 bp, Homo sapiens
gccaggagccaggaagcctaagg

SEQ ID NO: 8748 - DNA, 23 bp, Homo sapiens
accttactcatgcagcaagttgg

SEQ ID NO: 8749 - DNA, 23 bp, Homo sapiens
atcaatccattggcaatcaatgg

SEQ ID NO: 8750 - DNA, 23 bp, Homo sapiens
aacatggatcagctagagtttgg

SEQ ID NO: 8751 - DNA, 23 bp, Homo sapiens
catggtgacccagctctgaccgg

SEQ ID NO: 8752 - DNA, 23 bp, Homo sapiens
attccagacaagtttgttgtagg

SEQ ID NO: 8753 - DNA, 23 bp, Homo sapiens
gaggaccggaggaaagcaggagg

SEQ ID NO: 8754 - DNA, 23 bp, Homo sapiens
cggccaccttggcctagagcagg

SEQ ID NO: 8755 - DNA, 23 bp, Homo sapiens
ggtacctgcactcaagccttagg

SEQ ID NO: 8756 - DNA, 23 bp, Homo sapiens
cgactgcaatagagaagatatgg

SEQ ID NO: 8757 - DNA, 23 bp, Homo sapiens
aaaggcagagcttcctttgctgg

SEQ ID NO: 8758 - DNA, 23 bp, Homo sapiens
gcagaagctgctgaagcacgggg

SEQ ID NO: 8759 - DNA, 23 bp, Homo sapiens
ggaaaacagcagcttctaagagg

SEQ ID NO: 8760 - DNA, 23 bp, Homo sapiens
ctggtcccagcaggcctagtggg

SEQ ID NO: 8761 - DNA, 23 bp, Homo sapiens
gatgcctgaagggtagtcatagg

SEQ ID NO: 8762 - DNA, 23 bp, Homo sapiens
tcagatgcaagcagcaactttgg

SEQ ID NO: 8763 - DNA, 23 bp, Homo sapiens
cccaaagatgtcaatactgtggg

SEQ ID NO: 8764 - DNA, 23 bp, Homo sapiens
tgagtgtgaggatagcttatcgg

SEQ ID NO: 8765 - DNA, 23 bp, Homo sapiens
cctgggctgcactcactgagggg

SEQ ID NO: 8766 - DNA, 23 bp, Homo sapiens
attacaggaggccaaatagaggg

SEQ ID NO: 8767 - DNA, 23 bp, Homo sapiens
acacttgcagctcatgcagccgg

SEQ ID NO: 8768 - DNA, 23 bp, Homo sapiens
cgaggggccgctgggtcacatgg

SEQ ID NO: 8769 - DNA, 23 bp, Homo sapiens
ttcctgggcttgtttccaaaagg

SEQ ID NO: 8770 - DNA, 23 bp, Homo sapiens
tggccagaagcaagcgggaaagg

SEQ ID NO: 8771 - DNA, 23 bp, Homo sapiens
agcagttatttcagctgtagtgg

SEQ ID NO: 8772 - DNA, 23 bp, Homo sapiens
ccaaaccaataactgcctgaagg

SEQ ID NO: 8773 - DNA, 23 bp, Homo sapiens
gagcgactgggtcagggttccgg

SEQ ID NO: 8774 - DNA, 23 bp, Homo sapiens
catccccgccacgctcgctgagg

SEQ ID NO: 8775 - DNA, 23 bp, Homo sapiens
gtccagggaagttcaagagtggg

SEQ ID NO: 8776 - DNA, 23 bp, Homo sapiens
ttctgcatattcgctcctaaggg

SEQ ID NO: 8777 - DNA, 23 bp, Homo sapiens
ctagggctattacctgtctgtgg

SEQ ID NO: 8778 - DNA, 23 bp, Homo sapiens
tccaattcccaccacatgccagg

SEQ ID NO: 8779 - DNA, 23 bp, Homo sapiens
ggagcactgctggaagtgagtgg

SEQ ID NO: 8780 - DNA, 23 bp, Homo sapiens
ctctaccatcacaacacagtcgg

SEQ ID NO: 8781 - DNA, 23 bp, Homo sapiens
ccaggagttcaaaaccactctgg

SEQ ID NO: 8782 - DNA, 23 bp, Homo sapiens
atgaatatgtccaagagcagagg

SEQ ID NO: 8783 - DNA, 23 bp, Homo sapiens
cagcatggaagggtcagaagagg

SEQ ID NO: 8784 - DNA, 23 bp, Homo sapiens
ccttatactcagttcgacttagg

SEQ ID NO: 8785 - DNA, 23 bp, Homo sapiens
atagctccgaatgctggtagggg

SEQ ID NO: 8786 - DNA, 23 bp, Homo sapiens
ttgttggcagaacatttgactgg

SEQ ID NO: 8787 - DNA, 23 bp, Homo sapiens
cgttgggcaggacttcaggtggg

SEQ ID NO: 8788 - DNA, 23 bp, Homo sapiens
gggcacgactttggctgggatgg

SEQ ID NO: 8789 - DNA, 23 bp, Homo sapiens
gaccgggcacgactttggctggg

SEQ ID NO: 8790 - DNA, 23 bp, Homo sapiens
caggaagagggtgataaatgagg

SEQ ID NO: 8791 - DNA, 23 bp, Homo sapiens
tcactgggaggacattgaactgg

SEQ ID NO: 8792 - DNA, 23 bp, Homo sapiens
ggacttcggctggggctgagcgg

SEQ ID NO: 8793 - DNA, 23 bp, Homo sapiens
acatcattgagaagtggtagtgg

SEQ ID NO: 8794 - DNA, 23 bp, Homo sapiens
tgtagagaaatggcgttaaatgg

SEQ ID NO: 8795 - DNA, 23 bp, Homo sapiens
acaacagccaggtggtgagatgg

SEQ ID NO: 8796 - DNA, 23 bp, Homo sapiens
ctgccacgcaaaagagttgaagg

SEQ ID NO: 8797 - DNA, 23 bp, Homo sapiens
aaggacttaatggtgcaagctgg

SEQ ID NO: 8798 - DNA, 23 bp, Homo sapiens
agatgactttgaagaagccaagg

SEQ ID NO: 8799 - DNA, 23 bp, Homo sapiens
ctcctggcccccctgagcagagg

SEQ ID NO: 8800 - DNA, 23 bp, Homo sapiens
tcgttgagtagagaaattccagg

SEQ ID NO: 8801 - DNA, 23 bp, Homo sapiens
tcacagagacacccctgagaggg

SEQ ID NO: 8802 - DNA, 23 bp, Homo sapiens
agcagtcacgtcatcaatcatgg

SEQ ID NO: 8803 - DNA, 23 bp, Homo sapiens
ccccggtgctcaggctgccgcgg

SEQ ID NO: 8804 - DNA, 23 bp, Homo sapiens
gcccttccccagcagtggctcgg

SEQ ID NO: 8805 - DNA, 23 bp, Homo sapiens
ctccggccgccccgcagtaaagg

SEQ ID NO: 8806 - DNA, 23 bp, Homo sapiens
cattcgtatgcagccttgaaggg

SEQ ID NO: 8807 - DNA, 23 bp, Homo sapiens
gatccttcctgagcgtttcctgg

SEQ ID NO: 8808 - DNA, 23 bp, Homo sapiens
taatctcaaacctgccttcttgg

SEQ ID NO: 8809 - DNA, 23 bp, Homo sapiens
attcaatttgaagcagtggttgg

SEQ ID NO: 8810 - DNA, 23 bp, Homo sapiens
agaaatgagagaaatcaggaagg

SEQ ID NO: 8811 - DNA, 23 bp, Homo sapiens
gagggcttccattgcctaggtgg

SEQ ID NO: 8812 - DNA, 23 bp, Homo sapiens
aacaccaaggtcaggtagccagg

SEQ ID NO: 8813 - DNA, 23 bp, Homo sapiens
agactacgccaagctctgaaggg

SEQ ID NO: 8814 - DNA, 23 bp, Homo sapiens
ccagttttctttagactgcctgg

SEQ ID NO: 8815 - DNA, 23 bp, Homo sapiens
tatcctggtaaagaagctgtggg

SEQ ID NO: 8816 - DNA, 23 bp, Homo sapiens
cctccaaggaacttaagcaaagg

SEQ ID NO: 8817 - DNA, 23 bp, Homo sapiens
gataatcaggccaggctcagtgg

SEQ ID NO: 8818 - DNA, 23 bp, Homo sapiens
gggacctcagtggaagtcactgg

SEQ ID NO: 8819 - DNA, 23 bp, Homo sapiens
atccttaaatcactgagtcttgg

SEQ ID NO: 8820 - DNA, 23 bp, Homo sapiens
gagcagcgggcaaccctgatggg

SEQ ID NO: 8821 - DNA, 23 bp, Homo sapiens
ggccccagccccaccgtcactgg

SEQ ID NO: 8822 - DNA, 23 bp, Homo sapiens
catccagactcaggctgtgcagg

SEQ ID NO: 8823 - DNA, 23 bp, Homo sapiens
agatgaatgccagactgtgaagg

SEQ ID NO: 8824 - DNA, 23 bp, Homo sapiens
aggaccccactgtctcctagagg

SEQ ID NO: 8825 - DNA, 23 bp, Homo sapiens
agtggcatatcactatccagagg

SEQ ID NO: 8826 - DNA, 23 bp, Homo sapiens
ctttgactatgtgctgaaacagg

SEQ ID NO: 8827 - DNA, 23 bp, Homo sapiens
cactctggagcataatgtgtagg

SEQ ID NO: 8828 - DNA, 23 bp, Homo sapiens
tcagaggcgcggggtcttagggg

SEQ ID NO: 8829 - DNA, 23 bp, Homo sapiens
gcaggagcgctttccaaaggagg

SEQ ID NO: 8830 - DNA, 23 bp, Homo sapiens
cgcagaccagagcacatagaggg

SEQ ID NO: 8831 - DNA, 23 bp, Homo sapiens
gacgatgaggaggagtaggaagg

SEQ ID NO: 8832 - DNA, 23 bp, Homo sapiens
tgagccctctgacgatgaggagg

SEQ ID NO: 8833 - DNA, 23 bp, Homo sapiens
ttctttctcttctgacagaaagg

SEQ ID NO: 8834 - DNA, 23 bp, Homo sapiens
atggcagatcagttgtaattagg

SEQ ID NO: 8835 - DNA, 23 bp, Homo sapiens
attctgttcatctctgctgacgg

SEQ ID NO: 8836 - DNA, 23 bp, Homo sapiens
cctgttctctagcagtacccagg

SEQ ID NO: 8837 - DNA, 23 bp, Homo sapiens
agatgacgacacatcacgcatgg

SEQ ID NO: 8838 - DNA, 23 bp, Homo sapiens
tcgcatggaagaagtcgattagg

SEQ ID NO: 8839 - DNA, 23 bp, Homo sapiens
tgaagaagaagaaacagcaaagg

SEQ ID NO: 8840 - DNA, 23 bp, Homo sapiens
cttcgaagagtgtcaaagttggg

SEQ ID NO: 8841 - DNA, 23 bp, Homo sapiens
cgcgccggcgcgccctcagttgg

SEQ ID NO: 8842 - DNA, 23 bp, Homo sapiens
ctgcagaattcagttgaagttgg

SEQ ID NO: 8843 - DNA, 23 bp, Homo sapiens
acatgcacagatcaagaaactgg

SEQ ID NO: 8844 - DNA, 23 bp, Homo sapiens
tgtaattggttcctagcttttgg

SEQ ID NO: 8845 - DNA, 23 bp, Homo sapiens
ccattgaggaggtagattagggg

SEQ ID NO: 8846 - DNA, 23 bp, Homo sapiens
ccattgaggaggtggattagggg

SEQ ID NO: 8847 - DNA, 23 bp, Homo sapiens
ttcttcaattgtggggcctgtgg

SEQ ID NO: 8848 - DNA, 23 bp, Homo sapiens
gggacccaccatcgaagaagtgg

SEQ ID NO: 8849 - DNA, 23 bp, Homo sapiens
agacaagaagcttcctgaaatgg

SEQ ID NO: 8850 - DNA, 23 bp, Homo sapiens
atcctctggagagatggaagtgg

SEQ ID NO: 8851 - DNA, 23 bp, Homo sapiens
ccctcccccaactggtgaagagg

SEQ ID NO: 8852 - DNA, 23 bp, Homo sapiens
cattgaggaggttgattgaatgg

SEQ ID NO: 8853 - DNA, 23 bp, Homo sapiens
ctcagggcccaccattgaagagg

SEQ ID NO: 8854 - DNA, 23 bp, Homo sapiens
acaaaaggaagatcaaaaggagg

SEQ ID NO: 8855 - DNA, 23 bp, Homo sapiens
atccgggctaaggctttacttgg

SEQ ID NO: 8856 - DNA, 23 bp, Homo sapiens
gtgcatagcgtttctgcagaagg

SEQ ID NO: 8857 - DNA, 23 bp, Homo sapiens
tggcaatcagggctcaactatgg

SEQ ID NO: 8858 - DNA, 23 bp, Homo sapiens
cgatgtcacttagtcccaactgg

SEQ ID NO: 8859 - DNA, 23 bp, Homo sapiens
ccagccgcagccaagtaggaggg

SEQ ID NO: 8860 - DNA, 23 bp, Homo sapiens
ctcagattttgatctccgtccgg

SEQ ID NO: 8861 - DNA, 23 bp, Homo sapiens
agtactggcatctcaggtacagg

SEQ ID NO: 8862 - DNA, 23 bp, Homo sapiens
acatcgcgtcgtttgtttaccgg

SEQ ID NO: 8863 - DNA, 23 bp, Homo sapiens
gtggcacaacttttgatacaagg

SEQ ID NO: 8864 - DNA, 23 bp, Homo sapiens
cagcggacgacagcatggatcgg

SEQ ID NO: 8865 - DNA, 23 bp, Homo sapiens
atgggaggtggtatgggaggtgg

SEQ ID NO: 8866 - DNA, 23 bp, Homo sapiens
gttcttctcccagaatatggagg

SEQ ID NO: 8867 - DNA, 23 bp, Homo sapiens
ggggcaggcaggtgcctacgagg

SEQ ID NO: 8868 - DNA, 23 bp, Homo sapiens
gctgaacctccacatcagaatgg

SEQ ID NO: 8869 - DNA, 23 bp, Homo sapiens
aaactggaaagaactccaaatgg

SEQ ID NO: 8870 - DNA, 23 bp, Homo sapiens
catgacctggggaaagcgcatgg

SEQ ID NO: 8871 - DNA, 23 bp, Homo sapiens
tcacatttaagcattgcaacagg

SEQ ID NO: 8872 - DNA, 23 bp, Homo sapiens
gagaataaagctgctgccagtgg

SEQ ID NO: 8873 - DNA, 23 bp, Homo sapiens
tttccattttatggggactatgg

SEQ ID NO: 8874 - DNA, 23 bp, Homo sapiens
gaaaagcatcattcacatcgagg

SEQ ID NO: 8875 - DNA, 23 bp, Homo sapiens
ggctactcctccgtcatcactgg

SEQ ID NO: 8876 - DNA, 23 bp, Homo sapiens
tgcttgtttaaagtcctcattgg

SEQ ID NO: 8877 - DNA, 23 bp, Homo sapiens
catcaccgaataagactaggagg

SEQ ID NO: 8878 - DNA, 23 bp, Homo sapiens
ttacagtctaagtatgctctcgg

SEQ ID NO: 8879 - DNA, 23 bp, Homo sapiens
atcgacatcgcacaagcttttgg

SEQ ID NO: 8880 - DNA, 23 bp, Homo sapiens
aaaggtgagctgtgtgtgatagg

SEQ ID NO: 8881 - DNA, 23 bp, Homo sapiens
cttctcctcactgaaaatgaagg

SEQ ID NO: 8882 - DNA, 23 bp, Homo sapiens
cctccagtgtggttagcgaaagg

SEQ ID NO: 8883 - DNA, 23 bp, Homo sapiens
atctggcagtacgcttgagtggg

SEQ ID NO: 8884 - DNA, 23 bp, Homo sapiens
tccctctgggcactgtggggcgg

SEQ ID NO: 8885 - DNA, 23 bp, Homo sapiens
cattgtcctctggaacacctagg

SEQ ID NO: 8886 - DNA, 23 bp, Homo sapiens
tgcctctggaacacctaggcagg

SEQ ID NO: 8887 - DNA, 23 bp, Homo sapiens
tgctcagcccagtgacacttagg

SEQ ID NO: 8888 - DNA, 23 bp, Homo sapiens
agaaagtcatgttttagggaagg

SEQ ID NO: 8889 - DNA, 23 bp, Homo sapiens
gagcactttcagagttagacagg

SEQ ID NO: 8890 - DNA, 23 bp, Homo sapiens
tacatgtgtggatccattaatgg

SEQ ID NO: 8891 - DNA, 23 bp, Homo sapiens
tcaatcagaagcatgattccagg

SEQ ID NO: 8892 - DNA, 23 bp, Homo sapiens
tcttttctaggcaacactgaggg

SEQ ID NO: 8893 - DNA, 23 bp, Homo sapiens
ggcatccccacgaactgacccgg

SEQ ID NO: 8894 - DNA, 23 bp, Homo sapiens
aatctccagaccatcacaattgg

SEQ ID NO: 8895 - DNA, 23 bp, Homo sapiens
agcacaaactcaggtctctctgg

SEQ ID NO: 8896 - DNA, 23 bp, Homo sapiens
cagctcatgcctctgcctatggg

SEQ ID NO: 8897 - DNA, 23 bp, Homo sapiens
tctattcattctgtgacctcagg

SEQ ID NO: 8898 - DNA, 23 bp, Homo sapiens
acctgaggtggtcatgtgagggg

SEQ ID NO: 8899 - DNA, 23 bp, Homo sapiens
ctctcaatgaactgccagtgagg

SEQ ID NO: 8900 - DNA, 23 bp, Homo sapiens
ttgtttcaggtatgactgtcagg

SEQ ID NO: 8901 - DNA, 23 bp, Homo sapiens
ctcccaccatggcgctcagcagg

SEQ ID NO: 8902 - DNA, 23 bp, Homo sapiens
gtcaagacccagtgctaacttgg

SEQ ID NO: 8903 - DNA, 23 bp, Homo sapiens
acagggtgctaggacagcgcagg

SEQ ID NO: 8904 - DNA, 23 bp, Homo sapiens
aagctggctgaatttttacaagg

SEQ ID NO: 8905 - DNA, 23 bp, Homo sapiens
ggctttgggctggcctaataagg

SEQ ID NO: 8906 - DNA, 23 bp, Homo sapiens
ttgcgacagcatggacttcttgg

SEQ ID NO: 8907 - DNA, 23 bp, Homo sapiens
gcggaagagcatgtggtgattgg

SEQ ID NO: 8908 - DNA, 23 bp, Homo sapiens
ctaggcaggagacccctacaagg

SEQ ID NO: 8909 - DNA, 23 bp, Homo sapiens
tggctttatactgcttctttagg

SEQ ID NO: 8910 - DNA, 23 bp, Homo sapiens
caaagtgtcattagtgaaccagg

SEQ ID NO: 8911 - DNA, 23 bp, Homo sapiens
gtaaccctggttaccactaaagg

SEQ ID NO: 8912 - DNA, 23 bp, Homo sapiens
tctgctactcccagggtaagggg

SEQ ID NO: 8913 - DNA, 23 bp, Homo sapiens
ttgggggcacattttaggtaagg

SEQ ID NO: 8914 - DNA, 23 bp, Homo sapiens
gaaggctacaaaggcttcgtggg

SEQ ID NO: 8915 - DNA, 23 bp, Homo sapiens
ggtggtgtgcgggccctcactgg

SEQ ID NO: 8916 - DNA, 23 bp, Homo sapiens
acatggagatctcagtcacatgg

SEQ ID NO: 8917 - DNA, 23 bp, Homo sapiens
tgtcattcatctgttcaaggagg

SEQ ID NO: 8918 - DNA, 23 bp, Homo sapiens
ttaagaaggagaaagagggaagg

SEQ ID NO: 8919 - DNA, 23 bp, Homo sapiens
tatagttcgtcgttcttcaaagg

SEQ ID NO: 8920 - DNA, 23 bp, Homo sapiens
ttgagaaagcacgcatcagttgg

SEQ ID NO: 8921 - DNA, 23 bp, Homo sapiens
cagtcttcagtcattcttcctgg

SEQ ID NO: 8922 - DNA, 23 bp, Homo sapiens
ggtctcctgtgattggctaatgg

SEQ ID NO: 8923 - DNA, 23 bp, Homo sapiens
agagttacattgtcctctaaagg

SEQ ID NO: 8924 - DNA, 23 bp, Homo sapiens
tgctagaagtctgctgttgttgg

SEQ ID NO: 8925 - DNA, 23 bp, Homo sapiens
cgatgtgcagaagttgtcagtgg

SEQ ID NO: 8926 - DNA, 23 bp, Homo sapiens
agccaaggcttcggactacttgg

SEQ ID NO: 8927 - DNA, 23 bp, Homo sapiens
atcccaggctggagcttcactgg

SEQ ID NO: 8928 - DNA, 23 bp, Homo sapiens
gtacctatgtggaataagcatgg

SEQ ID NO: 8929 - DNA, 23 bp, Homo sapiens
tctcaaatcctgatgctgttggg

SEQ ID NO: 8930 - DNA, 23 bp, Homo sapiens
cccagacaccttaaagcaaatgg

SEQ ID NO: 8931 - DNA, 23 bp, Homo sapiens
ctttcaaacccagatgctattgg

SEQ ID NO: 8932 - DNA, 23 bp, Homo sapiens
gtcccgggataggttcagggagg

SEQ ID NO: 8933 - DNA, 23 bp, Homo sapiens
ccactcatggttgctatggccgg

SEQ ID NO: 8934 - DNA, 23 bp, Homo sapiens
atcccagcgtcactcagctctgg

SEQ ID NO: 8935 - DNA, 23 bp, Homo sapiens
atgaagtcccaggcgtaaagggg

SEQ ID NO: 8936 - DNA, 23 bp, Homo sapiens
ggggaaatggccatacatggtgg

SEQ ID NO: 8937 - DNA, 23 bp, Homo sapiens
cttcgccatacagctgacatcgg

SEQ ID NO: 8938 - DNA, 23 bp, Homo sapiens
acagaggagcttggctgacctgg

SEQ ID NO: 8939 - DNA, 23 bp, Homo sapiens
gcaagttgaaactgaaggagtgg

SEQ ID NO: 8940 - DNA, 23 bp, Homo sapiens
aacaagtacattccccttagggg

SEQ ID NO: 8941 - DNA, 23 bp, Homo sapiens
gggcttccaagtacgcatctcgg

SEQ ID NO: 8942 - DNA, 23 bp, Homo sapiens
ccggggccactgcccgtcacagg

SEQ ID NO: 8943 - DNA, 23 bp, Homo sapiens
acagatgtgaccctataatatgg

SEQ ID NO: 8944 - DNA, 23 bp, Homo sapiens
cagtcagtcacgagagcagaagg

SEQ ID NO: 8945 - DNA, 23 bp, Homo sapiens
cggtgagctccggtcaaacgtgg

SEQ ID NO: 8946 - DNA, 23 bp, Homo sapiens
tcggtataaggatgatctagtgg

SEQ ID NO: 8947 - DNA, 23 bp, Homo sapiens
cacaagatgcgatcgtccgcagg

SEQ ID NO: 8948 - DNA, 23 bp, Homo sapiens
aatgacagcaaagcactgtgtgg

SEQ ID NO: 8949 - DNA, 23 bp, Homo sapiens
aggagcttttgccactgactcgg

SEQ ID NO: 8950 - DNA, 23 bp, Homo sapiens
acctggacagcgcggctcagcgg

SEQ ID NO: 8951 - DNA, 23 bp, Homo sapiens
gcagccatgaagttaatatgtgg

SEQ ID NO: 8952 - DNA, 23 bp, Homo sapiens
cttgaagatcaaactagctcagg

SEQ ID NO: 8953 - DNA, 23 bp, Homo sapiens
agccctgggcaggcagtaggggg

SEQ ID NO: 8954 - DNA, 23 bp, Homo sapiens
aaaatgctcagacttcacagagg

SEQ ID NO: 8955 - DNA, 23 bp, Homo sapiens
tcggtcacctgcagactaaaggg

SEQ ID NO: 8956 - DNA, 23 bp, Homo sapiens
agcatagccacccatgtcagagg

SEQ ID NO: 8957 - DNA, 23 bp, Homo sapiens
ctgcaagttctgcattcagatgg

SEQ ID NO: 8958 - DNA, 23 bp, Homo sapiens
tgggtatggacagggcctatggg

SEQ ID NO: 8959 - DNA, 23 bp, Homo sapiens
cagtgcatgaggcgggctacagg

SEQ ID NO: 8960 - DNA, 23 bp, Homo sapiens
cgggccgtggaggcctaggctgg

SEQ ID NO: 8961 - DNA, 23 bp, Homo sapiens
cttctgaaaaaagcagccagtgg

SEQ ID NO: 8962 - DNA, 23 bp, Homo sapiens
caaaatacacagagtgtgagagg

SEQ ID NO: 8963 - DNA, 23 bp, Homo sapiens
ataaagttttctggagctgctgg

SEQ ID NO: 8964 - DNA, 23 bp, Homo sapiens
gagaaatcccttttgaaggaagg

SEQ ID NO: 8965 - DNA, 23 bp, Homo sapiens
ccttcacccacgtggttaggagg

SEQ ID NO: 8966 - DNA, 23 bp, Homo sapiens
aaactcaaggcatcaacaactgg

SEQ ID NO: 8967 - DNA, 23 bp, Homo sapiens
atcaggtatttgtcctcatgagg

SEQ ID NO: 8968 - DNA, 23 bp, Homo sapiens
gcacaggctcatggattgcccgg

SEQ ID NO: 8969 - DNA, 23 bp, Homo sapiens
cgccgctcggggtcctcagaagg

SEQ ID NO: 8970 - DNA, 23 bp, Homo sapiens
tgcggggagtcacagttagaagg

SEQ ID NO: 8971 - DNA, 23 bp, Homo sapiens
cggttcttacagatcgaataagg

SEQ ID NO: 8972 - DNA, 23 bp, Homo sapiens
aggggggccaagggctcagaagg

SEQ ID NO: 8973 - DNA, 23 bp, Homo sapiens
tgccctcgggggtccctagaagg

SEQ ID NO: 8974 - DNA, 23 bp, Homo sapiens
ggaggcaggtctctatctcatgg

SEQ ID NO: 8975 - DNA, 23 bp, Homo sapiens
cctcagtcatcagctgaccatgg

SEQ ID NO: 8976 - DNA, 23 bp, Homo sapiens
actcaatcctgattcaagtatgg

SEQ ID NO: 8977 - DNA, 23 bp, Homo sapiens
ccattgcggctgtcattgcgagg

SEQ ID NO: 8978 - DNA, 23 bp, Homo sapiens
ggctcctcgctgggtcaggatgg

SEQ ID NO: 8979 - DNA, 23 bp, Homo sapiens
gcctcagtgtggtgttcagctgg

SEQ ID NO: 8980 - DNA, 23 bp, Homo sapiens
actcaagtcagagaaacatgagg

SEQ ID NO: 8981 - DNA, 23 bp, Homo sapiens
ggagtgtttgcttcaagtgatgg

SEQ ID NO: 8982 - DNA, 23 bp, Homo sapiens
tcacctctgagtcaggctagggg

SEQ ID NO: 8983 - DNA, 23 bp, Homo sapiens
ggctgcagatgacttcttagagg

SEQ ID NO: 8984 - DNA, 23 bp, Homo sapiens
aggcaacttatctcaaatgcagg

SEQ ID NO: 8985 - DNA, 23 bp, Homo sapiens
tctcgatagtgaggaggatgagg

SEQ ID NO: 8986 - DNA, 23 bp, Homo sapiens
tcaagattgggaaatgtgatagg

SEQ ID NO: 8987 - DNA, 23 bp, Homo sapiens
ctctgtgagacaaggtccttagg

SEQ ID NO: 8988 - DNA, 23 bp, Homo sapiens
ctatgagagggctctgaggctgg

SEQ ID NO: 8989 - DNA, 23 bp, Homo sapiens
ttcagcatcaagctggaatgggg

SEQ ID NO: 8990 - DNA, 23 bp, Homo sapiens
tcagttgctctgagttagagagg

SEQ ID NO: 8991 - DNA, 23 bp, Homo sapiens
ggagctcacagagagcagtcagg

SEQ ID NO: 8992 - DNA, 23 bp, Homo sapiens
ttcatcctgttactggtattcgg

SEQ ID NO: 8993 - DNA, 23 bp, Homo sapiens
cagtgctcaagagtcccacatgg

SEQ ID NO: 8994 - DNA, 23 bp, Homo sapiens
gatgcctcctgatctatcgctgg

SEQ ID NO: 8995 - DNA, 23 bp, Homo sapiens
atgcctcctgatctatccatagg

SEQ ID NO: 8996 - DNA, 23 bp, Homo sapiens
tgacgcggactatgactgacagg

SEQ ID NO: 8997 - DNA, 23 bp, Homo sapiens
gcaagaaagattaaggaggaagg

SEQ ID NO: 8998 - DNA, 23 bp, Homo sapiens
agaaatacagcccttgtgcctgg

SEQ ID NO: 8999 - DNA, 23 bp, Homo sapiens
tcaagaaagattaaggaggaagg

SEQ ID NO: 9000 - DNA, 23 bp, Homo sapiens
gcaagtttgttgaaaacgagagg

SEQ ID NO: 9001 - DNA, 23 bp, Homo sapiens
gcaagaaaggttaaggaggaagg

SEQ ID NO: 9002 - DNA, 23 bp, Homo sapiens
atacagctcttgtgcctgggagg

SEQ ID NO: 9003 - DNA, 23 bp, Homo sapiens
aacaagtgaagaactacagcagg

SEQ ID NO: 9004 - DNA, 23 bp, Homo sapiens
aaacttaatcactggggcacagg

SEQ ID NO: 9005 - DNA, 23 bp, Homo sapiens
caccctccttccacctggccagg

SEQ ID NO: 9006 - DNA, 23 bp, Homo sapiens
tcagatgttgaccttggggatgg

SEQ ID NO: 9007 - DNA, 23 bp, Homo sapiens
ggctaggagatcttcagtttcgg

SEQ ID NO: 9008 - DNA, 23 bp, Homo sapiens
gtttagaagcccgaggtaggtgg

SEQ ID NO: 9009 - DNA, 23 bp, Homo sapiens
gcaggcaggacaaccattactgg

SEQ ID NO: 9010 - DNA, 23 bp, Homo sapiens
tgttggtctataaccaatcaagg

SEQ ID NO: 9011 - DNA, 23 bp, Homo sapiens
atgctttggttcaaagcgtttgg

SEQ ID NO: 9012 - DNA, 23 bp, Homo sapiens
aatttacagctctattcaggagg

SEQ ID NO: 9013 - DNA, 23 bp, Homo sapiens
ataaggtgtggggtgtcaggtgg

SEQ ID NO: 9014 - DNA, 23 bp, Homo sapiens
ggtgggagggtcagacacacagg

SEQ ID NO: 9015 - DNA, 23 bp, Homo sapiens
ggcggaagggtcagacacacagg

SEQ ID NO: 9016 - DNA, 23 bp, Homo sapiens
gccagagggggcggggtcagagg

SEQ ID NO: 9017 - DNA, 23 bp, Homo sapiens
atgtcgggggacagctcacctgg

SEQ ID NO: 9018 - DNA, 23 bp, Homo sapiens
aatcatttcaagatgagcccagg

SEQ ID NO: 9019 - DNA, 23 bp, Homo sapiens
cgagataagagagcagatgttgg

SEQ ID NO: 9020 - DNA, 23 bp, Homo sapiens
ttcagcaggtcctgcttcacagg

SEQ ID NO: 9021 - DNA, 23 bp, Homo sapiens
gtccccaggatgctggtcatggg

SEQ ID NO: 9022 - DNA, 23 bp, Homo sapiens
ctggggcccaggcccctcagggg

SEQ ID NO: 9023 - DNA, 23 bp, Homo sapiens
cagcttttcctttcagtagttgg

SEQ ID NO: 9024 - DNA, 23 bp, Homo sapiens
gagcaagttccgagcaccgatgg

SEQ ID NO: 9025 - DNA, 23 bp, Homo sapiens
ggccagtttcagaaaatagttgg

SEQ ID NO: 9026 - DNA, 23 bp, Homo sapiens
gtctgagagcagagacagggagg

SEQ ID NO: 9027 - DNA, 23 bp, Homo sapiens
ctgctccagctcgtcatgccagg

SEQ ID NO: 9028 - DNA, 23 bp, Homo sapiens
gtgacgggctcaggtgtgcctgg

SEQ ID NO: 9029 - DNA, 23 bp, Homo sapiens
tctaacacagtgttcaacatagg

SEQ ID NO: 9030 - DNA, 23 bp, Homo sapiens
ttgggaagtgtctcagctgaagg

SEQ ID NO: 9031 - DNA, 23 bp, Homo sapiens
atggtcttcagaaattgttctgg

SEQ ID NO: 9032 - DNA, 23 bp, Homo sapiens
ctcctctgagaaggcacggctgg

SEQ ID NO: 9033 - DNA, 23 bp, Homo sapiens
gtttcccaggctggagtgcatgg

SEQ ID NO: 9034 - DNA, 23 bp, Homo sapiens
gttattccagaaccagcaacagg

SEQ ID NO: 9035 - DNA, 23 bp, Homo sapiens
attttccatccatagttggtagg

SEQ ID NO: 9036 - DNA, 23 bp, Homo sapiens
gacttaaactcagtttccgctgg

SEQ ID NO: 9037 - DNA, 23 bp, Homo sapiens
ttgccagctttaaaatcatcagg

SEQ ID NO: 9038 - DNA, 23 bp, Homo sapiens
agccaatccagcaagagtatagg

SEQ ID NO: 9039 - DNA, 23 bp, Homo sapiens
tgtagtccgagcttctcaggagg

SEQ ID NO: 9040 - DNA, 23 bp, Homo sapiens
ttcaggagggtggggaggaccgg

SEQ ID NO: 9041 - DNA, 23 bp, Homo sapiens
aaaagagaaggaagtgctagcgg

SEQ ID NO: 9042 - DNA, 23 bp, Homo sapiens
agccaagaaaaggatcgatgagg

SEQ ID NO: 9043 - DNA, 23 bp, Homo sapiens
tatgggaaccgacagaacatggg

SEQ ID NO: 9044 - DNA, 23 bp, Homo sapiens
ggttacccagccagctcactcgg

SEQ ID NO: 9045 - DNA, 23 bp, Homo sapiens
ctctgggaagagctaggcagagg

SEQ ID NO: 9046 - DNA, 23 bp, Homo sapiens
aaacaagaactacaggatgtagg

SEQ ID NO: 9047 - DNA, 23 bp, Homo sapiens
atttgaagaacgcaagtagaggg

SEQ ID NO: 9048 - DNA, 23 bp, Homo sapiens
gctgaatgcagaggcaaaaaagg

SEQ ID NO: 9049 - DNA, 23 bp, Homo sapiens
ttcaggatccaaggatcagcagg

SEQ ID NO: 9050 - DNA, 23 bp, Homo sapiens
ttttgctcacttccgattgctgg

SEQ ID NO: 9051 - DNA, 23 bp, Homo sapiens
gtaaccaggcccaggcacggagg

SEQ ID NO: 9052 - DNA, 23 bp, Homo sapiens
gcctcacagcgcagcaagtgagg

SEQ ID NO: 9053 - DNA, 23 bp, Homo sapiens
ctcagtcaagacggaagtaaagg

SEQ ID NO: 9054 - DNA, 23 bp, Homo sapiens
tgcggagtcagatgtgtaagagg

SEQ ID NO: 9055 - DNA, 23 bp, Homo sapiens
cactttgctccctgctgaccagg

SEQ ID NO: 9056 - DNA, 23 bp, Homo sapiens
cctgggtctccagagatcagggg

SEQ ID NO: 9057 - DNA, 23 bp, Homo sapiens
ctgcggtctactgcatccgctgg

SEQ ID NO: 9058 - DNA, 23 bp, Homo sapiens
ctacaccaccaaggggaaggagg

SEQ ID NO: 9059 - DNA, 23 bp, Homo sapiens
gctgacagctttcgagagtgagg

SEQ ID NO: 9060 - DNA, 23 bp, Homo sapiens
ctcaacgttgctgctgtcgaagg

SEQ ID NO: 9061 - DNA, 23 bp, Homo sapiens
tcctgccccactgggagtagcgg

SEQ ID NO: 9062 - DNA, 23 bp, Homo sapiens
agcatcagcaaaaattacagtgg

SEQ ID NO: 9063 - DNA, 23 bp, Homo sapiens
tattctggaggtttatagctcgg

SEQ ID NO: 9064 - DNA, 23 bp, Homo sapiens
ctcccgatgaccgcatgtgatgg

SEQ ID NO: 9065 - DNA, 23 bp, Homo sapiens
cagcccggacctcggatgacagg

SEQ ID NO: 9066 - DNA, 23 bp, Homo sapiens
tactggagatgggagatgagtgg

SEQ ID NO: 9067 - DNA, 23 bp, Homo sapiens
ccatctcccggagctgtaccagg

SEQ ID NO: 9068 - DNA, 23 bp, Homo sapiens
accccagaacagtctagatgagg

SEQ ID NO: 9069 - DNA, 23 bp, Homo sapiens
cactacttccactcctgagcagg

SEQ ID NO: 9070 - DNA, 23 bp, Homo sapiens
tggctcatctggggtttgctggg

SEQ ID NO: 9071 - DNA, 23 bp, Homo sapiens
ggtgaggtgaggctaggtgctgg

SEQ ID NO: 9072 - DNA, 23 bp, Homo sapiens
gaaggagagggggacgtgaccgg

SEQ ID NO: 9073 - DNA, 23 bp, Homo sapiens
caaacgtgttgtgcatcagccgg

SEQ ID NO: 9074 - DNA, 23 bp, Homo sapiens
ggcccctgcagaatgttcatagg

SEQ ID NO: 9075 - DNA, 23 bp, Homo sapiens
gttggcttggagctcctcagagg

SEQ ID NO: 9076 - DNA, 23 bp, Homo sapiens
ggcccctacagaatgttcatagg

SEQ ID NO: 9077 - DNA, 23 bp, Homo sapiens
ctggctgtggtggagaatgtagg

SEQ ID NO: 9078 - DNA, 23 bp, Homo sapiens
aacctctcagagaatctctgtgg

SEQ ID NO: 9079 - DNA, 23 bp, Homo sapiens
gttgtcccaggtatcatggctgg

SEQ ID NO: 9080 - DNA, 23 bp, Homo sapiens
gctgcataatcactaccaagtgg

SEQ ID NO: 9081 - DNA, 23 bp, Homo sapiens
tcgggccgggtccttggtatagg

SEQ ID NO: 9082 - DNA, 23 bp, Homo sapiens
tgattctggagctgacgtgaagg

SEQ ID NO: 9083 - DNA, 23 bp, Homo sapiens
gcttggctggagctcacatgagg

SEQ ID NO: 9084 - DNA, 23 bp, Homo sapiens
aggactgacaggcagagaatagg

SEQ ID NO: 9085 - DNA, 23 bp, Homo sapiens
ccaggggccatagactaagcggg

SEQ ID NO: 9086 - DNA, 23 bp, Homo sapiens
gttgtattactgaccttctcagg

SEQ ID NO: 9087 - DNA, 23 bp, Homo sapiens
tttctatggcctttcatagttgg

SEQ ID NO: 9088 - DNA, 23 bp, Homo sapiens
tcatgaagaggcttcgaaaacgg

SEQ ID NO: 9089 - DNA, 23 bp, Homo sapiens
cagggatgttcacagcagagtgg

SEQ ID NO: 9090 - DNA, 23 bp, Homo sapiens
ggggtggagtcacagcaaagtgg

SEQ ID NO: 9091 - DNA, 23 bp, Homo sapiens
gtccggggcagggagctgaaagg

SEQ ID NO: 9092 - DNA, 23 bp, Homo sapiens
gaagaagatggaagctgatgggg

SEQ ID NO: 9093 - DNA, 23 bp, Homo sapiens
aatagtccaagctgagattaagg

SEQ ID NO: 9094 - DNA, 23 bp, Homo sapiens
tactcaagtacaggagaaaaggg

SEQ ID NO: 9095 - DNA, 23 bp, Homo sapiens
ctggagcaggcctcatgatgtgg

SEQ ID NO: 9096 - DNA, 23 bp, Homo sapiens
ccccatggagctcagacatcagg

SEQ ID NO: 9097 - DNA, 23 bp, Homo sapiens
ctgcgaggggatgaagctgctgg

SEQ ID NO: 9098 - DNA, 23 bp, Homo sapiens
gtcatggagtgcattgagtaggg

SEQ ID NO: 9099 - DNA, 23 bp, Homo sapiens
atatggggctgatgactttaggg

SEQ ID NO: 9100 - DNA, 23 bp, Homo sapiens
cgggagggctttagctcatgtgg

SEQ ID NO: 9101 - DNA, 23 bp, Homo sapiens
tgttacttcgcagatgctgctgg

SEQ ID NO: 9102 - DNA, 23 bp, Homo sapiens
tttggaatgaaaaggcctagtgg

SEQ ID NO: 9103 - DNA, 23 bp, Homo sapiens
gaccagatattcacttcagcagg

SEQ ID NO: 9104 - DNA, 23 bp, Homo sapiens
tggtcagtgaagccgacaccagg

SEQ ID NO: 9105 - DNA, 23 bp, Homo sapiens
gtccggggggagcataaggtggg

SEQ ID NO: 9106 - DNA, 23 bp, Homo sapiens
ttgcctgtcattttgcaagaggg

SEQ ID NO: 9107 - DNA, 23 bp, Homo sapiens
tcgtatcttcattgtcatgtagg

SEQ ID NO: 9108 - DNA, 23 bp, Homo sapiens
ctgcagtcaagtgagtgactcgg

SEQ ID NO: 9109 - DNA, 23 bp, Homo sapiens
tccttctcagagcctagctttgg

SEQ ID NO: 9110 - DNA, 23 bp, Homo sapiens
ctgaagactcggctgtgacccgg

SEQ ID NO: 9111 - DNA, 23 bp, Homo sapiens
agccctcctgggtcctctacagg

SEQ ID NO: 9112 - DNA, 23 bp, Homo sapiens
tcttcatgctttcagaattcggg

SEQ ID NO: 9113 - DNA, 23 bp, Homo sapiens
ggcatctgtgccctgcagttagg

SEQ ID NO: 9114 - DNA, 23 bp, Homo sapiens
acagagttgtccttggaggatgg

SEQ ID NO: 9115 - DNA, 23 bp, Homo sapiens
gagaatctcttgaatctggaagg

SEQ ID NO: 9116 - DNA, 23 bp, Homo sapiens
ggaggatggagacaggtgcaagg

SEQ ID NO: 9117 - DNA, 23 bp, Homo sapiens
cggttcaggatcttcaggcgtgg

SEQ ID NO: 9118 - DNA, 23 bp, Homo sapiens
gtctatcaggagcctgtccaagg

SEQ ID NO: 9119 - DNA, 23 bp, Homo sapiens
tgactccctcatgctctgagtgg

SEQ ID NO: 9120 - DNA, 23 bp, Homo sapiens
cgaggtggcccagtttgtaaagg

SEQ ID NO: 9121 - DNA, 23 bp, Homo sapiens
tgaagaaagcctctcagtgatgg

SEQ ID NO: 9122 - DNA, 23 bp, Homo sapiens
tggcttacgcaaaagcagaccgg

SEQ ID NO: 9123 - DNA, 23 bp, Homo sapiens
caaagaatgtgaggaactggagg

SEQ ID NO: 9124 - DNA, 23 bp, Homo sapiens
ctggtttccccgagtttcatagg

SEQ ID NO: 9125 - DNA, 23 bp, Homo sapiens
gctggacatacatgctcagtggg

SEQ ID NO: 9126 - DNA, 23 bp, Homo sapiens
gctgctggagactcctaggcagg

SEQ ID NO: 9127 - DNA, 23 bp, Homo sapiens
cccagagctcttaggccacatgg

SEQ ID NO: 9128 - DNA, 23 bp, Homo sapiens
ccaggtgattcagaagatgcagg

SEQ ID NO: 9129 - DNA, 23 bp, Homo sapiens
gcctcggcggtcacactgaacgg

SEQ ID NO: 9130 - DNA, 23 bp, Homo sapiens
cggggcaggaccggcctcagggg

SEQ ID NO: 9131 - DNA, 23 bp, Homo sapiens
catccaccatgtgcagtaagagg

SEQ ID NO: 9132 - DNA, 23 bp, Homo sapiens
cagaggggcccagtgcatgaggg

SEQ ID NO: 9133 - DNA, 23 bp, Homo sapiens
cttctcatgggtgggctacaagg

SEQ ID NO: 9134 - DNA, 23 bp, Homo sapiens
cgggacctggggcgggggacggg

SEQ ID NO: 9135 - DNA, 23 bp, Homo sapiens
gttacaaaggggcgaccgcgtgg

SEQ ID NO: 9136 - DNA, 23 bp, Homo sapiens
gcggcgcctggtgggagcgctgg

SEQ ID NO: 9137 - DNA, 23 bp, Homo sapiens
ggtggagctctgctcaacctagg

SEQ ID NO: 9138 - DNA, 23 bp, Homo sapiens
ctccctgggaaggtctaggaagg

SEQ ID NO: 9139 - DNA, 23 bp, Homo sapiens
tgcatcttattatcatgtcctgg

SEQ ID NO: 9140 - DNA, 23 bp, Homo sapiens
aatgctgggcattagttcacagg

SEQ ID NO: 9141 - DNA, 23 bp, Homo sapiens
cacagcagtccacagcagcaggg

SEQ ID NO: 9142 - DNA, 23 bp, Homo sapiens
ggtcaaggttgtgctgctgctgg

SEQ ID NO: 9143 - DNA, 23 bp, Homo sapiens
gattaagactcggaaagaacagg

SEQ ID NO: 9144 - DNA, 23 bp, Homo sapiens
ggagctcccagcctaaggaatgg

SEQ ID NO: 9145 - DNA, 23 bp, Homo sapiens
agctcgacgtctttctagcctgg

SEQ ID NO: 9146 - DNA, 23 bp, Homo sapiens
tgagactccagacctacgcctgg

SEQ ID NO: 9147 - DNA, 23 bp, Homo sapiens
ttaggaagacacaaattgcatgg

SEQ ID NO: 9148 - DNA, 23 bp, Homo sapiens
tactttgaacagagctggtaggg

SEQ ID NO: 9149 - DNA, 23 bp, Homo sapiens
aggacttgtgtgcccttatatgg

SEQ ID NO: 9150 - DNA, 23 bp, Homo sapiens
cacgtgcctctcgggtagcatgg

SEQ ID NO: 9151 - DNA, 23 bp, Homo sapiens
cagatggtctgactgtgctatgg

SEQ ID NO: 9152 - DNA, 23 bp, Homo sapiens
gaggggccacgccagtaagtggg

SEQ ID NO: 9153 - DNA, 23 bp, Homo sapiens
aagcagaaaggtaatagatgcgg

SEQ ID NO: 9154 - DNA, 23 bp, Homo sapiens
ccaccacacacagtaattatagg

SEQ ID NO: 9155 - DNA, 23 bp, Homo sapiens
cggtctagcagtgatgagcaggg

SEQ ID NO: 9156 - DNA, 23 bp, Homo sapiens
ccagtatatccagtgtgatatgg

SEQ ID NO: 9157 - DNA, 23 bp, Homo sapiens
actggtaaagctaagctctttgg

SEQ ID NO: 9158 - DNA, 23 bp, Homo sapiens
acagcaggcactattgcttctgg

SEQ ID NO: 9159 - DNA, 23 bp, Homo sapiens
tctcagaaacactccttacttgg

SEQ ID NO: 9160 - DNA, 23 bp, Homo sapiens
aagaagtgtactctcacgactgg

SEQ ID NO: 9161 - DNA, 23 bp, Homo sapiens
ggcagtactactcgtcctcctgg

SEQ ID NO: 9162 - DNA, 23 bp, Homo sapiens
tgagatgatgctttgacaaaagg

SEQ ID NO: 9163 - DNA, 23 bp, Homo sapiens
gatggaggagacagaataggagg

SEQ ID NO: 9164 - DNA, 23 bp, Homo sapiens
atgggggttatatgtgcagatgg

SEQ ID NO: 9165 - DNA, 23 bp, Homo sapiens
cctcagggcctggatctcatagg

SEQ ID NO: 9166 - DNA, 23 bp, Homo sapiens
cacggaagtgaagattcctgagg

SEQ ID NO: 9167 - DNA, 23 bp, Homo sapiens
ctttctaggaattctttgggtgg

SEQ ID NO: 9168 - DNA, 23 bp, Homo sapiens
ggaccccaggccagctaatgagg

SEQ ID NO: 9169 - DNA, 23 bp, Homo sapiens
gctttgctctggtcaaatgcagg

SEQ ID NO: 9170 - DNA, 23 bp, Homo sapiens
tgtgcagtgggagtcctgagggg

SEQ ID NO: 9171 - DNA, 23 bp, Homo sapiens
gagaagtgaagagagatgtgtgg

SEQ ID NO: 9172 - DNA, 23 bp, Homo sapiens
gccgcggttcactccctggtggg

SEQ ID NO: 9173 - DNA, 23 bp, Homo sapiens
cagcaaccctgagtccctaaagg

SEQ ID NO: 9174 - DNA, 23 bp, Homo sapiens
ttttggaaagccacttcaatagg

SEQ ID NO: 9175 - DNA, 23 bp, Homo sapiens
acaggcggtttctgctattccgg

SEQ ID NO: 9176 - DNA, 23 bp, Homo sapiens
cttgtagaatttctgcatccagg

SEQ ID NO: 9177 - DNA, 23 bp, Homo sapiens
gccccgtgtgatgggctagccgg

SEQ ID NO: 9178 - DNA, 23 bp, Homo sapiens
aactggatattcttctttcctgg

SEQ ID NO: 9179 - DNA, 23 bp, Homo sapiens
attgagcccccagccctgatcgg

SEQ ID NO: 9180 - DNA, 23 bp, Homo sapiens
gccccccaggccacaggttctgg

SEQ ID NO: 9181 - DNA, 23 bp, Homo sapiens
tgagtgggctcacctggcagcgg

SEQ ID NO: 9182 - DNA, 23 bp, Homo sapiens
gggtcaggacccaactcacttgg

SEQ ID NO: 9183 - DNA, 23 bp, Homo sapiens
aggattggggttcaggtttcagg

SEQ ID NO: 9184 - DNA, 23 bp, Homo sapiens
gttggactcaaaagatcgcgagg

SEQ ID NO: 9185 - DNA, 23 bp, Homo sapiens
aaggaagagatggccttaagtgg

SEQ ID NO: 9186 - DNA, 23 bp, Homo sapiens
gagagtcctgaggaaatggaagg

SEQ ID NO: 9187 - DNA, 23 bp, Homo sapiens
cacttatattgaagttgggcagg

SEQ ID NO: 9188 - DNA, 23 bp, Homo sapiens
tcgcatttagacttctcccttgg

SEQ ID NO: 9189 - DNA, 23 bp, Homo sapiens
attggggttcagagcacttctgg

SEQ ID NO: 9190 - DNA, 23 bp, Homo sapiens
tggagtgtttataggtgtaaagg

SEQ ID NO: 9191 - DNA, 23 bp, Homo sapiens
tccagggtgctcagggcaagagg

SEQ ID NO: 9192 - DNA, 23 bp, Homo sapiens
aagccaacactactgactttggg

SEQ ID NO: 9193 - DNA, 23 bp, Homo sapiens
atctttctcaccaaggagagagg

SEQ ID NO: 9194 - DNA, 23 bp, Homo sapiens
ccttatttctacatccttcctgg

SEQ ID NO: 9195 - DNA, 23 bp, Homo sapiens
tcattctgacttcagaacttggg

SEQ ID NO: 9196 - DNA, 23 bp, Homo sapiens
tacttccagcagtgtgactaggg

SEQ ID NO: 9197 - DNA, 23 bp, Homo sapiens
ccccagtgaggtcagcgattagg

SEQ ID NO: 9198 - DNA, 23 bp, Homo sapiens
gtgtctggtgactgaagtacagg

SEQ ID NO: 9199 - DNA, 23 bp, Homo sapiens
cgttggaaaacttcttggaaagg

SEQ ID NO: 9200 - DNA, 23 bp, Homo sapiens
tccgaaaatactttaatgcgagg

SEQ ID NO: 9201 - DNA, 23 bp, Homo sapiens
cacatacatgagggtctcttagg

SEQ ID NO: 9202 - DNA, 23 bp, Homo sapiens
ttggtgtaatgaacaccgagtgg

SEQ ID NO: 9203 - DNA, 23 bp, Homo sapiens
gacttcaatttccgtctcactgg

SEQ ID NO: 9204 - DNA, 23 bp, Homo sapiens
gtcaaaacacagaatcctccagg

SEQ ID NO: 9205 - DNA, 23 bp, Homo sapiens
tggagccaacctatttatgtggg

SEQ ID NO: 9206 - DNA, 23 bp, Homo sapiens
gctcttcggcaaatgtagcatgg

SEQ ID NO: 9207 - DNA, 23 bp, Homo sapiens
cacggcaacttctgcctcctggg

SEQ ID NO: 9208 - DNA, 23 bp, Homo sapiens
ctacttcttccccagatagctgg

SEQ ID NO: 9209 - DNA, 23 bp, Homo sapiens
gtggaagctgcgggctctgaagg

SEQ ID NO: 9210 - DNA, 23 bp, Homo sapiens
gcggctacatgcctcagtgaagg

SEQ ID NO: 9211 - DNA, 23 bp, Homo sapiens
actgttgaactgcactggccagg

SEQ ID NO: 9212 - DNA, 23 bp, Homo sapiens
agcccaaccaacaaagagtttgg

SEQ ID NO: 9213 - DNA, 23 bp, Homo sapiens
ggtcagcatcgatcaattattgg

SEQ ID NO: 9214 - DNA, 23 bp, Homo sapiens
ctgggtttcttacacttcactgg

SEQ ID NO: 9215 - DNA, 23 bp, Homo sapiens
gaaaagatgagagggatgagagg

SEQ ID NO: 9216 - DNA, 23 bp, Homo sapiens
ggctcggtcctggacattctagg

SEQ ID NO: 9217 - DNA, 23 bp, Homo sapiens
gtcctggctcaacagcacaccgg

SEQ ID NO: 9218 - DNA, 23 bp, Homo sapiens
ctctcatagtggaaggagtgtgg

SEQ ID NO: 9219 - DNA, 23 bp, Homo sapiens
gttgacaacatcagaccacaagg

SEQ ID NO: 9220 - DNA, 23 bp, Homo sapiens
agaagaaagcatggaaactcagg

SEQ ID NO: 9221 - DNA, 23 bp, Homo sapiens
gctacggctatcatgattttggg

SEQ ID NO: 9222 - DNA, 23 bp, Homo sapiens
ccgcgggggcttatctgtactgg

SEQ ID NO: 9223 - DNA, 23 bp, Homo sapiens
ggaggcaactcggcgacagcagg

SEQ ID NO: 9224 - DNA, 23 bp, Homo sapiens
tgagaagatgcaggacaagtagg

SEQ ID NO: 9225 - DNA, 23 bp, Homo sapiens
ggtgcggatagggcactgagggg

SEQ ID NO: 9226 - DNA, 23 bp, Homo sapiens
gatggctccattgctgtataggg

SEQ ID NO: 9227 - DNA, 23 bp, Homo sapiens
tcagaaaatctgtggccattagg

SEQ ID NO: 9228 - DNA, 23 bp, Homo sapiens
ccgtggtgacattgtatcattgg

SEQ ID NO: 9229 - DNA, 23 bp, Homo sapiens
ctcttgaaggagatattgtcagg

SEQ ID NO: 9230 - DNA, 23 bp, Homo sapiens
cttaccagtacagagagaagagg

SEQ ID NO: 9231 - DNA, 23 bp, Homo sapiens
gagatgggagaaaactgaaaagg

SEQ ID NO: 9232 - DNA, 23 bp, Homo sapiens
aatcttcctaaacctcactctgg

SEQ ID NO: 9233 - DNA, 23 bp, Homo sapiens
acttcgatctggaagcctagcgg

SEQ ID NO: 9234 - DNA, 23 bp, Homo sapiens
gagtggtgagtgtgctcactcgg

SEQ ID NO: 9235 - DNA, 23 bp, Homo sapiens
tcttcgtcgtctcgttgcaaagg

SEQ ID NO: 9236 - DNA, 23 bp, Homo sapiens
tgaagctggtggcgtgctaatgg

SEQ ID NO: 9237 - DNA, 23 bp, Homo sapiens
acagacgattaactatgggcggg

SEQ ID NO: 9238 - DNA, 23 bp, Homo sapiens
gaggagtcatctaaggctttggg

SEQ ID NO: 9239 - DNA, 23 bp, Homo sapiens
ctcccagatctagaaaagacagg

SEQ ID NO: 9240 - DNA, 23 bp, Homo sapiens
tacgaaaagcggctgtactgagg

SEQ ID NO: 9241 - DNA, 23 bp, Homo sapiens
gagaagcggcttttctgaaaagg

SEQ ID NO: 9242 - DNA, 23 bp, Homo sapiens
tttaaccatcaagattgggaagg

SEQ ID NO: 9243 - DNA, 23 bp, Homo sapiens
ctcacaaaagctgcaaactcagg

SEQ ID NO: 9244 - DNA, 23 bp, Homo sapiens
cttcaaaactttcccctatctgg

SEQ ID NO: 9245 - DNA, 23 bp, Homo sapiens
gggtggaagggagagttacccgg

SEQ ID NO: 9246 - DNA, 23 bp, Homo sapiens
cggagggcttcaacgactcccgg

SEQ ID NO: 9247 - DNA, 23 bp, Homo sapiens
ttggcagcgtctgaagagtaagg

SEQ ID NO: 9248 - DNA, 23 bp, Homo sapiens
tacagcctgaagaagcactgagg

SEQ ID NO: 9249 - DNA, 23 bp, Homo sapiens
gtggcctgggctctctcacttgg

SEQ ID NO: 9250 - DNA, 23 bp, Homo sapiens
aaactgtgtgtgatccagtaagg

SEQ ID NO: 9251 - DNA, 23 bp, Homo sapiens
ctacagtggggactcaccgcagg

SEQ ID NO: 9252 - DNA, 23 bp, Homo sapiens
aaaaagagagggcttacaacagg

SEQ ID NO: 9253 - DNA, 23 bp, Homo sapiens
tggtattgcccaaagtgcagggg

SEQ ID NO: 9254 - DNA, 23 bp, Homo sapiens
gaggcagcagacacaaataaagg

SEQ ID NO: 9255 - DNA, 23 bp, Homo sapiens
tgcagatgagaaggttcagttgg

SEQ ID NO: 9256 - DNA, 23 bp, Homo sapiens
cttggttgtcagccccacacagg

SEQ ID NO: 9257 - DNA, 23 bp, Homo sapiens
tctatttcttcttccgttcttgg

SEQ ID NO: 9258 - DNA, 23 bp, Homo sapiens
aaagaggaagaagaagtaggagg

SEQ ID NO: 9259 - DNA, 23 bp, Homo sapiens
gaccttaccacgaaacccaaagg

SEQ ID NO: 9260 - DNA, 23 bp, Homo sapiens
tgggcagacgggtcatcctgagg

SEQ ID NO: 9261 - DNA, 23 bp, Homo sapiens
agcactgtgcttgtatctaaggg

SEQ ID NO: 9262 - DNA, 23 bp, Homo sapiens
acatgatcgtggaggagtgtggg

SEQ ID NO: 9263 - DNA, 23 bp, Homo sapiens
aacatgattgtggaggagtgcgg

SEQ ID NO: 9264 - DNA, 23 bp, Homo sapiens
catagactaactgcacccacagg

SEQ ID NO: 9265 - DNA, 23 bp, Homo sapiens
ctcttgctagctgcagccacagg

SEQ ID NO: 9266 - DNA, 23 bp, Homo sapiens
cagtcaaacttgctaggagttgg

SEQ ID NO: 9267 - DNA, 23 bp, Homo sapiens
gttttcttcattctgggtcaagg

SEQ ID NO: 9268 - DNA, 23 bp, Homo sapiens
gccctcctggctcagggcccagg

SEQ ID NO: 9269 - DNA, 23 bp, Homo sapiens
gcaccaacccctctggaggacgg

SEQ ID NO: 9270 - DNA, 23 bp, Homo sapiens
tccccccttttggctacgtaagg

SEQ ID NO: 9271 - DNA, 23 bp, Homo sapiens
ggctcagggaacgatgctcgtgg

SEQ ID NO: 9272 - DNA, 23 bp, Homo sapiens
cctttccctcccctaactgaggg

SEQ ID NO: 9273 - DNA, 23 bp, Homo sapiens
gggcagggagtccagttaggagg

SEQ ID NO: 9274 - DNA, 23 bp, Homo sapiens
gcgtgatgtcacggtcactccgg

SEQ ID NO: 9275 - DNA, 23 bp, Homo sapiens
ctgcagagacgcatacctagagg

SEQ ID NO: 9276 - DNA, 23 bp, Homo sapiens
aggcctcccgaagggacttacgg

SEQ ID NO: 9277 - DNA, 23 bp, Homo sapiens
tgcaacgcaatttggtcaccagg

SEQ ID NO: 9278 - DNA, 23 bp, Homo sapiens
agacctccagaggggacttatgg

SEQ ID NO: 9279 - DNA, 23 bp, Homo sapiens
tgtgtggcttattttaagtctgg

SEQ ID NO: 9280 - DNA, 23 bp, Homo sapiens
tgttgtgtcgtgcagtgacgtgg

SEQ ID NO: 9281 - DNA, 23 bp, Homo sapiens
gaggagagagaggctcagagtgg

SEQ ID NO: 9282 - DNA, 23 bp, Homo sapiens
ggccaccagggcctctaggcagg

SEQ ID NO: 9283 - DNA, 23 bp, Homo sapiens
acttcaagaaacggagcagatgg

SEQ ID NO: 9284 - DNA, 23 bp, Homo sapiens
aaatctgaattatccgtgtctgg

SEQ ID NO: 9285 - DNA, 23 bp, Homo sapiens
ttgcacttgggaagaagtgatgg

SEQ ID NO: 9286 - DNA, 23 bp, Homo sapiens
aagggggcctggggccctgaggg

SEQ ID NO: 9287 - DNA, 23 bp, Homo sapiens
cccatcctggctcagatctgtgg

SEQ ID NO: 9288 - DNA, 23 bp, Homo sapiens
gctatcacttgctgagctgcagg

SEQ ID NO: 9289 - DNA, 23 bp, Homo sapiens
agttgcagtagttctccagctgg

SEQ ID NO: 9290 - DNA, 23 bp, Homo sapiens
ccccagcgctcccagaactgagg

SEQ ID NO: 9291 - DNA, 23 bp, Homo sapiens
cttactctgcagcaacatggagg

SEQ ID NO: 9292 - DNA, 23 bp, Homo sapiens
tcctgctgtggtttttattttgg

SEQ ID NO: 9293 - DNA, 23 bp, Homo sapiens
ggcgtcacggtggggaacatagg

SEQ ID NO: 9294 - DNA, 23 bp, Homo sapiens
ttgaagactcaatcactatgggg

SEQ ID NO: 9295 - DNA, 23 bp, Homo sapiens
tttggaagaaaatctgactgtgg

SEQ ID NO: 9296 - DNA, 23 bp, Homo sapiens
aatctcatcaggaatgaagaagg

SEQ ID NO: 9297 - DNA, 23 bp, Homo sapiens
tatcgcagaaaaatctcatcagg

SEQ ID NO: 9298 - DNA, 23 bp, Homo sapiens
agtagggacagagggtcagcagg

SEQ ID NO: 9299 - DNA, 23 bp, Homo sapiens
gcacccaaggaggaatcagtagg

SEQ ID NO: 9300 - DNA, 23 bp, Homo sapiens
tgtgaagtaatttgtgacgatgg

SEQ ID NO: 9301 - DNA, 23 bp, Homo sapiens
aagagcactcaaatcagtcatgg

SEQ ID NO: 9302 - DNA, 23 bp, Homo sapiens
tcagaaaagtgttgtcttacagg

SEQ ID NO: 9303 - DNA, 23 bp, Homo sapiens
ggtggagggcgcgctctagcagg

SEQ ID NO: 9304 - DNA, 23 bp, Homo sapiens
cactgcggcctggctgctgaggg

SEQ ID NO: 9305 - DNA, 23 bp, Homo sapiens
cacggtaggcactgttaggaagg

SEQ ID NO: 9306 - DNA, 23 bp, Homo sapiens
gccctcaaaatgggggtccaggg

SEQ ID NO: 9307 - DNA, 23 bp, Homo sapiens
gctgccacaggctcacatcacgg

SEQ ID NO: 9308 - DNA, 23 bp, Homo sapiens
ccttcagactctgacctgagtgg

SEQ ID NO: 9309 - DNA, 23 bp, Homo sapiens
ggtgagttgccggcctcagctgg

SEQ ID NO: 9310 - DNA, 23 bp, Homo sapiens
tgctatgaagcgattacagatgg

SEQ ID NO: 9311 - DNA, 23 bp, Homo sapiens
ttcaagtcactcttcactgccgg

SEQ ID NO: 9312 - DNA, 23 bp, Homo sapiens
ctttgcacacggacttctctggg

SEQ ID NO: 9313 - DNA, 23 bp, Homo sapiens
cagtgacagagctgtacatcagg

SEQ ID NO: 9314 - DNA, 23 bp, Homo sapiens
gtgggctctgacagtgactgagg

SEQ ID NO: 9315 - DNA, 23 bp, Homo sapiens
cccaaacctgcacggcgctaagg

SEQ ID NO: 9316 - DNA, 23 bp, Homo sapiens
cgtccactctccttcgacagggg

SEQ ID NO: 9317 - DNA, 23 bp, Homo sapiens
agaacaactggagaacttcttgg

SEQ ID NO: 9318 - DNA, 23 bp, Homo sapiens
atagacaactatgggcaggtagg

SEQ ID NO: 9319 - DNA, 23 bp, Homo sapiens
catgcaagaacaaatgtcagagg

SEQ ID NO: 9320 - DNA, 23 bp, Homo sapiens
tgtgactaatgttgttgtgaagg

SEQ ID NO: 9321 - DNA, 23 bp, Homo sapiens
ccatggttaaaaccgtgtgtagg

SEQ ID NO: 9322 - DNA, 23 bp, Homo sapiens
agtaaagttttgccattgcttgg

SEQ ID NO: 9323 - DNA, 23 bp, Homo sapiens
ttcttacagaagttctgagtggg

SEQ ID NO: 9324 - DNA, 23 bp, Homo sapiens
atcaagaaagcacagctacaagg

SEQ ID NO: 9325 - DNA, 23 bp, Homo sapiens
ttggctgagtagctgattgcagg

SEQ ID NO: 9326 - DNA, 23 bp, Homo sapiens
gggcccagaacagggcctactgg

SEQ ID NO: 9327 - DNA, 23 bp, Homo sapiens
agagataagtgaggagagtgggg

SEQ ID NO: 9328 - DNA, 23 bp, Homo sapiens
cagaattgagcaatcttaccagg

SEQ ID NO: 9329 - DNA, 23 bp, Homo sapiens
cctgtggccacagggaagtgtgg

SEQ ID NO: 9330 - DNA, 23 bp, Homo sapiens
tcaggtgggggcgtttcagcagg

SEQ ID NO: 9331 - DNA, 23 bp, Homo sapiens
ggaagtttcattctccctcttgg

SEQ ID NO: 9332 - DNA, 23 bp, Homo sapiens
aaccctgactttgtctcaaatgg

SEQ ID NO: 9333 - DNA, 23 bp, Homo sapiens
cctagcaacacaatagatgaggg

SEQ ID NO: 9334 - DNA, 23 bp, Homo sapiens
cagctacaggagtttttgcaagg

SEQ ID NO: 9335 - DNA, 23 bp, Homo sapiens
ttacacagctgactactgagggg

SEQ ID NO: 9336 - DNA, 23 bp, Homo sapiens
tgcagcctgcagtctaggagagg

SEQ ID NO: 9337 - DNA, 23 bp, Homo sapiens
gctcctgaactctgcgtgaaggg

SEQ ID NO: 9338 - DNA, 23 bp, Homo sapiens
gagataactcaattcatccctgg

SEQ ID NO: 9339 - DNA, 23 bp, Homo sapiens
ctgtgcccagcaacaactgaagg

SEQ ID NO: 9340 - DNA, 23 bp, Homo sapiens
cagaccatcggcatctaaaaagg

SEQ ID NO: 9341 - DNA, 23 bp, Homo sapiens
atcacaagactctaacaaagggg

SEQ ID NO: 9342 - DNA, 23 bp, Homo sapiens
atcaccagtcgttgtgaaggggg

SEQ ID NO: 9343 - DNA, 23 bp, Homo sapiens
agggaaagagttagaccttgtgg

SEQ ID NO: 9344 - DNA, 23 bp, Homo sapiens
aggcaaaggacaaagggaaaagg

SEQ ID NO: 9345 - DNA, 23 bp, Homo sapiens
agaagaagaaaaggaagtgatgg

SEQ ID NO: 9346 - DNA, 23 bp, Homo sapiens
cttagggttactcactaaggtgg

SEQ ID NO: 9347 - DNA, 23 bp, Homo sapiens
tggcttcctagggtctagccagg

SEQ ID NO: 9348 - DNA, 23 bp, Homo sapiens
aaaggcaaggagaagggcaaggg

SEQ ID NO: 9349 - DNA, 23 bp, Homo sapiens
acagtgacggggacctaaactgg

SEQ ID NO: 9350 - DNA, 23 bp, Homo sapiens
taaggcgacgcttagttcagagg

SEQ ID NO: 9351 - DNA, 23 bp, Homo sapiens
atacactctgtcacaatgcaagg

SEQ ID NO: 9352 - DNA, 23 bp, Homo sapiens
ttgagatcatcaactcctaaggg

SEQ ID NO: 9353 - DNA, 23 bp, Homo sapiens
cccaggcctttcagattgatagg

SEQ ID NO: 9354 - DNA, 23 bp, Homo sapiens
agacctggtcattcttttaatgg

SEQ ID NO: 9355 - DNA, 23 bp, Homo sapiens
atcgaaatcctcatgacctaggg

SEQ ID NO: 9356 - DNA, 23 bp, Homo sapiens
aaaggcaaggataagaggagagg

SEQ ID NO: 9357 - DNA, 23 bp, Homo sapiens
acagctcaattgccatctcctgg

SEQ ID NO: 9358 - DNA, 23 bp, Homo sapiens
gctgctgtaaatgcgaactatgg

SEQ ID NO: 9359 - DNA, 23 bp, Homo sapiens
taggtgctgatatttcttgatgg

SEQ ID NO: 9360 - DNA, 23 bp, Homo sapiens
tcaatcaaggagccataatgtgg

SEQ ID NO: 9361 - DNA, 23 bp, Homo sapiens
tgtattccaggatcatttcttgg

SEQ ID NO: 9362 - DNA, 23 bp, Homo sapiens
taaacttgaggtccattcactgg

SEQ ID NO: 9363 - DNA, 23 bp, Homo sapiens
tttcagttgaatgtcaagtcagg

SEQ ID NO: 9364 - DNA, 23 bp, Homo sapiens
accagcaagtcaaaattttctgg

SEQ ID NO: 9365 - DNA, 23 bp, Homo sapiens
ggaattttcatcttggctgcagg

SEQ ID NO: 9366 - DNA, 23 bp, Homo sapiens
ttttgttgagaaggaagatcagg

SEQ ID NO: 9367 - DNA, 23 bp, Homo sapiens
ctgctgaacaagaagttctatgg

SEQ ID NO: 9368 - DNA, 23 bp, Homo sapiens
tcctcaacaagaagtttttgcgg

SEQ ID NO: 9369 - DNA, 23 bp, Homo sapiens
cacaattgtgctgatgccgctgg

SEQ ID NO: 9370 - DNA, 23 bp, Homo sapiens
catgtgaggactgctaatgatgg

SEQ ID NO: 9371 - DNA, 23 bp, Homo sapiens
gcttaggagcacagcactgacgg

SEQ ID NO: 9372 - DNA, 23 bp, Homo sapiens
tctctccattcatcagaccacgg

SEQ ID NO: 9373 - DNA, 23 bp, Homo sapiens
ctgcgagacctctctgatgcagg

SEQ ID NO: 9374 - DNA, 23 bp, Homo sapiens
tttacagagcactatgggagtgg

SEQ ID NO: 9375 - DNA, 23 bp, Homo sapiens
ggtggggcagagtctacaccagg

SEQ ID NO: 9376 - DNA, 23 bp, Homo sapiens
aattggtaaaatggtgagtcggg

SEQ ID NO: 9377 - DNA, 23 bp, Homo sapiens
tactcctggatcacctaatgagg

SEQ ID NO: 9378 - DNA, 23 bp, Homo sapiens
gcctggaacaggacaggcagggg

SEQ ID NO: 9379 - DNA, 23 bp, Homo sapiens
agttaatgaacttgagagtctgg

SEQ ID NO: 9380 - DNA, 23 bp, Homo sapiens
agctgtgttccggtcatcagggg

SEQ ID NO: 9381 - DNA, 23 bp, Homo sapiens
gtactgttcatattcatcccagg

SEQ ID NO: 9382 - DNA, 23 bp, Homo sapiens
taagagaccagacattaagaagg

SEQ ID NO: 9383 - DNA, 23 bp, Homo sapiens
acatccatagatgttgttcttgg

SEQ ID NO: 9384 - DNA, 23 bp, Homo sapiens
tgcttcgtttgaagatgatgtgg

SEQ ID NO: 9385 - DNA, 23 bp, Homo sapiens
attccctgtgcaccgtagcaggg

SEQ ID NO: 9386 - DNA, 23 bp, Homo sapiens
aggcttaacagctcttgacgcgg

SEQ ID NO: 9387 - DNA, 23 bp, Homo sapiens
tggaggcagtggtagcctagggg

SEQ ID NO: 9388 - DNA, 23 bp, Homo sapiens
tcactttcacatctccagcaagg

SEQ ID NO: 9389 - DNA, 23 bp, Homo sapiens
gtggctgcccagtggttcaaggg

SEQ ID NO: 9390 - DNA, 23 bp, Homo sapiens
caccacctcaaccaataaactgg

SEQ ID NO: 9391 - DNA, 23 bp, Homo sapiens
gcgagggctcagctctccccagg

SEQ ID NO: 9392 - DNA, 23 bp, Homo sapiens
attcttgaatagaggaatggcgg

SEQ ID NO: 9393 - DNA, 23 bp, Homo sapiens
ccagctggcatgcaataacaagg

SEQ ID NO: 9394 - DNA, 23 bp, Homo sapiens
aagatggcattcacaattactgg

SEQ ID NO: 9395 - DNA, 23 bp, Homo sapiens
tcattagactgggttctaggcgg

SEQ ID NO: 9396 - DNA, 23 bp, Homo sapiens
gcccaagcgacgcacttagacgg

SEQ ID NO: 9397 - DNA, 23 bp, Homo sapiens
ggtcccccaggctctacaccagg

SEQ ID NO: 9398 - DNA, 23 bp, Homo sapiens
ttaagtacattctggacagctgg

SEQ ID NO: 9399 - DNA, 23 bp, Homo sapiens
aactatacgtaaatctgctcagg

SEQ ID NO: 9400 - DNA, 23 bp, Homo sapiens
ggaaaatctccagaaggagcggg

SEQ ID NO: 9401 - DNA, 23 bp, Homo sapiens
agccccctcccactcctcactgg

SEQ ID NO: 9402 - DNA, 23 bp, Homo sapiens
atgtccagttgagctactgacgg

SEQ ID NO: 9403 - DNA, 23 bp, Homo sapiens
cttgtcccaccacttgaaggagg

SEQ ID NO: 9404 - DNA, 23 bp, Homo sapiens
tcgactctcccaaaagaggtcgg

SEQ ID NO: 9405 - DNA, 23 bp, Homo sapiens
aaagaagacccttaatcaggcgg

SEQ ID NO: 9406 - DNA, 23 bp, Homo sapiens
gtccagccctacctatagaaggg

SEQ ID NO: 9407 - DNA, 23 bp, Homo sapiens
ggacgccgccctggtcttatcgg

SEQ ID NO: 9408 - DNA, 23 bp, Homo sapiens
aaacccttctgcgcctgaggcgg

SEQ ID NO: 9409 - DNA, 23 bp, Homo sapiens
ggtatgtccgacatttaacgcgg

SEQ ID NO: 9410 - DNA, 23 bp, Homo sapiens
gtgcagtgccagtacccgtctgg

SEQ ID NO: 9411 - DNA, 23 bp, Homo sapiens
atcaaagggacttgtggctgtgg

SEQ ID NO: 9412 - DNA, 23 bp, Homo sapiens
cctcacagacagttgcgtccagg

SEQ ID NO: 9413 - DNA, 23 bp, Homo sapiens
gatagagaaagatgacccacagg

SEQ ID NO: 9414 - DNA, 23 bp, Homo sapiens
acaagaacccaaaaaaggagagg

SEQ ID NO: 9415 - DNA, 23 bp, Homo sapiens
agctgagttttctcctctgctgg

SEQ ID NO: 9416 - DNA, 23 bp, Homo sapiens
tagccttaatgcatcgatggagg

SEQ ID NO: 9417 - DNA, 23 bp, Homo sapiens
agcctggcgggcggagctaaggg

SEQ ID NO: 9418 - DNA, 23 bp, Homo sapiens
ggcttcagtctgacacagccagg

SEQ ID NO: 9419 - DNA, 23 bp, Homo sapiens
ggaatccccctacagactagtgg

SEQ ID NO: 9420 - DNA, 23 bp, Homo sapiens
gccagtcctattgaggcatgagg

SEQ ID NO: 9421 - DNA, 23 bp, Homo sapiens
agtcccgtggagacgtgaggggg

SEQ ID NO: 9422 - DNA, 23 bp, Homo sapiens
aagccctgggtggggctagaagg

SEQ ID NO: 9423 - DNA, 23 bp, Homo sapiens
ggcaactacaggcagacggcagg

SEQ ID NO: 9424 - DNA, 23 bp, Homo sapiens
ccagtctctttaatattccctgg

SEQ ID NO: 9425 - DNA, 23 bp, Homo sapiens
accccgtcactagtactccttgg

SEQ ID NO: 9426 - DNA, 23 bp, Homo sapiens
atgtggacagctgtgagaagtgg

SEQ ID NO: 9427 - DNA, 23 bp, Homo sapiens
gggtctgctttccaaagtatagg

SEQ ID NO: 9428 - DNA, 23 bp, Homo sapiens
aaggcagggttggagttcagtgg

SEQ ID NO: 9429 - DNA, 23 bp, Homo sapiens
ctacaggagagtttaaggcaagg

SEQ ID NO: 9430 - DNA, 23 bp, Homo sapiens
ttttcagctcttcaaacctccgg

SEQ ID NO: 9431 - DNA, 23 bp, Homo sapiens
agcacagatgctgccccatttgg

SEQ ID NO: 9432 - DNA, 23 bp, Homo sapiens
cagaaggctcctggggtattagg

SEQ ID NO: 9433 - DNA, 23 bp, Homo sapiens
ctcactggattgaggatgtgagg

SEQ ID NO: 9434 - DNA, 23 bp, Homo sapiens
tgtgtgaccggggcctcaggtgg

SEQ ID NO: 9435 - DNA, 23 bp, Homo sapiens
tttgccatagaagaaacagaagg

SEQ ID NO: 9436 - DNA, 23 bp, Homo sapiens
aattggcattttacattggcagg

SEQ ID NO: 9437 - DNA, 23 bp, Homo sapiens
tagcatcaaaatgaaaccggtgg

SEQ ID NO: 9438 - DNA, 23 bp, Homo sapiens
atgaggcaagtacagctaggtgg

SEQ ID NO: 9439 - DNA, 23 bp, Homo sapiens
tgctgctcattttagcactgtgg

SEQ ID NO: 9440 - DNA, 23 bp, Homo sapiens
tcttctcttttttcttcctcagg

SEQ ID NO: 9441 - DNA, 23 bp, Homo sapiens
acccccaaagtgctggagtgagg

SEQ ID NO: 9442 - DNA, 23 bp, Homo sapiens
ggttcagctactgagctctgtgg

SEQ ID NO: 9443 - DNA, 23 bp, Homo sapiens
atgatgaagagggggagtgatgg

SEQ ID NO: 9444 - DNA, 23 bp, Homo sapiens
ctgaccgacgactactgaggggg

SEQ ID NO: 9445 - DNA, 23 bp, Homo sapiens
aagaaaacagaagagacagttgg

SEQ ID NO: 9446 - DNA, 23 bp, Homo sapiens
gcatcagcaagtacagagctagg

SEQ ID NO: 9447 - DNA, 23 bp, Homo sapiens
tgggaggactcaggcatcagagg

SEQ ID NO: 9448 - DNA, 23 bp, Homo sapiens
aatgaaagctactcatagcgggg

SEQ ID NO: 9449 - DNA, 23 bp, Homo sapiens
ctcagccatctgataaagagagg

SEQ ID NO: 9450 - DNA, 23 bp, Homo sapiens
ctgggacatgggaacctaggcgg

SEQ ID NO: 9451 - DNA, 23 bp, Homo sapiens
tttttttcttgtcatgcctcagg

SEQ ID NO: 9452 - DNA, 23 bp, Homo sapiens
tgactggtgtggcagctcactgg

SEQ ID NO: 9453 - DNA, 23 bp, Homo sapiens
tattaggacaaaggcacatttgg

SEQ ID NO: 9454 - DNA, 23 bp, Homo sapiens
tctgctcgaagaagagaattagg

SEQ ID NO: 9455 - DNA, 23 bp, Homo sapiens
ctctgagagtggtggtggcaagg

SEQ ID NO: 9456 - DNA, 23 bp, Homo sapiens
tgtcgggaaggagccgctactgg

SEQ ID NO: 9457 - DNA, 23 bp, Homo sapiens
caacctcatgaaaatggtgaagg

SEQ ID NO: 9458 - DNA, 23 bp, Homo sapiens
aagaggggatcatttctcactgg

SEQ ID NO: 9459 - DNA, 23 bp, Homo sapiens
agagttcagacattgtcctgagg

SEQ ID NO: 9460 - DNA, 23 bp, Homo sapiens
ccaaactacggacgtaaagctgg

SEQ ID NO: 9461 - DNA, 23 bp, Homo sapiens
gtggtcaatccgaagtatgaggg

SEQ ID NO: 9462 - DNA, 23 bp, Homo sapiens
taatacagagtcaaaagcggtgg

SEQ ID NO: 9463 - DNA, 23 bp, Homo sapiens
ggaagaggaggaagcaatggggg

SEQ ID NO: 9464 - DNA, 23 bp, Homo sapiens
ccccaagtttgctgagagttagg

SEQ ID NO: 9465 - DNA, 23 bp, Homo sapiens
ctgcttatcattaagtgccccgg

SEQ ID NO: 9466 - DNA, 23 bp, Homo sapiens
agagagcttgaaaatctcattgg

SEQ ID NO: 9467 - DNA, 23 bp, Homo sapiens
gatcaggcagatgcagaagttgg

SEQ ID NO: 9468 - DNA, 23 bp, Homo sapiens
gggcagggtgcggtcaagtttgg

SEQ ID NO: 9469 - DNA, 23 bp, Homo sapiens
caaatcctacaatggcactgtgg

SEQ ID NO: 9470 - DNA, 23 bp, Homo sapiens
aaagtagttctagcaatctgtgg

SEQ ID NO: 9471 - DNA, 23 bp, Homo sapiens
cagacagtcccactctctgaagg

SEQ ID NO: 9472 - DNA, 23 bp, Homo sapiens
tttcttcaggcttctcacgtcgg

SEQ ID NO: 9473 - DNA, 23 bp, Homo sapiens
aatgcatgtgaaatctggcttgg

SEQ ID NO: 9474 - DNA, 23 bp, Homo sapiens
ccagagggctcagaagatgtcgg

SEQ ID NO: 9475 - DNA, 23 bp, Homo sapiens
gctttctcaaacggccttaaagg

SEQ ID NO: 9476 - DNA, 23 bp, Homo sapiens
ctggtgtgtctactcaaaacagg

SEQ ID NO: 9477 - DNA, 23 bp, Homo sapiens
ggagatttcctgctggtctgtgg

SEQ ID NO: 9478 - DNA, 23 bp, Homo sapiens
atttccttttgccagcatcctgg

SEQ ID NO: 9479 - DNA, 23 bp, Homo sapiens
ctgccagcttcagagctccctgg

SEQ ID NO: 9480 - DNA, 23 bp, Homo sapiens
tggaattcagaagccatcacagg

SEQ ID NO: 9481 - DNA, 23 bp, Homo sapiens
ctggctgaaattgcagaatcagg

SEQ ID NO: 9482 - DNA, 23 bp, Homo sapiens
cagcagccgtgagataactgagg

SEQ ID NO: 9483 - DNA, 23 bp, Homo sapiens
cagtcgggagataacggaggcgg

SEQ ID NO: 9484 - DNA, 23 bp, Homo sapiens
caagatctgtcaagagtaagagg

SEQ ID NO: 9485 - DNA, 23 bp, Homo sapiens
ccagcaattgtttcgcaattcgg

SEQ ID NO: 9486 - DNA, 23 bp, Homo sapiens
ctcatctgcggggtggtgtgagg

SEQ ID NO: 9487 - DNA, 23 bp, Homo sapiens
ccctgaaggaagtacttcagggg

SEQ ID NO: 9488 - DNA, 23 bp, Homo sapiens
gcaggagtactttggcagtttgg

SEQ ID NO: 9489 - DNA, 23 bp, Homo sapiens
ggggtggagtggcagtagcaggg

SEQ ID NO: 9490 - DNA, 23 bp, Homo sapiens
tgacagcttcctacttcagtcgg

SEQ ID NO: 9491 - DNA, 23 bp, Homo sapiens
ggtcccggctccgtggctactgg

SEQ ID NO: 9492 - DNA, 23 bp, Homo sapiens
gccagcctggctgagagatgagg

SEQ ID NO: 9493 - DNA, 23 bp, Homo sapiens
gcgtgggcagctcaggcgagtgg

SEQ ID NO: 9494 - DNA, 23 bp, Homo sapiens
gatctgcctcctgcaggggctgg

SEQ ID NO: 9495 - DNA, 23 bp, Homo sapiens
tttgcttatgctggttgttgtgg

SEQ ID NO: 9496 - DNA, 23 bp, Homo sapiens
ttccccccatggtatcagtgtgg

SEQ ID NO: 9497 - DNA, 23 bp, Homo sapiens
ccttcggtggctctcctcagcgg

SEQ ID NO: 9498 - DNA, 23 bp, Homo sapiens
tgtaaaagacgtcagctttttgg

SEQ ID NO: 9499 - DNA, 23 bp, Homo sapiens
catcaaggtgctgcagccagtgg

SEQ ID NO: 9500 - DNA, 23 bp, Homo sapiens
gggtttacggttcaccttcaagg

SEQ ID NO: 9501 - DNA, 23 bp, Homo sapiens
catatgattcattgctggcttgg

SEQ ID NO: 9502 - DNA, 23 bp, Homo sapiens
gcagttgtttgatgagccgtagg

SEQ ID NO: 9503 - DNA, 23 bp, Homo sapiens
ctgtcctttagaacccctacagg

SEQ ID NO: 9504 - DNA, 23 bp, Homo sapiens
ctgctgctggctagctctcgggg

SEQ ID NO: 9505 - DNA, 23 bp, Homo sapiens
ggagagatcaacggggtgactgg

SEQ ID NO: 9506 - DNA, 23 bp, Homo sapiens
ctagtgaaagtctgcattgaagg

SEQ ID NO: 9507 - DNA, 23 bp, Homo sapiens
tgcgggtggttatttatgtttgg

SEQ ID NO: 9508 - DNA, 23 bp, Homo sapiens
ggctccattcatttgactcaagg

SEQ ID NO: 9509 - DNA, 23 bp, Homo sapiens
cattccaggcaaggtcacaatgg

SEQ ID NO: 9510 - DNA, 23 bp, Homo sapiens
aaaaattatcctgaaggagctgg

SEQ ID NO: 9511 - DNA, 23 bp, Homo sapiens
atcatggtgacagtgtaggcagg

SEQ ID NO: 9512 - DNA, 23 bp, Homo sapiens
catcagcagcttttcatgtgcgg

SEQ ID NO: 9513 - DNA, 23 bp, Homo sapiens
aagaaaaggccacagattcgagg

SEQ ID NO: 9514 - DNA, 23 bp, Homo sapiens
gccagtttaactcacagtccagg

SEQ ID NO: 9515 - DNA, 23 bp, Homo sapiens
aggaaaggaacggcaggaacagg

SEQ ID NO: 9516 - DNA, 23 bp, Homo sapiens
cactgcaaccgctgcctctcagg

SEQ ID NO: 9517 - DNA, 23 bp, Homo sapiens
aaactcctgctgcagtaggacgg

SEQ ID NO: 9518 - DNA, 23 bp, Homo sapiens
ggggaagatagatgagaaggagg

SEQ ID NO: 9519 - DNA, 23 bp, Homo sapiens
acactcagcagcatcttccaagg

SEQ ID NO: 9520 - DNA, 23 bp, Homo sapiens
cattatcaggagaagcatcttgg

SEQ ID NO: 9521 - DNA, 23 bp, Homo sapiens
tgtcaatcattaccctctccagg

SEQ ID NO: 9522 - DNA, 23 bp, Homo sapiens
agggaagggggtgagttaggagg

SEQ ID NO: 9523 - DNA, 23 bp, Homo sapiens
tttcccacagttcaatgcaaagg

SEQ ID NO: 9524 - DNA, 23 bp, Homo sapiens
gctatacgatgtactccattcgg

SEQ ID NO: 9525 - DNA, 23 bp, Homo sapiens
gctacgccggcaaggagtagggg

SEQ ID NO: 9526 - DNA, 23 bp, Homo sapiens
ctcttggttcaccagcacacagg

SEQ ID NO: 9527 - DNA, 23 bp, Homo sapiens
agctttcagaaccttattgaagg

SEQ ID NO: 9528 - DNA, 23 bp, Homo sapiens
caaataagggataacatggctgg

SEQ ID NO: 9529 - DNA, 23 bp, Homo sapiens
tgcgggcaggagctatgaaaagg

SEQ ID NO: 9530 - DNA, 23 bp, Homo sapiens
taacagctcgttctgatccttgg

SEQ ID NO: 9531 - DNA, 23 bp, Homo sapiens
tctcactagcattcattctgtgg

SEQ ID NO: 9532 - DNA, 23 bp, Homo sapiens
tctctcttgcctttattctatgg

SEQ ID NO: 9533 - DNA, 23 bp, Homo sapiens
tgggatcttatccatgttttcgg

SEQ ID NO: 9534 - DNA, 23 bp, Homo sapiens
tctccttagctttcattctctgg

SEQ ID NO: 9535 - DNA, 23 bp, Homo sapiens
tttcagaaacaacagaggcttgg

SEQ ID NO: 9536 - DNA, 23 bp, Homo sapiens
gccgcggcgggcggatcacgagg

SEQ ID NO: 9537 - DNA, 23 bp, Homo sapiens
gtatgctatgctcagaggaaagg

SEQ ID NO: 9538 - DNA, 23 bp, Homo sapiens
ctacatccgcactgacgaggagg

SEQ ID NO: 9539 - DNA, 23 bp, Homo sapiens
gactctccattcttctcaaaagg

SEQ ID NO: 9540 - DNA, 23 bp, Homo sapiens
tgatgagctcgaagcacttttgg

SEQ ID NO: 9541 - DNA, 23 bp, Homo sapiens
cggtgtcggctgagattatcagg

SEQ ID NO: 9542 - DNA, 23 bp, Homo sapiens
tgaccctagcagagtggagaggg

SEQ ID NO: 9543 - DNA, 23 bp, Homo sapiens
tagtcaggatagcaggcatctgg

SEQ ID NO: 9544 - DNA, 23 bp, Homo sapiens
ttctcgagctgctcgagcagtgg

SEQ ID NO: 9545 - DNA, 23 bp, Homo sapiens
gtgcttcaggcagttggtggagg

SEQ ID NO: 9546 - DNA, 23 bp, Homo sapiens
tgtctacactcagtgtccattgg

SEQ ID NO: 9547 - DNA, 23 bp, Homo sapiens
cgaggatgaagtagaggatatgg

SEQ ID NO: 9548 - DNA, 23 bp, Homo sapiens
atcctcacgacaggtgctatggg

SEQ ID NO: 9549 - DNA, 23 bp, Homo sapiens
aacagccttgctgggtcacctgg

SEQ ID NO: 9550 - DNA, 23 bp, Homo sapiens
gagtctctttatctgctcagggg

SEQ ID NO: 9551 - DNA, 23 bp, Homo sapiens
aggcttcaggccttgactgatgg

SEQ ID NO: 9552 - DNA, 23 bp, Homo sapiens
cgaggaggcggcagctggggagg

SEQ ID NO: 9553 - DNA, 23 bp, Homo sapiens
gcaggggccccggccatcagtgg

SEQ ID NO: 9554 - DNA, 23 bp, Homo sapiens
tgagcgtagcatgccaccagcgg

SEQ ID NO: 9555 - DNA, 23 bp, Homo sapiens
ccagctgttttggctagccgagg

SEQ ID NO: 9556 - DNA, 23 bp, Homo sapiens
ggctttaccttgcacagactggg

SEQ ID NO: 9557 - DNA, 23 bp, Homo sapiens
tgggcagaactgttacacatcgg

SEQ ID NO: 9558 - DNA, 23 bp, Homo sapiens
aggagaagggcagctggctgcgg

SEQ ID NO: 9559 - DNA, 23 bp, Homo sapiens
catgctgttgaatatcgggttgg

SEQ ID NO: 9560 - DNA, 23 bp, Homo sapiens
accgagacctatgctgatggagg

SEQ ID NO: 9561 - DNA, 23 bp, Homo sapiens
tggtaagcgacggtcaggtcagg

SEQ ID NO: 9562 - DNA, 23 bp, Homo sapiens
atggtgatcttgctcaacatcgg

SEQ ID NO: 9563 - DNA, 23 bp, Homo sapiens
catgcgtgtcaggtgcactgagg

SEQ ID NO: 9564 - DNA, 23 bp, Homo sapiens
ctgggctctcactgagcagatgg

SEQ ID NO: 9565 - DNA, 23 bp, Homo sapiens
ttctcccagctcctcacctgagg

SEQ ID NO: 9566 - DNA, 23 bp, Homo sapiens
agggccagggatgaactcactgg

SEQ ID NO: 9567 - DNA, 23 bp, Homo sapiens
ggcaagtccagcctcgtcttggg

SEQ ID NO: 9568 - DNA, 23 bp, Homo sapiens
gagcctgactgtacatctcttgg

SEQ ID NO: 9569 - DNA, 23 bp, Homo sapiens
gcttctcttcactctgccccagg

SEQ ID NO: 9570 - DNA, 23 bp, Homo sapiens
cagtggcttctcttagtagaagg

SEQ ID NO: 9571 - DNA, 23 bp, Homo sapiens
ccaacattatgtctctgtagagg

SEQ ID NO: 9572 - DNA, 23 bp, Homo sapiens
ccacagcaggtgacaactgatgg

SEQ ID NO: 9573 - DNA, 23 bp, Homo sapiens
tatgattctacctgatagactgg

SEQ ID NO: 9574 - DNA, 23 bp, Homo sapiens
ggcaaggggcgggactgagccgg

SEQ ID NO: 9575 - DNA, 23 bp, Homo sapiens
aagggtggaatgtagctatatgg

SEQ ID NO: 9576 - DNA, 23 bp, Homo sapiens
actgctgcgttagcatgagttgg

SEQ ID NO: 9577 - DNA, 23 bp, Homo sapiens
aggggcaggggacgttcagaagg

SEQ ID NO: 9578 - DNA, 23 bp, Homo sapiens
ccgcgcgcggactcagtacgcgg

SEQ ID NO: 9579 - DNA, 23 bp, Homo sapiens
agaccacatgctggcctaggcgg

SEQ ID NO: 9580 - DNA, 23 bp, Homo sapiens
cacaggtgaaagagaagtaacgg

SEQ ID NO: 9581 - DNA, 23 bp, Homo sapiens
cagcagcagaaagtagtgacggg

SEQ ID NO: 9582 - DNA, 23 bp, Homo sapiens
ggatgcgcgctaaacgtaagtgg

SEQ ID NO: 9583 - DNA, 23 bp, Homo sapiens
tgggagatggctacgtcccttgg

SEQ ID NO: 9584 - DNA, 23 bp, Homo sapiens
atcaatcaaatgaacctcggtgg

SEQ ID NO: 9585 - DNA, 23 bp, Homo sapiens
tcacggctactcttctgccgagg

SEQ ID NO: 9586 - DNA, 23 bp, Homo sapiens
acgaggcagcttactgaacctgg

SEQ ID NO: 9587 - DNA, 23 bp, Homo sapiens
gcaggtccctggggctgtagggg

SEQ ID NO: 9588 - DNA, 23 bp, Homo sapiens
cgcccgactcacagatgagcggg

SEQ ID NO: 9589 - DNA, 23 bp, Homo sapiens
attagtaagtcctagaccaaagg

SEQ ID NO: 9590 - DNA, 23 bp, Homo sapiens
caactaatagaagtgggttctgg

SEQ ID NO: 9591 - DNA, 23 bp, Homo sapiens
acacagcatcttcagggtgctgg

SEQ ID NO: 9592 - DNA, 23 bp, Homo sapiens
ggtgctgccctccagctcacagg

SEQ ID NO: 9593 - DNA, 23 bp, Homo sapiens
acactggaaagcacaacagttgg

SEQ ID NO: 9594 - DNA, 23 bp, Homo sapiens
agctgtattcgcatcagcgccgg

SEQ ID NO: 9595 - DNA, 23 bp, Homo sapiens
gggaggcctcattgacaagtagg

SEQ ID NO: 9596 - DNA, 23 bp, Homo sapiens
tactgaagaagaatttctccagg

SEQ ID NO: 9597 - DNA, 23 bp, Homo sapiens
actggagcaagagggggaagtgg

SEQ ID NO: 9598 - DNA, 23 bp, Homo sapiens
cttgctcatcttctcatgtaagg

SEQ ID NO: 9599 - DNA, 23 bp, Homo sapiens
tgatctctaattctctttcctgg

SEQ ID NO: 9600 - DNA, 23 bp, Homo sapiens
tcaatggctcctacatgagaagg

SEQ ID NO: 9601 - DNA, 23 bp, Homo sapiens
caggtcactttaagtgcccttgg

SEQ ID NO: 9602 - DNA, 23 bp, Homo sapiens
gggatcatgtgacagcaataagg

SEQ ID NO: 9603 - DNA, 23 bp, Homo sapiens
gggccaggctgctcacttcttgg

SEQ ID NO: 9604 - DNA, 23 bp, Homo sapiens
aactatggaggatttcgagatgg

SEQ ID NO: 9605 - DNA, 23 bp, Homo sapiens
atctatattcctttgccgtcagg

SEQ ID NO: 9606 - DNA, 23 bp, Homo sapiens
gtctgtctctgctgcagacttgg

SEQ ID NO: 9607 - DNA, 23 bp, Homo sapiens
aggtctgatggttttatcagggg

SEQ ID NO: 9608 - DNA, 23 bp, Homo sapiens
ctagtccattttcatgctgctgg

SEQ ID NO: 9609 - DNA, 23 bp, Homo sapiens
gtcctccctgcctgcaatcaagg

SEQ ID NO: 9610 - DNA, 23 bp, Homo sapiens
tggctcagagatactcagactgg

SEQ ID NO: 9611 - DNA, 23 bp, Homo sapiens
ctcatggccagtctggactgagg

SEQ ID NO: 9612 - DNA, 23 bp, Homo sapiens
actttggttccaggatatactgg

SEQ ID NO: 9613 - DNA, 23 bp, Homo sapiens
agagaatgacgattactactagg

SEQ ID NO: 9614 - DNA, 23 bp, Homo sapiens
gtcacattccaagtgtcatatgg

SEQ ID NO: 9615 - DNA, 23 bp, Homo sapiens
acatagaggaggacgcggactgg

SEQ ID NO: 9616 - DNA, 23 bp, Homo sapiens
ctggaggtcaccaacgtgtaagg

SEQ ID NO: 9617 - DNA, 23 bp, Homo sapiens
gagcagggcgccccgtaggccgg

SEQ ID NO: 9618 - DNA, 23 bp, Homo sapiens
gaagaaggcaatgagcactaagg

SEQ ID NO: 9619 - DNA, 23 bp, Homo sapiens
tgggcctgtgacttcgacaacgg

SEQ ID NO: 9620 - DNA, 23 bp, Homo sapiens
gcactaccacctgtatagtgggg

SEQ ID NO: 9621 - DNA, 23 bp, Homo sapiens
tctgttaaggctctaggcattgg

SEQ ID NO: 9622 - DNA, 23 bp, Homo sapiens
ttgcagtttgtgttggcctaagg

SEQ ID NO: 9623 - DNA, 23 bp, Homo sapiens
tgatcctgtgcatttcactgagg

SEQ ID NO: 9624 - DNA, 23 bp, Homo sapiens
cgaaatgcacaggatcagcaggg

SEQ ID NO: 9625 - DNA, 23 bp, Homo sapiens
agtactttctgaagacactgagg

SEQ ID NO: 9626 - DNA, 23 bp, Homo sapiens
gaattgggatgtcatcaaagagg

SEQ ID NO: 9627 - DNA, 23 bp, Homo sapiens
tgctcttattaacgcagttttgg

SEQ ID NO: 9628 - DNA, 23 bp, Homo sapiens
gctgttccacagagaagtctagg

SEQ ID NO: 9629 - DNA, 23 bp, Homo sapiens
cacatagtttgtgttagccaagg

SEQ ID NO: 9630 - DNA, 23 bp, Homo sapiens
cagctgtaactacattgcacagg

SEQ ID NO: 9631 - DNA, 23 bp, Homo sapiens
tttgatgttgacacaagagttgg

SEQ ID NO: 9632 - DNA, 23 bp, Homo sapiens
ctgttctaatgcaaaggctgtgg

SEQ ID NO: 9633 - DNA, 23 bp, Homo sapiens
ccgggaaacagatttgtgaaagg

SEQ ID NO: 9634 - DNA, 23 bp, Homo sapiens
agagaaaagaatgctcacggagg

SEQ ID NO: 9635 - DNA, 23 bp, Homo sapiens
cacctggtcaccgaagtgtgagg

SEQ ID NO: 9636 - DNA, 23 bp, Homo sapiens
caacaagccctacagcaagaagg

SEQ ID NO: 9637 - DNA, 23 bp, Homo sapiens
tctgtagtcctttttgctgtagg

SEQ ID NO: 9638 - DNA, 23 bp, Homo sapiens
gcccgcgacagactacttcttgg

SEQ ID NO: 9639 - DNA, 23 bp, Homo sapiens
tctgatctcgtgtgcttccatgg

SEQ ID NO: 9640 - DNA, 23 bp, Homo sapiens
ttttgtaactagtcacatgctgg

SEQ ID NO: 9641 - DNA, 23 bp, Homo sapiens
cagatcgacatgcctctaagagg

SEQ ID NO: 9642 - DNA, 23 bp, Homo sapiens
gctgtgagagtgacttgaccagg

SEQ ID NO: 9643 - DNA, 23 bp, Homo sapiens
agccataccaaggactatactgg

SEQ ID NO: 9644 - DNA, 23 bp, Homo sapiens
atcctacatcacctggataatgg

SEQ ID NO: 9645 - DNA, 23 bp, Homo sapiens
ggtttacaagatagatgggatgg

SEQ ID NO: 9646 - DNA, 23 bp, Homo sapiens
ttaagtaagagatctggcctcgg

SEQ ID NO: 9647 - DNA, 23 bp, Homo sapiens
ggagggggttcgtccactagggg

SEQ ID NO: 9648 - DNA, 23 bp, Homo sapiens
cccagcccccttcctcaatgtgg

SEQ ID NO: 9649 - DNA, 23 bp, Homo sapiens
gtcctcaccctctcttaaagcgg

SEQ ID NO: 9650 - DNA, 23 bp, Homo sapiens
tcagcaggcctacccctcacagg

SEQ ID NO: 9651 - DNA, 23 bp, Homo sapiens
gaatcccctgagtactcaggagg

SEQ ID NO: 9652 - DNA, 23 bp, Homo sapiens
ctctgtccagtggttttacaagg

SEQ ID NO: 9653 - DNA, 23 bp, Homo sapiens
tagccagtggtggggttcatggg

SEQ ID NO: 9654 - DNA, 23 bp, Homo sapiens
ttcaaaatgtccccctgataagg

SEQ ID NO: 9655 - DNA, 23 bp, Homo sapiens
cgtgttagatcatagacacacgg

SEQ ID NO: 9656 - DNA, 23 bp, Homo sapiens
gggggtgctaggaattctgatgg

SEQ ID NO: 9657 - DNA, 23 bp, Homo sapiens
cctcgcccagggcgctgagcggg

SEQ ID NO: 9658 - DNA, 23 bp, Homo sapiens
gctccagagttgcaagtgacagg

SEQ ID NO: 9659 - DNA, 23 bp, Homo sapiens
ccgcgctcagttattgtctctgg

SEQ ID NO: 9660 - DNA, 23 bp, Homo sapiens
atgcgctgtgggtgcgggcaggg

SEQ ID NO: 9661 - DNA, 23 bp, Homo sapiens
aattcaggaattcagtggagagg

SEQ ID NO: 9662 - DNA, 23 bp, Homo sapiens
ctgagttacatgtgcatgatagg

SEQ ID NO: 9663 - DNA, 23 bp, Homo sapiens
catttttggagccagctgagagg

SEQ ID NO: 9664 - DNA, 23 bp, Homo sapiens
aagcaaaaagtgtctgtttgtgg

SEQ ID NO: 9665 - DNA, 23 bp, Homo sapiens
tcggacccgggcagttagtgggg

SEQ ID NO: 9666 - DNA, 23 bp, Homo sapiens
gacccaggaagaaggcacagggg

SEQ ID NO: 9667 - DNA, 23 bp, Homo sapiens
gggccctgggccagggtcagtgg

SEQ ID NO: 9668 - DNA, 23 bp, Homo sapiens
catccaggatgatgaggtggtgg

SEQ ID NO: 9669 - DNA, 23 bp, Homo sapiens
ttgtcagattcaggtgattcagg

SEQ ID NO: 9670 - DNA, 23 bp, Homo sapiens
gtctttatcttggagttcagtgg

SEQ ID NO: 9671 - DNA, 23 bp, Homo sapiens
ttccggcttttattccattttgg

SEQ ID NO: 9672 - DNA, 23 bp, Homo sapiens
tttctgatcctggtcttccaggg

SEQ ID NO: 9673 - DNA, 23 bp, Homo sapiens
gtgcttgtgacaacttccagtgg

SEQ ID NO: 9674 - DNA, 23 bp, Homo sapiens
acatgacattttgaaacagctgg

SEQ ID NO: 9675 - DNA, 23 bp, Homo sapiens
cattaccctgacctggactcagg

SEQ ID NO: 9676 - DNA, 23 bp, Homo sapiens
gacattgtcaaagagctgcatgg

SEQ ID NO: 9677 - DNA, 23 bp, Homo sapiens
gctgtttgagaatgtcatctagg

SEQ ID NO: 9678 - DNA, 23 bp, Homo sapiens
cacattttcaaagagctgcatgg

SEQ ID NO: 9679 - DNA, 23 bp, Homo sapiens
gacttctgacaagatgaagttgg

SEQ ID NO: 9680 - DNA, 23 bp, Homo sapiens
cattgctgatgcgcacactaagg

SEQ ID NO: 9681 - DNA, 23 bp, Homo sapiens
gagagaccatggctcaggacagg

SEQ ID NO: 9682 - DNA, 23 bp, Homo sapiens
ggagcagcggccctacagacggg

SEQ ID NO: 9683 - DNA, 23 bp, Homo sapiens
gacctggatatccacatcaatgg

SEQ ID NO: 9684 - DNA, 23 bp, Homo sapiens
gacatcagtttgcatcatggagg

SEQ ID NO: 9685 - DNA, 23 bp, Homo sapiens
atcagagggaaagagaactgagg

SEQ ID NO: 9686 - DNA, 23 bp, Homo sapiens
gtcaggagagctttctgataagg

SEQ ID NO: 9687 - DNA, 23 bp, Homo sapiens
agcagcggccctacagacggggg

SEQ ID NO: 9688 - DNA, 23 bp, Homo sapiens
caggcccttacggcgagagtcgg

SEQ ID NO: 9689 - DNA, 23 bp, Homo sapiens
cagcttgcagcgaatctgcgcgg

SEQ ID NO: 9690 - DNA, 23 bp, Homo sapiens
gaaggcattgtggaaacaactgg

SEQ ID NO: 9691 - DNA, 23 bp, Homo sapiens
gaggagcagctaggatggaaggg

SEQ ID NO: 9692 - DNA, 23 bp, Homo sapiens
ttctcagacgagttactccgcgg

SEQ ID NO: 9693 - DNA, 23 bp, Homo sapiens
ggccgggcctggaggtcagatgg

SEQ ID NO: 9694 - DNA, 23 bp, Homo sapiens
ggccaggggctcggtgtgagggg

SEQ ID NO: 9695 - DNA, 23 bp, Homo sapiens
ccagctagggcactaaactttgg

SEQ ID NO: 9696 - DNA, 23 bp, Homo sapiens
gtgcaatttatgactccagaagg

SEQ ID NO: 9697 - DNA, 23 bp, Homo sapiens
ggaggaagctggtcacaccttgg

SEQ ID NO: 9698 - DNA, 23 bp, Homo sapiens
gcaacaaatcctacgctcaatgg

SEQ ID NO: 9699 - DNA, 23 bp, Homo sapiens
tcaagtaatgagttgttctccgg

SEQ ID NO: 9700 - DNA, 23 bp, Homo sapiens
gggcggacgggcggtctacctgg

SEQ ID NO: 9701 - DNA, 23 bp, Homo sapiens
tggcagagaccagtggggacagg

SEQ ID NO: 9702 - DNA, 23 bp, Homo sapiens
gcctgggtggggttgtcagatgg

SEQ ID NO: 9703 - DNA, 23 bp, Homo sapiens
aagaaaggactgggaagctgagg

SEQ ID NO: 9704 - DNA, 23 bp, Homo sapiens
aagatccccatctctgcatgagg

SEQ ID NO: 9705 - DNA, 23 bp, Homo sapiens
ggttcctctgcacaggtctgagg

SEQ ID NO: 9706 - DNA, 23 bp, Homo sapiens
agatttctggccgggcacggtgg

SEQ ID NO: 9707 - DNA, 23 bp, Homo sapiens
tcacgctgcaggctgtggcaagg

SEQ ID NO: 9708 - DNA, 23 bp, Homo sapiens
ctttcaagttggtgcaaaacagg

SEQ ID NO: 9709 - DNA, 23 bp, Homo sapiens
ggtttgacgccacactgtgctgg

SEQ ID NO: 9710 - DNA, 23 bp, Homo sapiens
ggcccctcggggcagtcacacgg

SEQ ID NO: 9711 - DNA, 23 bp, Homo sapiens
acaaaggcgtgccggtgtagggg

SEQ ID NO: 9712 - DNA, 23 bp, Homo sapiens
aacagccccaagggcacatgagg

SEQ ID NO: 9713 - DNA, 23 bp, Homo sapiens
gcttccatccccaggtagctggg

SEQ ID NO: 9714 - DNA, 23 bp, Homo sapiens
atttatgggagtcctagtccagg

SEQ ID NO: 9715 - DNA, 23 bp, Homo sapiens
cacctgacgcttcagcaagcagg

SEQ ID NO: 9716 - DNA, 23 bp, Homo sapiens
tccagggcacggcgtgggagggg

SEQ ID NO: 9717 - DNA, 23 bp, Homo sapiens
tttccctccccacacctaaacgg

SEQ ID NO: 9718 - DNA, 23 bp, Homo sapiens
gcccaagtccagggagtcccggg

SEQ ID NO: 9719 - DNA, 23 bp, Homo sapiens
accttcgatgtatggttgctagg

SEQ ID NO: 9720 - DNA, 23 bp, Homo sapiens
agaagtacgtgcaggaagagcgg

SEQ ID NO: 9721 - DNA, 23 bp, Homo sapiens
ccactgcgggggcaagacgaagg

SEQ ID NO: 9722 - DNA, 23 bp, Homo sapiens
gggaaaaatcctttgggcaaggg

SEQ ID NO: 9723 - DNA, 23 bp, Homo sapiens
tcgaggtggctagatgtcgtcgg

SEQ ID NO: 9724 - DNA, 23 bp, Homo sapiens
tggatggatggctctacttctgg

SEQ ID NO: 9725 - DNA, 23 bp, Homo sapiens
tactatgtgagaggatccaacgg

SEQ ID NO: 9726 - DNA, 23 bp, Homo sapiens
agagcagagaaatcttaagacgg

SEQ ID NO: 9727 - DNA, 23 bp, Homo sapiens
tgtaggagagctttctgacctgg

SEQ ID NO: 9728 - DNA, 23 bp, Homo sapiens
aagcgcaagttctcttaaagggg

SEQ ID NO: 9729 - DNA, 23 bp, Homo sapiens
ccccctcggactgcgggtgacgg

SEQ ID NO: 9730 - DNA, 23 bp, Homo sapiens
tagctactctctgatgaagttgg

SEQ ID NO: 9731 - DNA, 23 bp, Homo sapiens
caactgcttgaacttgtgtacgg

SEQ ID NO: 9732 - DNA, 23 bp, Homo sapiens
cagccagcagtccaagtagctgg

SEQ ID NO: 9733 - DNA, 23 bp, Homo sapiens
cccgatgaggggtcctgaggagg

SEQ ID NO: 9734 - DNA, 23 bp, Homo sapiens
gccgggcccaggaagtgaggcgg

SEQ ID NO: 9735 - DNA, 23 bp, Homo sapiens
aagtggggtttaagaacaaatgg

SEQ ID NO: 9736 - DNA, 23 bp, Homo sapiens
agccagtgacctcttttaaatgg

SEQ ID NO: 9737 - DNA, 23 bp, Homo sapiens
tcagcaccaacatggactgaggg

SEQ ID NO: 9738 - DNA, 23 bp, Homo sapiens
gtttgacatgaggcaagctgagg

SEQ ID NO: 9739 - DNA, 23 bp, Homo sapiens
caccacaacctccgcctctgggg

SEQ ID NO: 9740 - DNA, 23 bp, Homo sapiens
ttctttatctgagattgctctgg

SEQ ID NO: 9741 - DNA, 23 bp, Homo sapiens
ccctggttttaatacatctgagg

SEQ ID NO: 9742 - DNA, 23 bp, Homo sapiens
aatgattccctacgttagccggg

SEQ ID NO: 9743 - DNA, 23 bp, Homo sapiens
aattgcacagcaaaatgagcggg

SEQ ID NO: 9744 - DNA, 23 bp, Homo sapiens
ctgtgtctcgtcgcgagtctcgg

SEQ ID NO: 9745 - DNA, 23 bp, Homo sapiens
cactggtcaagattctcgggagg

SEQ ID NO: 9746 - DNA, 23 bp, Homo sapiens
gaatatgggcaggtctatagtgg

SEQ ID NO: 9747 - DNA, 23 bp, Homo sapiens
gcagcgggggagatgatttctgg

SEQ ID NO: 9748 - DNA, 23 bp, Homo sapiens
tcttgtcttggggtgagctgtgg

SEQ ID NO: 9749 - DNA, 23 bp, Homo sapiens
taatctttactgccctagggtgg

SEQ ID NO: 9750 - DNA, 23 bp, Homo sapiens
tcctggctcagggtgtctcctgg

SEQ ID NO: 9751 - DNA, 23 bp, Homo sapiens
gcaagagcctctggactaaatgg

SEQ ID NO: 9752 - DNA, 23 bp, Homo sapiens
gcccacctccaccagtgagcagg

SEQ ID NO: 9753 - DNA, 23 bp, Homo sapiens
ctgcgctttgtccggcactgagg

SEQ ID NO: 9754 - DNA, 23 bp, Homo sapiens
caccgagtacgtcttctgcaggg

SEQ ID NO: 9755 - DNA, 23 bp, Homo sapiens
tggccaacaaattgtcttcaagg

SEQ ID NO: 9756 - DNA, 23 bp, Homo sapiens
ctgccggctcaactcggtacagg

SEQ ID NO: 9757 - DNA, 23 bp, Homo sapiens
gtctcctagcgtccgagagatgg

SEQ ID NO: 9758 - DNA, 23 bp, Homo sapiens
ttcctgagagaaaacatccttgg

SEQ ID NO: 9759 - DNA, 23 bp, Homo sapiens
gccagaggcacccggatgtgagg

SEQ ID NO: 9760 - DNA, 23 bp, Homo sapiens
agatcacctccagggacttgggg

SEQ ID NO: 9761 - DNA, 23 bp, Homo sapiens
tgaggctgagcttgcagtgaggg

SEQ ID NO: 9762 - DNA, 23 bp, Homo sapiens
actgagaacgggaagaacaaggg

SEQ ID NO: 9763 - DNA, 23 bp, Homo sapiens
aagtacctacaagaggactaggg

SEQ ID NO: 9764 - DNA, 23 bp, Homo sapiens
ttcttcaggagagaggatcgcgg

SEQ ID NO: 9765 - DNA, 23 bp, Homo sapiens
tctaacgactttcaggattaggg

SEQ ID NO: 9766 - DNA, 23 bp, Homo sapiens
ttcttctcacccacatgctctgg

SEQ ID NO: 9767 - DNA, 23 bp, Homo sapiens
aaaaagtgattcttcaggtcagg

SEQ ID NO: 9768 - DNA, 23 bp, Homo sapiens
gctgtgaacaattgaccctttgg

SEQ ID NO: 9769 - DNA, 23 bp, Homo sapiens
aacgaggctcaaggatgtgaggg

SEQ ID NO: 9770 - DNA, 23 bp, Homo sapiens
gagatcagtcgtctgtcttccgg

SEQ ID NO: 9771 - DNA, 23 bp, Homo sapiens
atgagttcaagatcacatggtgg

SEQ ID NO: 9772 - DNA, 23 bp, Homo sapiens
tctatgagttcaagatcacatgg

SEQ ID NO: 9773 - DNA, 23 bp, Homo sapiens
ctgaactgttgcagaagtatggg

SEQ ID NO: 9774 - DNA, 23 bp, Homo sapiens
acactttgtgacatgtgtagtgg

SEQ ID NO: 9775 - DNA, 23 bp, Homo sapiens
tgcatatcagagttcatctttgg

SEQ ID NO: 9776 - DNA, 23 bp, Homo sapiens
actcaaagttcttctcttgaagg

SEQ ID NO: 9777 - DNA, 23 bp, Homo sapiens
ggagaggaccggggctatgccgg

SEQ ID NO: 9778 - DNA, 23 bp, Homo sapiens
atggtctttggcacttatgctgg

SEQ ID NO: 9779 - DNA, 23 bp, Homo sapiens
tgcattaaacagaaaccttctgg

SEQ ID NO: 9780 - DNA, 23 bp, Homo sapiens
gtctctgaaggtcctcagattgg

SEQ ID NO: 9781 - DNA, 23 bp, Homo sapiens
aaatggatgagtaactccttagg

SEQ ID NO: 9782 - DNA, 23 bp, Homo sapiens
gcaggggttagcagtacacctgg

SEQ ID NO: 9783 - DNA, 23 bp, Homo sapiens
atgcatctgtctcacatgcttgg

SEQ ID NO: 9784 - DNA, 23 bp, Homo sapiens
gttacaggggcatatttgagtgg

SEQ ID NO: 9785 - DNA, 23 bp, Homo sapiens
gtatcagcttctcgtcagacagg

SEQ ID NO: 9786 - DNA, 23 bp, Homo sapiens
cggctcactcatcccccaaacgg

SEQ ID NO: 9787 - DNA, 23 bp, Homo sapiens
tggactaactcagtttttgcagg

SEQ ID NO: 9788 - DNA, 23 bp, Homo sapiens
agattaaggtttgccaaaactgg

SEQ ID NO: 9789 - DNA, 23 bp, Homo sapiens
atccaaactggcaaggtcctagg

SEQ ID NO: 9790 - DNA, 23 bp, Homo sapiens
ataccgggccatcatggagtagg

SEQ ID NO: 9791 - DNA, 23 bp, Homo sapiens
gagcggccagctgtcctagaagg

SEQ ID NO: 9792 - DNA, 23 bp, Homo sapiens
tggagcagacattatccaagggg

SEQ ID NO: 9793 - DNA, 23 bp, Homo sapiens
atgcagactactgtctcttctgg

SEQ ID NO: 9794 - DNA, 23 bp, Homo sapiens
taatgggagcatatatgatgagg

SEQ ID NO: 9795 - DNA, 23 bp, Homo sapiens
taggcagaatacctttacagagg

SEQ ID NO: 9796 - DNA, 23 bp, Homo sapiens
agcccgtggacttagggcacagg

SEQ ID NO: 9797 - DNA, 23 bp, Homo sapiens
tgctgaaggccaccactcaaagg

SEQ ID NO: 9798 - DNA, 23 bp, Homo sapiens
ctaaccaagcatctgctaactgg

SEQ ID NO: 9799 - DNA, 23 bp, Homo sapiens
ttgtgtttttactttcggcttgg

SEQ ID NO: 9800 - DNA, 23 bp, Homo sapiens
aatgctggttagaggctaccagg

SEQ ID NO: 9801 - DNA, 23 bp, Homo sapiens
aggcctcccagagagaatcgagg

SEQ ID NO: 9802 - DNA, 23 bp, Homo sapiens
cactgtcacaactgttgctgagg

SEQ ID NO: 9803 - DNA, 23 bp, Homo sapiens
ggttatgcccctgatgaatgggg

SEQ ID NO: 9804 - DNA, 23 bp, Homo sapiens
caactgttgctcatcagagtagg

SEQ ID NO: 9805 - DNA, 23 bp, Homo sapiens
ggaacaatatcaagatgaggcgg

SEQ ID NO: 9806 - DNA, 23 bp, Homo sapiens
ccagccagcacgtcgcgatgagg

SEQ ID NO: 9807 - DNA, 23 bp, Homo sapiens
gtcacacaaagaaacgtgcatgg

SEQ ID NO: 9808 - DNA, 23 bp, Homo sapiens
agcttctggtggtcgtagccagg

SEQ ID NO: 9809 - DNA, 23 bp, Homo sapiens
gagctctcctcctgtttaaaagg

SEQ ID NO: 9810 - DNA, 23 bp, Homo sapiens
ctatgctgtcaaaacttccaagg

SEQ ID NO: 9811 - DNA, 23 bp, Homo sapiens
agaaacaaaagtgcctcaacagg

SEQ ID NO: 9812 - DNA, 23 bp, Homo sapiens
cgctgccagctctggtaacttgg

SEQ ID NO: 9813 - DNA, 23 bp, Homo sapiens
gacctgcttcagacttctgcagg

SEQ ID NO: 9814 - DNA, 23 bp, Homo sapiens
acggatacagtgaactcaaatgg

SEQ ID NO: 9815 - DNA, 23 bp, Homo sapiens
tcccaggggagatcagtctccgg

SEQ ID NO: 9816 - DNA, 23 bp, Homo sapiens
acccagttactagattatgaagg

SEQ ID NO: 9817 - DNA, 23 bp, Homo sapiens
gcatacagagagcacccatatgg

SEQ ID NO: 9818 - DNA, 23 bp, Homo sapiens
acccctatggtagatattgaagg

SEQ ID NO: 9819 - DNA, 23 bp, Homo sapiens
tacaatcagtatctgccatatgg

SEQ ID NO: 9820 - DNA, 23 bp, Homo sapiens
tgtggcctgcagggctttgatgg

SEQ ID NO: 9821 - DNA, 23 bp, Homo sapiens
ctcaaaagttaagactgagcagg

SEQ ID NO: 9822 - DNA, 23 bp, Homo sapiens
cacgcagcagggacagcagcagg

SEQ ID NO: 9823 - DNA, 23 bp, Homo sapiens
tgagtggtttatggaatagatgg

SEQ ID NO: 9824 - DNA, 23 bp, Homo sapiens
gttcacctgttctaaagcaaagg

SEQ ID NO: 9825 - DNA, 23 bp, Homo sapiens
tttggcaggcgcaaatgatttgg

SEQ ID NO: 9826 - DNA, 23 bp, Homo sapiens
gtaagactaggttttggctaagg

SEQ ID NO: 9827 - DNA, 23 bp, Homo sapiens
agtgttgtaagactaggttttgg

SEQ ID NO: 9828 - DNA, 23 bp, Homo sapiens
gtgggtgggccctagtgaagagg

SEQ ID NO: 9829 - DNA, 23 bp, Homo sapiens
aacaggaaagaatggaactgagg

SEQ ID NO: 9830 - DNA, 23 bp, Homo sapiens
attgctcaaaggacagataatgg

SEQ ID NO: 9831 - DNA, 23 bp, Homo sapiens
gagacagaccaggtggctacagg

SEQ ID NO: 9832 - DNA, 23 bp, Homo sapiens
ggctggcctggggtcagtactgg

SEQ ID NO: 9833 - DNA, 23 bp, Homo sapiens
agacagcagacctgaactgcagg

SEQ ID NO: 9834 - DNA, 23 bp, Homo sapiens
agaatctctatgtcttttggtgg

SEQ ID NO: 9835 - DNA, 23 bp, Homo sapiens
tctgcgatccgaagcattgatgg

SEQ ID NO: 9836 - DNA, 23 bp, Homo sapiens
aagcaacagcccatctggtaagg

SEQ ID NO: 9837 - DNA, 23 bp, Homo sapiens
tgagcaaatggccactgagtagg

SEQ ID NO: 9838 - DNA, 23 bp, Homo sapiens
gagacgacggcgctgctgactgg

SEQ ID NO: 9839 - DNA, 23 bp, Homo sapiens
acacgtaggtaactttgtgatgg

SEQ ID NO: 9840 - DNA, 23 bp, Homo sapiens
cagcacagtgtttatgccactgg

SEQ ID NO: 9841 - DNA, 23 bp, Homo sapiens
ggggcagataccttctgaacggg

SEQ ID NO: 9842 - DNA, 23 bp, Homo sapiens
tcttagaggctgctacataaagg

SEQ ID NO: 9843 - DNA, 23 bp, Homo sapiens
tgccatttctcatcaccaccagg

SEQ ID NO: 9844 - DNA, 23 bp, Homo sapiens
agaggagcagtgcatgctttggg

SEQ ID NO: 9845 - DNA, 23 bp, Homo sapiens
ttctgcctcagataacatagagg

SEQ ID NO: 9846 - DNA, 23 bp, Homo sapiens
agtgaatgaactgactgacaggg

SEQ ID NO: 9847 - DNA, 23 bp, Homo sapiens
agccctcaacggacatcagtcgg

SEQ ID NO: 9848 - DNA, 23 bp, Homo sapiens
gccattctggatggctccctagg

SEQ ID NO: 9849 - DNA, 23 bp, Homo sapiens
ccgcacgcggctaggtcatcagg

SEQ ID NO: 9850 - DNA, 23 bp, Homo sapiens
tcatgatttcattgtgcagatgg

SEQ ID NO: 9851 - DNA, 23 bp, Homo sapiens
agtcactatggtaaccaagatgg

SEQ ID NO: 9852 - DNA, 23 bp, Homo sapiens
cgagtggacaattctggaactgg

SEQ ID NO: 9853 - DNA, 23 bp, Homo sapiens
tactgcactacaggatgaaaagg

SEQ ID NO: 9854 - DNA, 23 bp, Homo sapiens
cttcgttgtcaaaagaaaggagg

SEQ ID NO: 9855 - DNA, 23 bp, Homo sapiens
gaaataaaggctgccaaagcagg

SEQ ID NO: 9856 - DNA, 23 bp, Homo sapiens
gtcctgttggctcctcctacggg

SEQ ID NO: 9857 - DNA, 23 bp, Homo sapiens
aagagggctctagaagccagtgg

SEQ ID NO: 9858 - DNA, 23 bp, Homo sapiens
attgcgtgatttctgccatgtgg

SEQ ID NO: 9859 - DNA, 23 bp, Homo sapiens
ccaaaaggaaagcaaaggcttgg

SEQ ID NO: 9860 - DNA, 23 bp, Homo sapiens
gccccagattataaaataggtgg

SEQ ID NO: 9861 - DNA, 23 bp, Homo sapiens
ggatccccgccaatatcgtcagg

SEQ ID NO: 9862 - DNA, 23 bp, Homo sapiens
ttaagaggtttcttttgctgtgg

SEQ ID NO: 9863 - DNA, 23 bp, Homo sapiens
gtggccagaacggccataagcgg

SEQ ID NO: 9864 - DNA, 23 bp, Homo sapiens
ggtctgtgctgctcaggagatgg

SEQ ID NO: 9865 - DNA, 23 bp, Homo sapiens
aggcaggcagtgcctctcacagg

SEQ ID NO: 9866 - DNA, 23 bp, Homo sapiens
ctctttcagaggactcctgatgg

SEQ ID NO: 9867 - DNA, 23 bp, Homo sapiens
tcatatatttggggatcttgagg

SEQ ID NO: 9868 - DNA, 23 bp, Homo sapiens
gttggaggagaatcagattctgg

SEQ ID NO: 9869 - DNA, 23 bp, Homo sapiens
aaagagaggttgtgattgattgg

SEQ ID NO: 9870 - DNA, 23 bp, Homo sapiens
cagatgtttacggactgacatgg

SEQ ID NO: 9871 - DNA, 23 bp, Homo sapiens
ctgaaatacattggccaacatgg

SEQ ID NO: 9872 - DNA, 23 bp, Homo sapiens
gaggagaagatgggcctcccggg

SEQ ID NO: 9873 - DNA, 23 bp, Homo sapiens
tgcgctggatcatctccgagcgg

SEQ ID NO: 9874 - DNA, 23 bp, Homo sapiens
gcagaacttccacagctgatcgg

SEQ ID NO: 9875 - DNA, 23 bp, Homo sapiens
cggggctaaggcgttagacctgg

SEQ ID NO: 9876 - DNA, 23 bp, Homo sapiens
attttacaggactgctaccaagg

SEQ ID NO: 9877 - DNA, 23 bp, Homo sapiens
agtcttccatgagaatcaattgg

SEQ ID NO: 9878 - DNA, 23 bp, Homo sapiens
tcagaggcttttctggtctttgg

SEQ ID NO: 9879 - DNA, 23 bp, Homo sapiens
gaactctggaaggtcatcagcgg

SEQ ID NO: 9880 - DNA, 23 bp, Homo sapiens
tatgagaaccaagtttgaccagg

SEQ ID NO: 9881 - DNA, 23 bp, Homo sapiens
catgcattggcctggcatctagg

SEQ ID NO: 9882 - DNA, 23 bp, Homo sapiens
tgaaggggcctctcagctagagg

SEQ ID NO: 9883 - DNA, 23 bp, Homo sapiens
tctaaaagtcgttttggtcaagg

SEQ ID NO: 9884 - DNA, 23 bp, Homo sapiens
tctaagagcaacagaaaaagtgg

SEQ ID NO: 9885 - DNA, 23 bp, Homo sapiens
gggccccagtgggggctcactgg

SEQ ID NO: 9886 - DNA, 23 bp, Homo sapiens
tgtgtggtctttgagcccgttgg

SEQ ID NO: 9887 - DNA, 23 bp, Homo sapiens
ctacaaatacccaggccttaagg

SEQ ID NO: 9888 - DNA, 23 bp, Homo sapiens
ctgttagttcactcagacactgg

SEQ ID NO: 9889 - DNA, 23 bp, Homo sapiens
attcaagatgcagctctgtcagg

SEQ ID NO: 9890 - DNA, 23 bp, Homo sapiens
agtgttagttgccatgttgatgg

SEQ ID NO: 9891 - DNA, 23 bp, Homo sapiens
tcttctgagagcacaggctttgg

SEQ ID NO: 9892 - DNA, 23 bp, Homo sapiens
tgagatagatagctcttcagagg

SEQ ID NO: 9893 - DNA, 23 bp, Homo sapiens
ccaacccccaagtgaattaaagg

SEQ ID NO: 9894 - DNA, 23 bp, Homo sapiens
ggttcccacttggccttcaatgg

SEQ ID NO: 9895 - DNA, 23 bp, Homo sapiens
atctctaattccagcactttggg

SEQ ID NO: 9896 - DNA, 23 bp, Homo sapiens
tgcttgctgctctcaccgtgagg

SEQ ID NO: 9897 - DNA, 23 bp, Homo sapiens
ttgacagcacagaacccaaaagg

SEQ ID NO: 9898 - DNA, 23 bp, Homo sapiens
ccctaaggcagcggctcagctgg

SEQ ID NO: 9899 - DNA, 23 bp, Homo sapiens
cacacccagtaggattcagtggg

SEQ ID NO: 9900 - DNA, 23 bp, Homo sapiens
ggaaaatgtcaggcttgctgagg

SEQ ID NO: 9901 - DNA, 23 bp, Homo sapiens
actacagcagccacgggacgggg

SEQ ID NO: 9902 - DNA, 23 bp, Homo sapiens
catttgacaagactctaaggagg

SEQ ID NO: 9903 - DNA, 23 bp, Homo sapiens
gcaagcagctgtgctcacagagg

SEQ ID NO: 9904 - DNA, 23 bp, Homo sapiens
attatcttgtcgaacacgtttgg

SEQ ID NO: 9905 - DNA, 23 bp, Homo sapiens
ctcccaggtgactggcactaggg

SEQ ID NO: 9906 - DNA, 23 bp, Homo sapiens
ttctggcggtcaggacaccttgg

SEQ ID NO: 9907 - DNA, 23 bp, Homo sapiens
atgctcccggcataactgagggg

SEQ ID NO: 9908 - DNA, 23 bp, Homo sapiens
ctcaggttcagacccgcatctgg

SEQ ID NO: 9909 - DNA, 23 bp, Homo sapiens
gagtcacttagtatttcgactgg

SEQ ID NO: 9910 - DNA, 23 bp, Homo sapiens
tcagcacccaatctcaaagctgg

SEQ ID NO: 9911 - DNA, 23 bp, Homo sapiens
ggattaagtcagggccatcttgg

SEQ ID NO: 9912 - DNA, 23 bp, Homo sapiens
ccctgacctcaaggagagtgggg

SEQ ID NO: 9913 - DNA, 23 bp, Homo sapiens
ttactcaaatctgggccttttgg

SEQ ID NO: 9914 - DNA, 23 bp, Homo sapiens
gaagtcgtcgtttgataatctgg

SEQ ID NO: 9915 - DNA, 23 bp, Homo sapiens
ctctgacacaggagatctggggg

SEQ ID NO: 9916 - DNA, 23 bp, Homo sapiens
ctctgacctcactcctagggtgg

SEQ ID NO: 9917 - DNA, 23 bp, Homo sapiens
gagttggggagggtcagggcagg

SEQ ID NO: 9918 - DNA, 23 bp, Homo sapiens
gtgaggagacgacggtcaggagg

SEQ ID NO: 9919 - DNA, 23 bp, Homo sapiens
tgtgcgtgatgctgatatccagg

SEQ ID NO: 9920 - DNA, 23 bp, Homo sapiens
cacagggtctggctctaagacgg

SEQ ID NO: 9921 - DNA, 23 bp, Homo sapiens
aacggaggggaagaggaggccgg

SEQ ID NO: 9922 - DNA, 23 bp, Homo sapiens
ccgcaggaggtggacgtctgagg

SEQ ID NO: 9923 - DNA, 23 bp, Homo sapiens
caagggtctggctcatctaccgg

SEQ ID NO: 9924 - DNA, 23 bp, Homo sapiens
cgaagtatctaggaaaccaaggg

SEQ ID NO: 9925 - DNA, 23 bp, Homo sapiens
agaccccgtgccctttaaaccgg

SEQ ID NO: 9926 - DNA, 23 bp, Homo sapiens
tgacctccacgtgaagagcaagg

SEQ ID NO: 9927 - DNA, 23 bp, Homo sapiens
tttttatttgcagtcgtcactgg

SEQ ID NO: 9928 - DNA, 23 bp, Homo sapiens
ggaaagcaaggccaaagacaggg

SEQ ID NO: 9929 - DNA, 23 bp, Homo sapiens
aggagaagctggctttactttgg

SEQ ID NO: 9930 - DNA, 23 bp, Homo sapiens
gacgtgatggttgtcactcatgg

SEQ ID NO: 9931 - DNA, 23 bp, Homo sapiens
gatgatgactccaacttcagtgg

SEQ ID NO: 9932 - DNA, 23 bp, Homo sapiens
cgtgggtgtgggagattagctgg

SEQ ID NO: 9933 - DNA, 23 bp, Homo sapiens
gtggcagtgcgaggtggaggagg

SEQ ID NO: 9934 - DNA, 23 bp, Homo sapiens
catgccattcgagggggaggagg

SEQ ID NO: 9935 - DNA, 23 bp, Homo sapiens
cttctgcagaatgctctgtctgg

SEQ ID NO: 9936 - DNA, 23 bp, Homo sapiens
gaaggggctgagtgatgttttgg

SEQ ID NO: 9937 - DNA, 23 bp, Homo sapiens
ttcccaaggtcttcaggatgagg

SEQ ID NO: 9938 - DNA, 23 bp, Homo sapiens
ggtctgccccgagggcttacagg

SEQ ID NO: 9939 - DNA, 23 bp, Homo sapiens
tctattttctatgtgcctgctgg

SEQ ID NO: 9940 - DNA, 23 bp, Homo sapiens
gaaccttactactatggctatgg

SEQ ID NO: 9941 - DNA, 23 bp, Homo sapiens
gatccgtcttcacttcctgttgg

SEQ ID NO: 9942 - DNA, 23 bp, Homo sapiens
caggtctctgctggcagaggcgg

SEQ ID NO: 9943 - DNA, 23 bp, Homo sapiens
ccggaggaagctgcagccctcgg

SEQ ID NO: 9944 - DNA, 23 bp, Homo sapiens
cgcggccactgcctgtgtgacgg

SEQ ID NO: 9945 - DNA, 23 bp, Homo sapiens
ttaaaaggacgcagagttgaagg

SEQ ID NO: 9946 - DNA, 23 bp, Homo sapiens
ttggatcagggctcagcatttgg

SEQ ID NO: 9947 - DNA, 23 bp, Homo sapiens
taccagcagctggaatctgaagg

SEQ ID NO: 9948 - DNA, 23 bp, Homo sapiens
ccttctttctccttcatcgctgg

SEQ ID NO: 9949 - DNA, 23 bp, Homo sapiens
ggccttgaggggatcttctaggg

SEQ ID NO: 9950 - DNA, 23 bp, Homo sapiens
ggaggtgtcatacgcataattgg

SEQ ID NO: 9951 - DNA, 23 bp, Homo sapiens
gacacctacatgttctgattggg

SEQ ID NO: 9952 - DNA, 23 bp, Homo sapiens
ggtcttgagggggttttctaggg

SEQ ID NO: 9953 - DNA, 23 bp, Homo sapiens
acagataccagcgtgtaacacgg

SEQ ID NO: 9954 - DNA, 23 bp, Homo sapiens
taatggaccaagagcctgcaggg

SEQ ID NO: 9955 - DNA, 23 bp, Homo sapiens
gcatgcagactcacgtgtagggg

SEQ ID NO: 9956 - DNA, 23 bp, Homo sapiens
aaagatgtcacacgtgagtctgg

SEQ ID NO: 9957 - DNA, 23 bp, Homo sapiens
ggatctccaacttgccataatgg

SEQ ID NO: 9958 - DNA, 23 bp, Homo sapiens
agcaggagtgcaatgaacagggg

SEQ ID NO: 9959 - DNA, 23 bp, Homo sapiens
cggatgcagactcacgtctaagg

SEQ ID NO: 9960 - DNA, 23 bp, Homo sapiens
gaagcgctgggcggggctgaggg

SEQ ID NO: 9961 - DNA, 23 bp, Homo sapiens
ggacaacgcccctctctgagcgg

SEQ ID NO: 9962 - DNA, 23 bp, Homo sapiens
acatcgtcgtgcacaagcagagg

SEQ ID NO: 9963 - DNA, 23 bp, Homo sapiens
gagacagccaagtcttacaaggg

SEQ ID NO: 9964 - DNA, 23 bp, Homo sapiens
catcagaatcatcggtgttatgg

SEQ ID NO: 9965 - DNA, 23 bp, Homo sapiens
tcacacccgaaagtctttactgg

SEQ ID NO: 9966 - DNA, 23 bp, Homo sapiens
actctcttgcctttctttaatgg

SEQ ID NO: 9967 - DNA, 23 bp, Homo sapiens
cgacagcagcagcagtggcctgg

SEQ ID NO: 9968 - DNA, 23 bp, Homo sapiens
gaggaaaatgaagctcgggctgg

SEQ ID NO: 9969 - DNA, 23 bp, Homo sapiens
cccttcagcattagcccaccagg

SEQ ID NO: 9970 - DNA, 23 bp, Homo sapiens
cgcagttcactggacgttagtgg

SEQ ID NO: 9971 - DNA, 23 bp, Homo sapiens
aatgtcagctgcttgaagagagg

SEQ ID NO: 9972 - DNA, 23 bp, Homo sapiens
gcagatggatgagctaagagagg

SEQ ID NO: 9973 - DNA, 23 bp, Homo sapiens
agtgccagggcagggctcaaagg

SEQ ID NO: 9974 - DNA, 23 bp, Homo sapiens
ctttccggtctgtcactgtgtgg

SEQ ID NO: 9975 - DNA, 23 bp, Homo sapiens
catgccagcctctgcctgaaagg

SEQ ID NO: 9976 - DNA, 23 bp, Homo sapiens
cggaggcatatgttggtgtgagg

SEQ ID NO: 9977 - DNA, 23 bp, Homo sapiens
ctgagaagcccaggggcttttgg

SEQ ID NO: 9978 - DNA, 23 bp, Homo sapiens
gtggcgggctcagggcgagctgg

SEQ ID NO: 9979 - DNA, 23 bp, Homo sapiens
gacagcaatgactgtcctacagg

SEQ ID NO: 9980 - DNA, 23 bp, Homo sapiens
ttcagggcgctttcagttcacgg

SEQ ID NO: 9981 - DNA, 23 bp, Homo sapiens
gggctgcacgagggccctacagg

SEQ ID NO: 9982 - DNA, 23 bp, Homo sapiens
tcctcctgctgctggtccttagg

SEQ ID NO: 9983 - DNA, 23 bp, Homo sapiens
atgaaacggcacatgtagccggg

SEQ ID NO: 9984 - DNA, 23 bp, Homo sapiens
gaggcaatcagactagcatgtgg

SEQ ID NO: 9985 - DNA, 23 bp, Homo sapiens
acctcgccttacacatgaagagg

SEQ ID NO: 9986 - DNA, 23 bp, Homo sapiens
acacgggcagtgctcagttctgg

SEQ ID NO: 9987 - DNA, 23 bp, Homo sapiens
ccacctctctgctccctcagagg

SEQ ID NO: 9988 - DNA, 23 bp, Homo sapiens
acctggccctgcacatgaagagg

SEQ ID NO: 9989 - DNA, 23 bp, Homo sapiens
agatatgtctcttcatgtggagg

SEQ ID NO: 9990 - DNA, 23 bp, Homo sapiens
ccatcccaggtgcatttataagg

SEQ ID NO: 9991 - DNA, 23 bp, Homo sapiens
tgtgacctgtgcggctcacatgg

SEQ ID NO: 9992 - DNA, 23 bp, Homo sapiens
gcgctggccaacgctttgtgagg

SEQ ID NO: 9993 - DNA, 23 bp, Homo sapiens
tttggactctttgttcttctcgg

SEQ ID NO: 9994 - DNA, 23 bp, Homo sapiens
ctcatcgaacgcttgaaatgagg

SEQ ID NO: 9995 - DNA, 23 bp, Homo sapiens
aacaacacttctggatcttaagg

SEQ ID NO: 9996 - DNA, 23 bp, Homo sapiens
cgtctcctcccatgggtaggagg

SEQ ID NO: 9997 - DNA, 23 bp, Homo sapiens
cggagaggagagcggtgcggagg

SEQ ID NO: 9998 - DNA, 23 bp, Homo sapiens
gttgagggactgctagaccctgg

SEQ ID NO: 9999 - DNA, 23 bp, Homo sapiens
gctgcagacctcactctgagtgg

SEQ ID NO: 10000 - DNA, 23 bp, Homo sapiens
gctaggagtcagagacacacagg

SEQ ID NO: 10001 - DNA, 23 bp, Homo sapiens
gtctgcgtgatggggtctgaagg

SEQ ID NO: 10002 - DNA, 23 bp, Homo sapiens
cagtccacaggtttgcatcctgg

SEQ ID NO: 10003 - DNA, 23 bp, Homo sapiens
gcagatggtgtctctagctctgg

SEQ ID NO: 10004 - DNA, 23 bp, Homo sapiens
ttgcttgatgactaccacacagg

SEQ ID NO: 10005 - DNA, 23 bp, Homo sapiens
ctaaatgaagaggctcatacagg

SEQ ID NO: 10006 - DNA, 23 bp, Homo sapiens
aagctctcagattgaatgctagg

SEQ ID NO: 10007 - DNA, 23 bp, Homo sapiens
ccaacaatggtcacttctcgcgg

SEQ ID NO: 10008 - DNA, 23 bp, Homo sapiens
tgatcttaaggtgcagaaagagg

SEQ ID NO: 10009 - DNA, 23 bp, Homo sapiens
tcctggtgttatttgttgtatgg

SEQ ID NO: 10010 - DNA, 23 bp, Homo sapiens
actatgtactggatgaggtcagg

SEQ ID NO: 10011 - DNA, 23 bp, Homo sapiens
tctggtggtaggtgggtcagagg

SEQ ID NO: 10012 - DNA, 23 bp, Homo sapiens
atcccatcctctgccttagatgg

SEQ ID NO: 10013 - DNA, 23 bp, Homo sapiens
aatgtccttcaggctcataatgg

SEQ ID NO: 10014 - DNA, 23 bp, Homo sapiens
ttctctgtgttcaccaaatatgg

SEQ ID NO: 10015 - DNA, 23 bp, Homo sapiens
caacccgacgaggaacgaatggg

SEQ ID NO: 10016 - DNA, 23 bp, Homo sapiens
ctggggctagtgcagctcatcgg

SEQ ID NO: 10017 - DNA, 23 bp, Homo sapiens
tgacaactccagtgaggactagg

SEQ ID NO: 10018 - DNA, 23 bp, Homo sapiens
ccagtgccatgcggtctcatggg

SEQ ID NO: 10019 - DNA, 23 bp, Homo sapiens
aatagtcacacagccatgatagg

SEQ ID NO: 10020 - DNA, 23 bp, Homo sapiens
ctcagcaggtgctcctcacgcgg

SEQ ID NO: 10021 - DNA, 23 bp, Homo sapiens
agacaacatgcggtcaggccagg

SEQ ID NO: 10022 - DNA, 23 bp, Homo sapiens
aggctggagtgcagtgccagtgg

SEQ ID NO: 10023 - DNA, 23 bp, Homo sapiens
gggtcttgggggctacctcctgg

SEQ ID NO: 10024 - DNA, 23 bp, Homo sapiens
tatactgtcgctgcaactttggg

SEQ ID NO: 10025 - DNA, 23 bp, Homo sapiens
ccctgccctgtgttcagacacgg

SEQ ID NO: 10026 - DNA, 23 bp, Homo sapiens
cagtaggagtttgggtcacaagg

SEQ ID NO: 10027 - DNA, 23 bp, Homo sapiens
tggccctggtttagtgctcctgg

SEQ ID NO: 10028 - DNA, 23 bp, Homo sapiens
acctgggctcagatactgactgg

SEQ ID NO: 10029 - DNA, 23 bp, Homo sapiens
aggtagaacatacctcatgttgg

SEQ ID NO: 10030 - DNA, 23 bp, Homo sapiens
ctgttgcagtctcacttgcttgg

SEQ ID NO: 10031 - DNA, 23 bp, Homo sapiens
tgatggcttggcttttcagatgg

SEQ ID NO: 10032 - DNA, 23 bp, Homo sapiens
accaaacctgctgggtgaagagg

SEQ ID NO: 10033 - DNA, 23 bp, Homo sapiens
gatttggtgctgggctgaatggg

SEQ ID NO: 10034 - DNA, 23 bp, Homo sapiens
ccatcatccagagcttgggcagg

SEQ ID NO: 10035 - DNA, 23 bp, Homo sapiens
agaggcgcagctagggtcactgg

SEQ ID NO: 10036 - DNA, 23 bp, Homo sapiens
aggtttcttgtcgacctcatggg

SEQ ID NO: 10037 - DNA, 23 bp, Homo sapiens
agaagctgaaagagactctgggg

SEQ ID NO: 10038 - DNA, 23 bp, Homo sapiens
agctggtgcatgtgttgtagtgg

SEQ ID NO: 10039 - DNA, 23 bp, Homo sapiens
gagctggtcacatcttagtcagg

SEQ ID NO: 10040 - DNA, 23 bp, Homo sapiens
agagatttaaacgtgttgctagg

SEQ ID NO: 10041 - DNA, 23 bp, Homo sapiens
agcttttggacataacttgctgg

SEQ ID NO: 10042 - DNA, 23 bp, Homo sapiens
ccactgtgcctaggaagagctgg

SEQ ID NO: 10043 - DNA, 23 bp, Homo sapiens
ccggagcagtgtctgtctgacgg

SEQ ID NO: 10044 - DNA, 23 bp, Homo sapiens
gtgaaaagcataccacactctgg

SEQ ID NO: 10045 - DNA, 23 bp, Homo sapiens
atttgtgttgtcgatacttgtgg

SEQ ID NO: 10046 - DNA, 23 bp, Homo sapiens
aggtcatggatccaataatgtgg

SEQ ID NO: 10047 - DNA, 23 bp, Homo sapiens
agcaccttcagatcattcttagg

SEQ ID NO: 10048 - DNA, 23 bp, Homo sapiens
cgttcaggagttctccgctatgg

SEQ ID NO: 10049 - DNA, 23 bp, Homo sapiens
agcgtagcatctggatcagttgg

SEQ ID NO: 10050 - DNA, 23 bp, Homo sapiens
acgatgaagaacaattagactgg

SEQ ID NO: 10051 - DNA, 23 bp, Homo sapiens
actggatccggatgatcatgagg

SEQ ID NO: 10052 - DNA, 23 bp, Homo sapiens
ccccgctcgtgggtcttagaagg

SEQ ID NO: 10053 - DNA, 23 bp, Homo sapiens
agagttagaggatgttgtcaagg

SEQ ID NO: 10054 - DNA, 23 bp, Homo sapiens
cagcagcaaaaatggttgaaggg

SEQ ID NO: 10055 - DNA, 23 bp, Homo sapiens
aaacgatgcgggacaaatgatgg

SEQ ID NO: 10056 - DNA, 23 bp, Homo sapiens
gaatagtcagttcctcttcatgg

SEQ ID NO: 10057 - DNA, 23 bp, Homo sapiens
gctgggagcccccggtcacaagg

SEQ ID NO: 10058 - DNA, 23 bp, Homo sapiens
ggtgggacaggggcactcagggg

SEQ ID NO: 10059 - DNA, 23 bp, Homo sapiens
tcccaacatctggaggggaaagg

SEQ ID NO: 10060 - DNA, 23 bp, Homo sapiens
gggttgataggggtgctcagggg

SEQ ID NO: 10061 - DNA, 23 bp, Homo sapiens
tccctagtgccctggagaggagg

SEQ ID NO: 10062 - DNA, 23 bp, Homo sapiens
ggttgggtcaacgtgccacaagg

SEQ ID NO: 10063 - DNA, 23 bp, Homo sapiens
tcccagtccccagagttaactgg

SEQ ID NO: 10064 - DNA, 23 bp, Homo sapiens
tcctgggatgactcaggagttgg

SEQ ID NO: 10065 - DNA, 23 bp, Homo sapiens
ggaggtagatgtcacatgtcagg

SEQ ID NO: 10066 - DNA, 23 bp, Homo sapiens
tgtcacatgtcagggtcacttgg

SEQ ID NO: 10067 - DNA, 23 bp, Homo sapiens
gcgttagcgatgctttttcatgg

SEQ ID NO: 10068 - DNA, 23 bp, Homo sapiens
gactggatcaagaagatcatagg

SEQ ID NO: 10069 - DNA, 23 bp, Homo sapiens
aagaagatcataggcagcaaggg

SEQ ID NO: 10070 - DNA, 23 bp, Homo sapiens
tgactggatccaagaaatcatgg

SEQ ID NO: 10071 - DNA, 23 bp, Homo sapiens
ctctggactgcttctcatgctgg

SEQ ID NO: 10072 - DNA, 23 bp, Homo sapiens
ggcatcaccagctggggtgaagg

SEQ ID NO: 10073 - DNA, 23 bp, Homo sapiens
agtctcaggtctcagtcctttgg

SEQ ID NO: 10074 - DNA, 23 bp, Homo sapiens
tcacaggtgttagttctttttgg

SEQ ID NO: 10075 - DNA, 23 bp, Homo sapiens
cgacttaaatcagcccagtgtgg

SEQ ID NO: 10076 - DNA, 23 bp, Homo sapiens
atatcattgaagatccacactgg

SEQ ID NO: 10077 - DNA, 23 bp, Homo sapiens
tgattcttgaagatccacactgg

SEQ ID NO: 10078 - DNA, 23 bp, Homo sapiens
atcagagttcttcgaagcacagg

SEQ ID NO: 10079 - DNA, 23 bp, Homo sapiens
tgcatagcgtataatccaaatgg

SEQ ID NO: 10080 - DNA, 23 bp, Homo sapiens
cctgcagcagtgttttcaaatgg

SEQ ID NO: 10081 - DNA, 23 bp, Homo sapiens
tttgatctccttgatcctgttgg

SEQ ID NO: 10082 - DNA, 23 bp, Homo sapiens
ttgacgcacaatggaaccagtgg

SEQ ID NO: 10083 - DNA, 23 bp, Homo sapiens
ctgtgaagttcctttacactggg

SEQ ID NO: 10084 - DNA, 23 bp, Homo sapiens
tttacactgggtgtgtaagaagg

SEQ ID NO: 10085 - DNA, 23 bp, Homo sapiens
gccaaggggacccagtgatctgg

SEQ ID NO: 10086 - DNA, 23 bp, Homo sapiens
atacgtacatctgcatgcaaagg

SEQ ID NO: 10087 - DNA, 23 bp, Homo sapiens
ctatcacctgctaatgagattgg

SEQ ID NO: 10088 - DNA, 23 bp, Homo sapiens
gagaagagcagctttagtttagg

SEQ ID NO: 10089 - DNA, 23 bp, Homo sapiens
tgccgtcggttccttaactgagg

SEQ ID NO: 10090 - DNA, 23 bp, Homo sapiens
catttcagttcatccacttccgg

SEQ ID NO: 10091 - DNA, 23 bp, Homo sapiens
gagcctggaattgtcggaaatgg

SEQ ID NO: 10092 - DNA, 23 bp, Homo sapiens
gggtcagggtggcattaaaatgg

SEQ ID NO: 10093 - DNA, 23 bp, Homo sapiens
cccgtggctgaagcattaaccgg

SEQ ID NO: 10094 - DNA, 23 bp, Homo sapiens
aagcgcttgaggttaatagttgg

SEQ ID NO: 10095 - DNA, 23 bp, Homo sapiens
tgcattgtttttttcctgagtgg

SEQ ID NO: 10096 - DNA, 23 bp, Homo sapiens
cggcggtgaagagctgtgacagg

SEQ ID NO: 10097 - DNA, 23 bp, Homo sapiens
ctgtggttcacttctgtagccgg

SEQ ID NO: 10098 - DNA, 23 bp, Homo sapiens
ccaggcccgagctcggctactgg

SEQ ID NO: 10099 - DNA, 23 bp, Homo sapiens
cctcaccttggttcgtgagcagg

SEQ ID NO: 10100 - DNA, 23 bp, Homo sapiens
gggcccagacagggcctcactgg

SEQ ID NO: 10101 - DNA, 23 bp, Homo sapiens
tgctttactttctctgcccatgg

SEQ ID NO: 10102 - DNA, 23 bp, Homo sapiens
aatttcactaactgacttccagg

SEQ ID NO: 10103 - DNA, 23 bp, Homo sapiens
agagccagcatctgagagggagg

SEQ ID NO: 10104 - DNA, 23 bp, Homo sapiens
atggtggtccaagggtctagtgg

SEQ ID NO: 10105 - DNA, 23 bp, Homo sapiens
cgcttccaagtcagtcaagctgg

SEQ ID NO: 10106 - DNA, 23 bp, Homo sapiens
aacaacagcccttaaggaaatgg

SEQ ID NO: 10107 - DNA, 23 bp, Homo sapiens
gctgttagaaactttgcaagagg

SEQ ID NO: 10108 - DNA, 23 bp, Homo sapiens
ggatattgcaccaaatgtagagg

SEQ ID NO: 10109 - DNA, 23 bp, Homo sapiens
atttcacagggagcagtgtctgg

SEQ ID NO: 10110 - DNA, 23 bp, Homo sapiens
gcagagtattgcttcaaagctgg

SEQ ID NO: 10111 - DNA, 23 bp, Homo sapiens
atctaaaagttaaaggtcccagg

SEQ ID NO: 10112 - DNA, 23 bp, Homo sapiens
tttgtttgaaggttggctgttgg

SEQ ID NO: 10113 - DNA, 23 bp, Homo sapiens
ctgccaatgtaccaacagaaggg

SEQ ID NO: 10114 - DNA, 23 bp, Homo sapiens
cagcaggaagcaccaatggatgg

SEQ ID NO: 10115 - DNA, 23 bp, Homo sapiens
ctggaggcagatattatagctgg

SEQ ID NO: 10116 - DNA, 23 bp, Homo sapiens
tgacttggctcagtaaagtttgg

SEQ ID NO: 10117 - DNA, 23 bp, Homo sapiens
catgggcaacaaaagaactgagg

SEQ ID NO: 10118 - DNA, 23 bp, Homo sapiens
tgcctttgctggagtgaaagggg

SEQ ID NO: 10119 - DNA, 23 bp, Homo sapiens
tgggtgcatgggtgcttaagagg

SEQ ID NO: 10120 - DNA, 23 bp, Homo sapiens
aacatcagcaaagacaagacagg

SEQ ID NO: 10121 - DNA, 23 bp, Homo sapiens
agcaaagaagaaaagactcctgg

SEQ ID NO: 10122 - DNA, 23 bp, Homo sapiens
cgagatggggggcgcattgatgg

SEQ ID NO: 10123 - DNA, 23 bp, Homo sapiens
agccatctgttcaccagcagagg

SEQ ID NO: 10124 - DNA, 23 bp, Homo sapiens
atcgtcaatgctgggaagacagg

SEQ ID NO: 10125 - DNA, 23 bp, Homo sapiens
acagcacttcaaaatacatgagg

SEQ ID NO: 10126 - DNA, 23 bp, Homo sapiens
gaaacactgaaggatgaaagcgg

SEQ ID NO: 10127 - DNA, 23 bp, Homo sapiens
ctttgggaccagtctattcttgg

SEQ ID NO: 10128 - DNA, 23 bp, Homo sapiens
ggggtttttagtcactcacaagg

SEQ ID NO: 10129 - DNA, 23 bp, Homo sapiens
tgtctacagtcagatacttctgg

SEQ ID NO: 10130 - DNA, 23 bp, Homo sapiens
cggggcccagagtcagagagcgg

SEQ ID NO: 10131 - DNA, 23 bp, Homo sapiens
ctctggctggaggcactcagagg

SEQ ID NO: 10132 - DNA, 23 bp, Homo sapiens
tggtgctcaggagctgttcttgg

SEQ ID NO: 10133 - DNA, 23 bp, Homo sapiens
ttgttttcagatccatagcatgg

SEQ ID NO: 10134 - DNA, 23 bp, Homo sapiens
agaaattgcacttaagatggagg

SEQ ID NO: 10135 - DNA, 23 bp, Homo sapiens
acagagggcatctctttatctgg

SEQ ID NO: 10136 - DNA, 23 bp, Homo sapiens
gtgggcgagtcttcatctaaggg

SEQ ID NO: 10137 - DNA, 23 bp, Homo sapiens
ggtggtctcatctcaagttcagg

SEQ ID NO: 10138 - DNA, 23 bp, Homo sapiens
ccaggcagatttaaggcctacgg

SEQ ID NO: 10139 - DNA, 23 bp, Homo sapiens
cgtggtaacagaggtgctacggg

SEQ ID NO: 10140 - DNA, 23 bp, Homo sapiens
gtccttcgcaccaagaactgagg

SEQ ID NO: 10141 - DNA, 23 bp, Homo sapiens
acacttagatttctctcttgtgg

SEQ ID NO: 10142 - DNA, 23 bp, Homo sapiens
cagctcagttctaggagctctgg

SEQ ID NO: 10143 - DNA, 23 bp, Homo sapiens
cggggtagctgagtcctcagcgg

SEQ ID NO: 10144 - DNA, 23 bp, Homo sapiens
ccaatgacaccaaagttctgagg

SEQ ID NO: 10145 - DNA, 23 bp, Homo sapiens
cccagagcctgctgcctcagagg

SEQ ID NO: 10146 - DNA, 23 bp, Homo sapiens
tctaaaagagaaggtcacgctgg

SEQ ID NO: 10147 - DNA, 23 bp, Homo sapiens
gtcatctgaagtcaaagaggtgg

SEQ ID NO: 10148 - DNA, 23 bp, Homo sapiens
tgttgatggaggtttgatagagg

SEQ ID NO: 10149 - DNA, 23 bp, Homo sapiens
attggtctcatgcgtgcttttgg

SEQ ID NO: 10150 - DNA, 23 bp, Homo sapiens
tcaagtcagcagtatttctgagg

SEQ ID NO: 10151 - DNA, 23 bp, Homo sapiens
tgctttgagatttctcttccagg

SEQ ID NO: 10152 - DNA, 23 bp, Homo sapiens
ccttctaaagcaccataatgagg

SEQ ID NO: 10153 - DNA, 23 bp, Homo sapiens
tcaacaacaagaatgaacagagg

SEQ ID NO: 10154 - DNA, 23 bp, Homo sapiens
caacggcaagacagaacaaaggg

SEQ ID NO: 10155 - DNA, 23 bp, Homo sapiens
gctgatgcgtgctctttatctgg

SEQ ID NO: 10156 - DNA, 23 bp, Homo sapiens
ccctaggttctagcgcacgaagg

SEQ ID NO: 10157 - DNA, 23 bp, Homo sapiens
gcacaaagggacttcagtagcgg

SEQ ID NO: 10158 - DNA, 23 bp, Homo sapiens
gcaacacatttgggtactagagg

SEQ ID NO: 10159 - DNA, 23 bp, Homo sapiens
ccagggtatctagtacccaaagg

SEQ ID NO: 10160 - DNA, 23 bp, Homo sapiens
ccctgtggcacctctcaaaaggg

SEQ ID NO: 10161 - DNA, 23 bp, Homo sapiens
gtgtgccctgcccagggggtcgg

SEQ ID NO: 10162 - DNA, 23 bp, Homo sapiens
gaccaagtgggctgtcacagcgg

SEQ ID NO: 10163 - DNA, 23 bp, Homo sapiens
tcagaatcatctccccatgctgg

SEQ ID NO: 10164 - DNA, 23 bp, Homo sapiens
ggtccacaggaattcagaatcgg

SEQ ID NO: 10165 - DNA, 23 bp, Homo sapiens
caccttgggatgttagactttgg

SEQ ID NO: 10166 - DNA, 23 bp, Homo sapiens
ccctgaacaagagacgatagagg

SEQ ID NO: 10167 - DNA, 23 bp, Homo sapiens
ttcaacagtgcagatgacatagg

SEQ ID NO: 10168 - DNA, 23 bp, Homo sapiens
cttagctcttgaagctcttccgg

SEQ ID NO: 10169 - DNA, 23 bp, Homo sapiens
gtgcttatagctcttcctgctgg

SEQ ID NO: 10170 - DNA, 23 bp, Homo sapiens
gtgcttgtagctcttcctgctgg

SEQ ID NO: 10171 - DNA, 23 bp, Homo sapiens
ggtgggaggcggctcagtcgcgg

SEQ ID NO: 10172 - DNA, 23 bp, Homo sapiens
gggcagtcttctctaccgactgg

SEQ ID NO: 10173 - DNA, 23 bp, Homo sapiens
ccaaccacttgtccatcatctgg

SEQ ID NO: 10174 - DNA, 23 bp, Homo sapiens
tgtgttgcacttttatctcatgg

SEQ ID NO: 10175 - DNA, 23 bp, Homo sapiens
gggtgaggccatgggtctagcgg

SEQ ID NO: 10176 - DNA, 23 bp, Homo sapiens
cttagtgcgtgtagctcttctgg

SEQ ID NO: 10177 - DNA, 23 bp, Homo sapiens
atttggaacagtagatcacttgg

SEQ ID NO: 10178 - DNA, 23 bp, Homo sapiens
acaggcggatcttggagtagagg

SEQ ID NO: 10179 - DNA, 23 bp, Homo sapiens
tggctgctgggtcgctcagtagg

SEQ ID NO: 10180 - DNA, 23 bp, Homo sapiens
ggctcagcagctaatacctctgg

SEQ ID NO: 10181 - DNA, 23 bp, Homo sapiens
ggctgccgcagctgttcacttgg

SEQ ID NO: 10182 - DNA, 23 bp, Homo sapiens
cctgatctggaggcagctacagg

SEQ ID NO: 10183 - DNA, 23 bp, Homo sapiens
tcggaggtctcagagtaaggcgg

SEQ ID NO: 10184 - DNA, 23 bp, Homo sapiens
cagcagctgccggaaatgttagg

SEQ ID NO: 10185 - DNA, 23 bp, Homo sapiens
tcggatcatgctaatgcttgtgg

SEQ ID NO: 10186 - DNA, 23 bp, Homo sapiens
cggccaggggaggcattaagtgg

SEQ ID NO: 10187 - DNA, 23 bp, Homo sapiens
ggggctgggctctcagtacttgg

SEQ ID NO: 10188 - DNA, 23 bp, Homo sapiens
catgactctactaggcaaagcgg

SEQ ID NO: 10189 - DNA, 23 bp, Homo sapiens
cagctgtaagaggtgctaggagg

SEQ ID NO: 10190 - DNA, 23 bp, Homo sapiens
ttgaggaagaagactaggaatgg

SEQ ID NO: 10191 - DNA, 23 bp, Homo sapiens
agaaggaggttttcaacaagtgg

SEQ ID NO: 10192 - DNA, 23 bp, Homo sapiens
tcagcaaactggcttttagcagg

SEQ ID NO: 10193 - DNA, 23 bp, Homo sapiens
tcagcaacctggcttttagcagg

SEQ ID NO: 10194 - DNA, 23 bp, Homo sapiens
gcaaactggctttcagcaagtgg

SEQ ID NO: 10195 - DNA, 23 bp, Homo sapiens
aggattgagcactcagcagctgg

SEQ ID NO: 10196 - DNA, 23 bp, Homo sapiens
gccaaaagtctagctgctgatgg

SEQ ID NO: 10197 - DNA, 23 bp, Homo sapiens
ccagaagtccagctgctgacggg

SEQ ID NO: 10198 - DNA, 23 bp, Homo sapiens
gggagcacacggggcgtcagagg

SEQ ID NO: 10199 - DNA, 23 bp, Homo sapiens
gcctgagcagaggcctcagcagg

SEQ ID NO: 10200 - DNA, 23 bp, Homo sapiens
catccagggctgtcagcagctgg

SEQ ID NO: 10201 - DNA, 23 bp, Homo sapiens
taaggagatcactcagcagctgg

SEQ ID NO: 10202 - DNA, 23 bp, Homo sapiens
gccagaagtccagctgctgacgg

SEQ ID NO: 10203 - DNA, 23 bp, Homo sapiens
ctggctcctacacacttagcagg

SEQ ID NO: 10204 - DNA, 23 bp, Homo sapiens
ggagattcatgctcagcagcagg

SEQ ID NO: 10205 - DNA, 23 bp, Homo sapiens
aggagcagctggtcagcagcagg

SEQ ID NO: 10206 - DNA, 23 bp, Homo sapiens
acccccactggctgctgagcagg

SEQ ID NO: 10207 - DNA, 23 bp, Homo sapiens
tacagaccaacttgtggatcagg

SEQ ID NO: 10208 - DNA, 23 bp, Homo sapiens
tcagcaagttgatctgcagaagg

SEQ ID NO: 10209 - DNA, 23 bp, Homo sapiens
tatcagccattctgtagatctgg

SEQ ID NO: 10210 - DNA, 23 bp, Homo sapiens
tagaagcgagatccacagattgg

SEQ ID NO: 10211 - DNA, 23 bp, Homo sapiens
ctggttagtaacaagttgcctgg

SEQ ID NO: 10212 - DNA, 23 bp, Homo sapiens
ttggcaggcttgctggcagcagg

SEQ ID NO: 10213 - DNA, 23 bp, Homo sapiens
ttttgtgtcgcatataggtgtgg

SEQ ID NO: 10214 - DNA, 23 bp, Homo sapiens
tctattgccttcagcatcaatgg

SEQ ID NO: 10215 - DNA, 23 bp, Homo sapiens
ggccacagaggctgtggagatgg

SEQ ID NO: 10216 - DNA, 23 bp, Homo sapiens
aatttcacacattgtgttgctgg

SEQ ID NO: 10217 - DNA, 23 bp, Homo sapiens
ccctgaggacacgatatcagagg

SEQ ID NO: 10218 - DNA, 23 bp, Homo sapiens
tatggaggatatggattctctgg

SEQ ID NO: 10219 - DNA, 23 bp, Homo sapiens
cttgcccgtatgcttcagcaagg

SEQ ID NO: 10220 - DNA, 23 bp, Homo sapiens
tatgggggatactggtcttctgg

SEQ ID NO: 10221 - DNA, 23 bp, Homo sapiens
tgagttcactcttcagtagaagg

SEQ ID NO: 10222 - DNA, 23 bp, Homo sapiens
gcagcaggtggtggctcagcagg

SEQ ID NO: 10223 - DNA, 23 bp, Homo sapiens
aggagaggtggggtctcagcagg

SEQ ID NO: 10224 - DNA, 23 bp, Homo sapiens
gggggcattggggtctcagcagg

SEQ ID NO: 10225 - DNA, 23 bp, Homo sapiens
tactactgcccatcttgctatgg

SEQ ID NO: 10226 - DNA, 23 bp, Homo sapiens
gcaaatttaggaagtccatgtgg

SEQ ID NO: 10227 - DNA, 23 bp, Homo sapiens
gatgtggctgtggtggggtatgg

SEQ ID NO: 10228 - DNA, 23 bp, Homo sapiens
gaatccatggtgtcattacctgg

SEQ ID NO: 10229 - DNA, 23 bp, Homo sapiens
tgctaaaacatcactgtcggagg

SEQ ID NO: 10230 - DNA, 23 bp, Homo sapiens
tagtgatgattagtagcaagagg

SEQ ID NO: 10231 - DNA, 23 bp, Homo sapiens
tgtggctgtaacggttattatgg

SEQ ID NO: 10232 - DNA, 23 bp, Homo sapiens
tagagattgctgatctgtttagg

SEQ ID NO: 10233 - DNA, 23 bp, Homo sapiens
atttctttctaggagccaatagg

SEQ ID NO: 10234 - DNA, 23 bp, Homo sapiens
gggctttcaggagacttgctggg

SEQ ID NO: 10235 - DNA, 23 bp, Homo sapiens
gttggtcaatagcatttcagagg

SEQ ID NO: 10236 - DNA, 23 bp, Homo sapiens
cttgttctgattttgtgggttgg

SEQ ID NO: 10237 - DNA, 23 bp, Homo sapiens
acgtgtcgtccatcttgctctgg

SEQ ID NO: 10238 - DNA, 23 bp, Homo sapiens
cctacagatcttcacttactagg

SEQ ID NO: 10239 - DNA, 23 bp, Homo sapiens
ctgtgagtccagcttctgcaagg

SEQ ID NO: 10240 - DNA, 23 bp, Homo sapiens
cagactcggctggttaacagcgg

SEQ ID NO: 10241 - DNA, 23 bp, Homo sapiens
gcctcccaagaggctgctgatgg

SEQ ID NO: 10242 - DNA, 23 bp, Homo sapiens
gcctcccaagaggctgctaatgg

SEQ ID NO: 10243 - DNA, 23 bp, Homo sapiens
ccaatatgaggttcaacaagagg

SEQ ID NO: 10244 - DNA, 23 bp, Homo sapiens
agcagagatttagcagcaagagg

SEQ ID NO: 10245 - DNA, 23 bp, Homo sapiens
tgccgcccaacctgctctagtgg

SEQ ID NO: 10246 - DNA, 23 bp, Homo sapiens
tgcttccaccccatctgctgcgg

SEQ ID NO: 10247 - DNA, 23 bp, Homo sapiens
tgggctagcagcatagagactgg

SEQ ID NO: 10248 - DNA, 23 bp, Homo sapiens
aaggagacattagcagcaagagg

SEQ ID NO: 10249 - DNA, 23 bp, Homo sapiens
gcaaggagctcagcagcaagagg

SEQ ID NO: 10250 - DNA, 23 bp, Homo sapiens
gcagtgggctcagcagcaagagg

SEQ ID NO: 10251 - DNA, 23 bp, Homo sapiens
ccagaaatcagatcttgcactgg

SEQ ID NO: 10252 - DNA, 23 bp, Homo sapiens
tgctgccagtgtaagatctgagg

SEQ ID NO: 10253 - DNA, 23 bp, Homo sapiens
tgctgccagtgcaaaatctgagg

SEQ ID NO: 10254 - DNA, 23 bp, Homo sapiens
tgctgccagtgcaagatctgagg

SEQ ID NO: 10255 - DNA, 23 bp, Homo sapiens
tgctaccagtgcaagatctgagg

SEQ ID NO: 10256 - DNA, 23 bp, Homo sapiens
ggctctggctactattattgagg

SEQ ID NO: 10257 - DNA, 23 bp, Homo sapiens
tgtggctatggatgcggctctgg

SEQ ID NO: 10258 - DNA, 23 bp, Homo sapiens
gagcatgtgggcttcagaattgg

SEQ ID NO: 10259 - DNA, 23 bp, Homo sapiens
ggagccattggtccatcagtagg

SEQ ID NO: 10260 - DNA, 23 bp, Homo sapiens
tgtcccagagaacatcagccagg

SEQ ID NO: 10261 - DNA, 23 bp, Homo sapiens
cagcagctggagacacagcaagg

SEQ ID NO: 10262 - DNA, 23 bp, Homo sapiens
ggagttgattagcagcaagaagg

SEQ ID NO: 10263 - DNA, 23 bp, Homo sapiens
ggacttgatcagcagcaaaaagg

SEQ ID NO: 10264 - DNA, 23 bp, Homo sapiens
acaagaatgctggcagcagctgg

SEQ ID NO: 10265 - DNA, 23 bp, Homo sapiens
gcaagcaggctgacagcagctgg

SEQ ID NO: 10266 - DNA, 23 bp, Homo sapiens
gaacgtgatcagcagcaagaagg

SEQ ID NO: 10267 - DNA, 23 bp, Homo sapiens
ggacttgatcagcagcaagaagg

SEQ ID NO: 10268 - DNA, 23 bp, Homo sapiens
ctcacaccagccaaggtcacagg

SEQ ID NO: 10269 - DNA, 23 bp, Homo sapiens
atcacagagaagttgggtttagg

SEQ ID NO: 10270 - DNA, 23 bp, Homo sapiens
ccagtggaggtcatggtcactgg

SEQ ID NO: 10271 - DNA, 23 bp, Homo sapiens
tctcccaccctggacacttctgg

SEQ ID NO: 10272 - DNA, 23 bp, Homo sapiens
tgtctcaccctggacatttctgg

SEQ ID NO: 10273 - DNA, 23 bp, Homo sapiens
ctacctcctctggtcagtgcagg

SEQ ID NO: 10274 - DNA, 23 bp, Homo sapiens
aaaggagaaagagcactaccagg

SEQ ID NO: 10275 - DNA, 23 bp, Homo sapiens
acagatgacgaggagatgacggg

SEQ ID NO: 10276 - DNA, 23 bp, Homo sapiens
gaccggggcacagccctcactgg

SEQ ID NO: 10277 - DNA, 23 bp, Homo sapiens
ggccataggccacatcagcaggg

SEQ ID NO: 10278 - DNA, 23 bp, Homo sapiens
gaagctgcggaagtggaaggtgg

SEQ ID NO: 10279 - DNA, 23 bp, Homo sapiens
ctgaagaaatcatcaaggcatgg

SEQ ID NO: 10280 - DNA, 23 bp, Homo sapiens
aagtatagaagtgagcagattgg

SEQ ID NO: 10281 - DNA, 23 bp, Homo sapiens
ggcatgcttttcatgaatgaagg

SEQ ID NO: 10282 - DNA, 23 bp, Homo sapiens
ctgccgtggccctagaatagtgg

SEQ ID NO: 10283 - DNA, 23 bp, Homo sapiens
ccaccttgagagaattactgggg

SEQ ID NO: 10284 - DNA, 23 bp, Homo sapiens
acttcttccattgcaatttctgg

SEQ ID NO: 10285 - DNA, 23 bp, Homo sapiens
attgcaaggtttcgcggagtagg

SEQ ID NO: 10286 - DNA, 23 bp, Homo sapiens
atttatcaaacacccaactcagg

SEQ ID NO: 10287 - DNA, 23 bp, Homo sapiens
gatgacgacccattgagggatgg

SEQ ID NO: 10288 - DNA, 23 bp, Homo sapiens
atcactggcaaagctaagtttgg

SEQ ID NO: 10289 - DNA, 23 bp, Homo sapiens
ctccgtcgagaacatcaagcagg

SEQ ID NO: 10290 - DNA, 23 bp, Homo sapiens
tctctgcagctttgaacatcagg

SEQ ID NO: 10291 - DNA, 23 bp, Homo sapiens
caagaagtcaggggatgaatggg

SEQ ID NO: 10292 - DNA, 23 bp, Homo sapiens
gtccgagatggccttaattttgg

SEQ ID NO: 10293 - DNA, 23 bp, Homo sapiens
tttctctcttgcagtcagtttgg

SEQ ID NO: 10294 - DNA, 23 bp, Homo sapiens
ttttcagcttctcatgcccatgg

SEQ ID NO: 10295 - DNA, 23 bp, Homo sapiens
ggatatgctgacgactgtgcagg

SEQ ID NO: 10296 - DNA, 23 bp, Homo sapiens
tctctactatggctgccagtagg

SEQ ID NO: 10297 - DNA, 23 bp, Homo sapiens
ttcaagggcaatcttcaaagcgg

SEQ ID NO: 10298 - DNA, 23 bp, Homo sapiens
acacagatcctgacaagaaatgg

SEQ ID NO: 10299 - DNA, 23 bp, Homo sapiens
gctgcggctgcggggcaagccgg

SEQ ID NO: 10300 - DNA, 23 bp, Homo sapiens
tgactcctcgctggacgctgagg

SEQ ID NO: 10301 - DNA, 23 bp, Homo sapiens
gagccggagcagctctgacctgg

SEQ ID NO: 10302 - DNA, 23 bp, Homo sapiens
tttgcccaggccaggcttagcgg

SEQ ID NO: 10303 - DNA, 23 bp, Homo sapiens
gtgggtatggggtcagtgtctgg

SEQ ID NO: 10304 - DNA, 23 bp, Homo sapiens
cattcatggtgcatcaaatccgg

SEQ ID NO: 10305 - DNA, 23 bp, Homo sapiens
gcactgagaagctggaacagtgg

SEQ ID NO: 10306 - DNA, 23 bp, Homo sapiens
tctgcttgaagttcaggactcgg

SEQ ID NO: 10307 - DNA, 23 bp, Homo sapiens
tagttggctgggcatgatacagg

SEQ ID NO: 10308 - DNA, 23 bp, Homo sapiens
agagactgtgtaagtgactgagg

SEQ ID NO: 10309 - DNA, 23 bp, Homo sapiens
gtgaaataggcttgggttactgg

SEQ ID NO: 10310 - DNA, 23 bp, Homo sapiens
gctctgtcatgtcaggctgctgg

SEQ ID NO: 10311 - DNA, 23 bp, Homo sapiens
tcacctgggctaggtcagttcgg

SEQ ID NO: 10312 - DNA, 23 bp, Homo sapiens
ggggttggctgtgtcctaggcgg

SEQ ID NO: 10313 - DNA, 23 bp, Homo sapiens
tgctatacacagcaactttctgg

SEQ ID NO: 10314 - DNA, 23 bp, Homo sapiens
aggccttgggcaggggtcactgg

SEQ ID NO: 10315 - DNA, 23 bp, Homo sapiens
gaagctgtagcatcacttgcagg

SEQ ID NO: 10316 - DNA, 23 bp, Homo sapiens
caggagaattgcttgcactcagg

SEQ ID NO: 10317 - DNA, 23 bp, Homo sapiens
aagctttaaagtatcttgcctgg

SEQ ID NO: 10318 - DNA, 23 bp, Homo sapiens
atatgctaggtgctatagctagg

SEQ ID NO: 10319 - DNA, 23 bp, Homo sapiens
aagacactagggcttttcaatgg

SEQ ID NO: 10320 - DNA, 23 bp, Homo sapiens
gacggcctcctgcatctgatggg

SEQ ID NO: 10321 - DNA, 23 bp, Homo sapiens
ttcactgttgctcaagagcctgg

SEQ ID NO: 10322 - DNA, 23 bp, Homo sapiens
actgtgccagctggcagtgaggg

SEQ ID NO: 10323 - DNA, 23 bp, Homo sapiens
ggctaccagactatctagcctgg

SEQ ID NO: 10324 - DNA, 23 bp, Homo sapiens
ggaagaaggaaaagtcgtactgg

SEQ ID NO: 10325 - DNA, 23 bp, Homo sapiens
ggtctcaagcaccatcatgctgg

SEQ ID NO: 10326 - DNA, 23 bp, Homo sapiens
ggcagaagaaaaagttatgctgg

SEQ ID NO: 10327 - DNA, 23 bp, Homo sapiens
cgggcaacaattagattctctgg

SEQ ID NO: 10328 - DNA, 23 bp, Homo sapiens
agtataagcacatgggctagagg

SEQ ID NO: 10329 - DNA, 23 bp, Homo sapiens
ccaaggacccctctcttcatggg

SEQ ID NO: 10330 - DNA, 23 bp, Homo sapiens
cccaagtggcggcatcttaacgg

SEQ ID NO: 10331 - DNA, 23 bp, Homo sapiens
tgaagaactgagacaagttgtgg

SEQ ID NO: 10332 - DNA, 23 bp, Homo sapiens
agaacacacactgctggtgacgg

SEQ ID NO: 10333 - DNA, 23 bp, Homo sapiens
ccggcaggctcagacatcaatgg

SEQ ID NO: 10334 - DNA, 23 bp, Homo sapiens
gaacagatatgagcatcaagagg

SEQ ID NO: 10335 - DNA, 23 bp, Homo sapiens
ccctgcatttgaactctgaaagg

SEQ ID NO: 10336 - DNA, 23 bp, Homo sapiens
ctcttcgaagagggattaaaagg

SEQ ID NO: 10337 - DNA, 23 bp, Homo sapiens
ctgctgctgtaccggctcacggg

SEQ ID NO: 10338 - DNA, 23 bp, Homo sapiens
cttcagcgtctttgtttagaagg

SEQ ID NO: 10339 - DNA, 23 bp, Homo sapiens
gaactcaatgagagtccttgtgg

SEQ ID NO: 10340 - DNA, 23 bp, Homo sapiens
aaggcagaatttcttcaggcagg

SEQ ID NO: 10341 - DNA, 23 bp, Homo sapiens
aaggcttaggcagacacgtaagg

SEQ ID NO: 10342 - DNA, 23 bp, Homo sapiens
agcaccacccccatactcagagg

SEQ ID NO: 10343 - DNA, 23 bp, Homo sapiens
ttggtgctagctgttgttctcgg

SEQ ID NO: 10344 - DNA, 23 bp, Homo sapiens
cagagccctgcccgaggctgagg

SEQ ID NO: 10345 - DNA, 23 bp, Homo sapiens
cactcgaacacacagactttggg

SEQ ID NO: 10346 - DNA, 23 bp, Homo sapiens
aagcatcagtagaaagatgttgg

SEQ ID NO: 10347 - DNA, 23 bp, Homo sapiens
cgatgtaacagtgggttatttgg

SEQ ID NO: 10348 - DNA, 23 bp, Homo sapiens
ctgtatgtgagcaaaaggcttgg

SEQ ID NO: 10349 - DNA, 23 bp, Homo sapiens
tgtgaattgtcactggactccgg

SEQ ID NO: 10350 - DNA, 23 bp, Homo sapiens
atggggactatggtaggggcagg

SEQ ID NO: 10351 - DNA, 23 bp, Homo sapiens
aatgctgctgctatgaatatggg

SEQ ID NO: 10352 - DNA, 23 bp, Homo sapiens
gaagcagtacttgccctcgatgg

SEQ ID NO: 10353 - DNA, 23 bp, Homo sapiens
ttttactttggtgatctgggtgg

SEQ ID NO: 10354 - DNA, 23 bp, Homo sapiens
cagacgtacggttttcactgagg

SEQ ID NO: 10355 - DNA, 23 bp, Homo sapiens
tagcacagcacccagcacatagg

SEQ ID NO: 10356 - DNA, 23 bp, Homo sapiens
tcatggccatgagaggagcaggg

SEQ ID NO: 10357 - DNA, 23 bp, Homo sapiens
cagcctcgggaaaagaaaagagg

SEQ ID NO: 10358 - DNA, 23 bp, Homo sapiens
tggcgatacaataatctatctgg

SEQ ID NO: 10359 - DNA, 23 bp, Homo sapiens
ctggctgtcaatcttgcaccagg

SEQ ID NO: 10360 - DNA, 23 bp, Homo sapiens
ctggcctgcagctcttctgatgg

SEQ ID NO: 10361 - DNA, 23 bp, Homo sapiens
gggggcgctgcgggttcagatgg

SEQ ID NO: 10362 - DNA, 23 bp, Homo sapiens
atctgcaggagctgaactgaggg

SEQ ID NO: 10363 - DNA, 23 bp, Homo sapiens
gtggcagccacagaagcctaggg

SEQ ID NO: 10364 - DNA, 23 bp, Homo sapiens
acaaggctcagagcagcagtcgg

SEQ ID NO: 10365 - DNA, 23 bp, Homo sapiens
caagaaagatgaagagcgaaggg

SEQ ID NO: 10366 - DNA, 23 bp, Homo sapiens
cagcctgtgtacgtgtagatggg

SEQ ID NO: 10367 - DNA, 23 bp, Homo sapiens
tacctgggtcttcattcatcagg

SEQ ID NO: 10368 - DNA, 23 bp, Homo sapiens
gagtaaggagtctggatgggtgg

SEQ ID NO: 10369 - DNA, 23 bp, Homo sapiens
tcctggtcttgctgtgtgatggg

SEQ ID NO: 10370 - DNA, 23 bp, Homo sapiens
gagctgtggttcactagtcctgg

SEQ ID NO: 10371 - DNA, 23 bp, Homo sapiens
gtccaatacatgagagtttgagg

SEQ ID NO: 10372 - DNA, 23 bp, Homo sapiens
gaagaaatacggcgtggcttggg

SEQ ID NO: 10373 - DNA, 23 bp, Homo sapiens
gatcgacgtggacgattgagcgg

SEQ ID NO: 10374 - DNA, 23 bp, Homo sapiens
gtcagacgaggagatacaggtgg

SEQ ID NO: 10375 - DNA, 23 bp, Homo sapiens
gaatcagctgcttttactgctgg

SEQ ID NO: 10376 - DNA, 23 bp, Homo sapiens
aagccatcgtcacctacagaagg

SEQ ID NO: 10377 - DNA, 23 bp, Homo sapiens
gcaaaggaaggtctttattcagg

SEQ ID NO: 10378 - DNA, 23 bp, Homo sapiens
tctggaggctgctgctaaagtgg

SEQ ID NO: 10379 - DNA, 23 bp, Homo sapiens
tctggaggctgctgctgaagtgg

SEQ ID NO: 10380 - DNA, 23 bp, Homo sapiens
tggctgctgccacagctctgggg

SEQ ID NO: 10381 - DNA, 23 bp, Homo sapiens
tctgggggctgctgctgacctgg

SEQ ID NO: 10382 - DNA, 23 bp, Homo sapiens
agctgtggccacagttctgcggg

SEQ ID NO: 10383 - DNA, 23 bp, Homo sapiens
gactgtggctatggctctggagg

SEQ ID NO: 10384 - DNA, 23 bp, Homo sapiens
ggctgctgccacggttctggggg

SEQ ID NO: 10385 - DNA, 23 bp, Homo sapiens
ggagggggctgttgctgacctgg

SEQ ID NO: 10386 - DNA, 23 bp, Homo sapiens
tctggaggctgctgctgacctgg

SEQ ID NO: 10387 - DNA, 23 bp, Homo sapiens
tgcaaagaggaagagtgtgaagg

SEQ ID NO: 10388 - DNA, 23 bp, Homo sapiens
gtaccagcctcagccttgagagg

SEQ ID NO: 10389 - DNA, 23 bp, Homo sapiens
gtggctgtttgtgtaaaagtcgg

SEQ ID NO: 10390 - DNA, 23 bp, Homo sapiens
accaaaggaggaaatgagcttgg

SEQ ID NO: 10391 - DNA, 23 bp, Homo sapiens
tccttaagtgctgggcagtaagg

SEQ ID NO: 10392 - DNA, 23 bp, Homo sapiens
gaagctctttatggagaaccagg

SEQ ID NO: 10393 - DNA, 23 bp, Homo sapiens
tgctctccagggagcgattaggg

SEQ ID NO: 10394 - DNA, 23 bp, Homo sapiens
aggacgctggctctcatggcagg

SEQ ID NO: 10395 - DNA, 23 bp, Homo sapiens
cccaggccagcgtctgttgaagg

SEQ ID NO: 10396 - DNA, 23 bp, Homo sapiens
atgcaaccctgagagcaaggagg

SEQ ID NO: 10397 - DNA, 23 bp, Homo sapiens
gcactcagccgtcgatacactgg

SEQ ID NO: 10398 - DNA, 23 bp, Homo sapiens
gggcttcctgtcacagtagcagg

SEQ ID NO: 10399 - DNA, 23 bp, Homo sapiens
gtgtgccgagctcctgaaggagg

SEQ ID NO: 10400 - DNA, 23 bp, Homo sapiens
agcattacaggagcccgcccagg

SEQ ID NO: 10401 - DNA, 23 bp, Homo sapiens
agccatcttcatggtgtccttgg

SEQ ID NO: 10402 - DNA, 23 bp, Homo sapiens
gcggctggatgcaaagtgattgg

SEQ ID NO: 10403 - DNA, 23 bp, Homo sapiens
cactttgtgctgcctctccctgg

SEQ ID NO: 10404 - DNA, 23 bp, Homo sapiens
tacaaagtaaaggagaggctggg

SEQ ID NO: 10405 - DNA, 23 bp, Homo sapiens
tcctaacaagtaatctacacagg

SEQ ID NO: 10406 - DNA, 23 bp, Homo sapiens
tctcttcgcttttgagattttgg

SEQ ID NO: 10407 - DNA, 23 bp, Homo sapiens
aaaggaatgaagagggtgtgagg

SEQ ID NO: 10408 - DNA, 23 bp, Homo sapiens
gctcggctataacttgctatggg

SEQ ID NO: 10409 - DNA, 23 bp, Homo sapiens
actcatcagaatgaagacaccgg

SEQ ID NO: 10410 - DNA, 23 bp, Homo sapiens
tgtctcagctctgcctcctcagg

SEQ ID NO: 10411 - DNA, 23 bp, Homo sapiens
cctcaggccaatttacattttgg

SEQ ID NO: 10412 - DNA, 23 bp, Homo sapiens
ccttgggggccaagaaatgatgg

SEQ ID NO: 10413 - DNA, 23 bp, Homo sapiens
gccacagcagggccttttactgg

SEQ ID NO: 10414 - DNA, 23 bp, Homo sapiens
atttaaggagaagcattgagggg

SEQ ID NO: 10415 - DNA, 23 bp, Homo sapiens
cagtgtcaggctgcgcactaagg

SEQ ID NO: 10416 - DNA, 23 bp, Homo sapiens
tctggtgccgatcatcttattgg

SEQ ID NO: 10417 - DNA, 23 bp, Homo sapiens
acacaccatcaacttgtaggcgg

SEQ ID NO: 10418 - DNA, 23 bp, Homo sapiens
cattaaggatttgggctgaaagg

SEQ ID NO: 10419 - DNA, 23 bp, Homo sapiens
tacactttgggggatccaaaagg

SEQ ID NO: 10420 - DNA, 23 bp, Homo sapiens
tacaacaggattctaggtggagg

SEQ ID NO: 10421 - DNA, 23 bp, Homo sapiens
ttcacaagcaggtggttgagagg

SEQ ID NO: 10422 - DNA, 23 bp, Homo sapiens
aacactttgggaaattcagaagg

SEQ ID NO: 10423 - DNA, 23 bp, Homo sapiens
aaagctgacccctgaagaagagg

SEQ ID NO: 10424 - DNA, 23 bp, Homo sapiens
gcctagagctcactagtcacagg

SEQ ID NO: 10425 - DNA, 23 bp, Homo sapiens
agaagagtgcagaaacactttgg

SEQ ID NO: 10426 - DNA, 23 bp, Homo sapiens
ccaggcaaagtgctgtgaagggg

SEQ ID NO: 10427 - DNA, 23 bp, Homo sapiens
ggtcagtctggaggatgacgtgg

SEQ ID NO: 10428 - DNA, 23 bp, Homo sapiens
gcctgtcccggaccctgagtggg

SEQ ID NO: 10429 - DNA, 23 bp, Homo sapiens
tgatggcactaacaactgcgggg

SEQ ID NO: 10430 - DNA, 23 bp, Homo sapiens
ttgatgagggcttcactcagtgg

SEQ ID NO: 10431 - DNA, 23 bp, Homo sapiens
cttatacttcttcagtgccctgg

SEQ ID NO: 10432 - DNA, 23 bp, Homo sapiens
acgttggaaggaatcagaccagg

SEQ ID NO: 10433 - DNA, 23 bp, Homo sapiens
atgacctcttcagcttctgaggg

SEQ ID NO: 10434 - DNA, 23 bp, Homo sapiens
agaagaggaggatgattattagg

SEQ ID NO: 10435 - DNA, 23 bp, Homo sapiens
cctggtatgtacatcattcctgg

SEQ ID NO: 10436 - DNA, 23 bp, Homo sapiens
accattggccttcgatttacagg

SEQ ID NO: 10437 - DNA, 23 bp, Homo sapiens
atgtaggcagctgtcattcttgg

SEQ ID NO: 10438 - DNA, 23 bp, Homo sapiens
cccaggacctcttctggagatgg

SEQ ID NO: 10439 - DNA, 23 bp, Homo sapiens
ctacactaggcgcctatggctgg

SEQ ID NO: 10440 - DNA, 23 bp, Homo sapiens
atacaccaggcgcctatggctgg

SEQ ID NO: 10441 - DNA, 23 bp, Homo sapiens
ctgccattcttaggagaaggcgg

SEQ ID NO: 10442 - DNA, 23 bp, Homo sapiens
gaaagctgaacgtgagttaatgg

SEQ ID NO: 10443 - DNA, 23 bp, Homo sapiens
gtgcccacagtgcctcactctgg

SEQ ID NO: 10444 - DNA, 23 bp, Homo sapiens
acagcaagcttcaagcccactgg

SEQ ID NO: 10445 - DNA, 23 bp, Homo sapiens
gtggaaaataagtcgctgtttgg

SEQ ID NO: 10446 - DNA, 23 bp, Homo sapiens
ttatcgctctgagtcagagaagg

SEQ ID NO: 10447 - DNA, 23 bp, Homo sapiens
actggcctaaccaattctcaagg

SEQ ID NO: 10448 - DNA, 23 bp, Homo sapiens
tcaaggaactgctggattaatgg

SEQ ID NO: 10449 - DNA, 23 bp, Homo sapiens
ccctcaggagtcagtgagtaagg

SEQ ID NO: 10450 - DNA, 23 bp, Homo sapiens
ctcctcgctgggtgctcagaagg

SEQ ID NO: 10451 - DNA, 23 bp, Homo sapiens
aggtctgggggtgtcactccagg

SEQ ID NO: 10452 - DNA, 23 bp, Homo sapiens
atcttctgcttttctctttccgg

SEQ ID NO: 10453 - DNA, 23 bp, Homo sapiens
gtatgtgatcagcgatgaagagg

SEQ ID NO: 10454 - DNA, 23 bp, Homo sapiens
gacctcagccctgggtgctgagg

SEQ ID NO: 10455 - DNA, 23 bp, Homo sapiens
ggccacagggtcctctgcatagg

SEQ ID NO: 10456 - DNA, 23 bp, Homo sapiens
gggtggaggttggttgacttagg

SEQ ID NO: 10457 - DNA, 23 bp, Homo sapiens
aagaattgttcctgggcacaagg

SEQ ID NO: 10458 - DNA, 23 bp, Homo sapiens
tactcagactcataagatcatgg

SEQ ID NO: 10459 - DNA, 23 bp, Homo sapiens
atgattttagctgggagcagtgg

SEQ ID NO: 10460 - DNA, 23 bp, Homo sapiens
aaaaaatcagctgggtgttgtgg

SEQ ID NO: 10461 - DNA, 23 bp, Homo sapiens
acgacttcagctggcagcagtgg

SEQ ID NO: 10462 - DNA, 23 bp, Homo sapiens
tagttgtcattgtgcctgagagg

SEQ ID NO: 10463 - DNA, 23 bp, Homo sapiens
ggcagagaaggaggtcgcagagg

SEQ ID NO: 10464 - DNA, 23 bp, Homo sapiens
aacagcaaggctagttcaaaagg

SEQ ID NO: 10465 - DNA, 23 bp, Homo sapiens
agacgagagagacgaagggtagg

SEQ ID NO: 10466 - DNA, 23 bp, Homo sapiens
gattggccagctgactgctcagg

SEQ ID NO: 10467 - DNA, 23 bp, Homo sapiens
ccaccaactaccttgggacaagg

SEQ ID NO: 10468 - DNA, 23 bp, Homo sapiens
gtcgaacttggctgggagaatgg

SEQ ID NO: 10469 - DNA, 23 bp, Homo sapiens
attggagctggtcatactcaagg

SEQ ID NO: 10470 - DNA, 23 bp, Homo sapiens
cgcatgtggctttaaggagtagg

SEQ ID NO: 10471 - DNA, 23 bp, Homo sapiens
cttcacaggagatcctacattgg

SEQ ID NO: 10472 - DNA, 23 bp, Homo sapiens
cccgcactgccatcttctagtgg

SEQ ID NO: 10473 - DNA, 23 bp, Homo sapiens
cctcagtttccccacctggatgg

SEQ ID NO: 10474 - DNA, 23 bp, Homo sapiens
ggctggctgatttcagtcaaagg

SEQ ID NO: 10475 - DNA, 23 bp, Homo sapiens
ctctactgtgtccactcctgagg

SEQ ID NO: 10476 - DNA, 23 bp, Homo sapiens
cagtgtgtgtctgcaattgaggg

SEQ ID NO: 10477 - DNA, 23 bp, Homo sapiens
gagtgcttatcagcgattgaggg

SEQ ID NO: 10478 - DNA, 23 bp, Homo sapiens
cagtgcttgtcaacaatggacgg

SEQ ID NO: 10479 - DNA, 23 bp, Homo sapiens
gctacctgagcgtaaggggcggg

SEQ ID NO: 10480 - DNA, 23 bp, Homo sapiens
cacgcttcaatgagaacaacagg

SEQ ID NO: 10481 - DNA, 23 bp, Homo sapiens
gcccctttcagattatatcatgg

SEQ ID NO: 10482 - DNA, 23 bp, Homo sapiens
ctcctcaggtgtggactagacgg

SEQ ID NO: 10483 - DNA, 23 bp, Homo sapiens
ccccaggaatagattagatctgg

SEQ ID NO: 10484 - DNA, 23 bp, Homo sapiens
ttctgctcagaagatcctcacgg

SEQ ID NO: 10485 - DNA, 23 bp, Homo sapiens
acttactggaagtaaggagctgg

SEQ ID NO: 10486 - DNA, 23 bp, Homo sapiens
gacccatgtgcagacataggcgg

SEQ ID NO: 10487 - DNA, 23 bp, Homo sapiens
ttgaatactaccatcgcctgagg

SEQ ID NO: 10488 - DNA, 23 bp, Homo sapiens
gacccacgtgcagacataggcgg

SEQ ID NO: 10489 - DNA, 23 bp, Homo sapiens
tggtttaaatcagccaagcttgg

SEQ ID NO: 10490 - DNA, 23 bp, Homo sapiens
aatgttgtcataattccggaagg

SEQ ID NO: 10491 - DNA, 23 bp, Homo sapiens
gacacatgtgtgaatgatcttgg

SEQ ID NO: 10492 - DNA, 23 bp, Homo sapiens
aaagaaatctctcctgtcggtgg

SEQ ID NO: 10493 - DNA, 23 bp, Homo sapiens
ggtggatctcagtgcctaggggg

SEQ ID NO: 10494 - DNA, 23 bp, Homo sapiens
gttggtggtctcaggcactgagg

SEQ ID NO: 10495 - DNA, 23 bp, Homo sapiens
cagctcttcagtagtgaccaagg

SEQ ID NO: 10496 - DNA, 23 bp, Homo sapiens
ttgtaagcatagcgcaccaaagg

SEQ ID NO: 10497 - DNA, 23 bp, Homo sapiens
acatgggacaaatgccacagagg

SEQ ID NO: 10498 - DNA, 23 bp, Homo sapiens
tatttacacgtgtgaagcaaagg

SEQ ID NO: 10499 - DNA, 23 bp, Homo sapiens
actgggaaaaaatggttggcagg

SEQ ID NO: 10500 - DNA, 23 bp, Homo sapiens
tgccatgaagaaatatgagttgg

SEQ ID NO: 10501 - DNA, 23 bp, Homo sapiens
gctgcggggagggtctttagagg

SEQ ID NO: 10502 - DNA, 23 bp, Homo sapiens
ctgtgtagcgagtcttgtctagg

SEQ ID NO: 10503 - DNA, 23 bp, Homo sapiens
ctttcaaagctcaaggtttgagg

SEQ ID NO: 10504 - DNA, 23 bp, Homo sapiens
ctgatctgcctcctttagtttgg

SEQ ID NO: 10505 - DNA, 23 bp, Homo sapiens
cttgatggcagaggaactgaagg

SEQ ID NO: 10506 - DNA, 23 bp, Homo sapiens
tcactcacagggaccctgaaagg

SEQ ID NO: 10507 - DNA, 23 bp, Homo sapiens
cctgacgactacaaggcagatgg

SEQ ID NO: 10508 - DNA, 23 bp, Homo sapiens
aagcactacccatactgagatgg

SEQ ID NO: 10509 - DNA, 23 bp, Homo sapiens
tgccctgcaagcgataggagtgg

SEQ ID NO: 10510 - DNA, 23 bp, Homo sapiens
tgcagcacgccgacaagtgatgg

SEQ ID NO: 10511 - DNA, 23 bp, Homo sapiens
ttccggatggtgctcgtcactgg

SEQ ID NO: 10512 - DNA, 23 bp, Homo sapiens
gaggcggccgtgtggtagcgggg

SEQ ID NO: 10513 - DNA, 23 bp, Homo sapiens
gggttgcgagtcattagaaaagg

SEQ ID NO: 10514 - DNA, 23 bp, Homo sapiens
gcctgggtcagaactgagcgtgg

SEQ ID NO: 10515 - DNA, 23 bp, Homo sapiens
gggaggagagaagtttaaaaagg

SEQ ID NO: 10516 - DNA, 23 bp, Homo sapiens
aacgaagccgccgtgtggtaagg

SEQ ID NO: 10517 - DNA, 23 bp, Homo sapiens
gcttggacactggatctcagcgg

SEQ ID NO: 10518 - DNA, 23 bp, Homo sapiens
ggcagcgttagtactgaaaaagg

SEQ ID NO: 10519 - DNA, 23 bp, Homo sapiens
ttggcagttgtgtcattgaatgg

SEQ ID NO: 10520 - DNA, 23 bp, Homo sapiens
ttgttaaggtagtttgtgagggg

SEQ ID NO: 10521 - DNA, 23 bp, Homo sapiens
ccacagccacgatcatggtaggg

SEQ ID NO: 10522 - DNA, 23 bp, Homo sapiens
aggtcttgttgaagttttagagg

SEQ ID NO: 10523 - DNA, 23 bp, Homo sapiens
gccaacaaggcgtcaccttaagg

SEQ ID NO: 10524 - DNA, 23 bp, Homo sapiens
tttctagactaaagccatagagg

SEQ ID NO: 10525 - DNA, 23 bp, Homo sapiens
ggcagagctgtttcacgcaaagg

SEQ ID NO: 10526 - DNA, 23 bp, Homo sapiens
gttggcccaggccttctagcagg

SEQ ID NO: 10527 - DNA, 23 bp, Homo sapiens
cggtgacactgttaatcgtttgg

SEQ ID NO: 10528 - DNA, 23 bp, Homo sapiens
taggagggcgagggcttagtagg

SEQ ID NO: 10529 - DNA, 23 bp, Homo sapiens
gaagaactgtgccagcaggcagg

SEQ ID NO: 10530 - DNA, 23 bp, Homo sapiens
gggaagacagcaaacctagcagg

SEQ ID NO: 10531 - DNA, 23 bp, Homo sapiens
agtagtttcttgtttagctgagg

SEQ ID NO: 10532 - DNA, 23 bp, Homo sapiens
acctcccggctgcatctcagagg

SEQ ID NO: 10533 - DNA, 23 bp, Homo sapiens
gattccaaggctggtgagtgagg

SEQ ID NO: 10534 - DNA, 23 bp, Homo sapiens
cctctctgctgttcacctcccgg

SEQ ID NO: 10535 - DNA, 23 bp, Homo sapiens
cctggaggcctctgtgctcaggg

SEQ ID NO: 10536 - DNA, 23 bp, Homo sapiens
gactccaaggctggtgagtgagg

SEQ ID NO: 10537 - DNA, 23 bp, Homo sapiens
gatcatcagatctgttcccaagg

SEQ ID NO: 10538 - DNA, 23 bp, Homo sapiens
ccctttttgtctttcttagcagg

SEQ ID NO: 10539 - DNA, 23 bp, Homo sapiens
gcccccaagctgcagctggaagg

SEQ ID NO: 10540 - DNA, 23 bp, Homo sapiens
acccccaagatgcagccgggagg

SEQ ID NO: 10541 - DNA, 23 bp, Homo sapiens
tccccagagtggtgagtgacggg

SEQ ID NO: 10542 - DNA, 23 bp, Homo sapiens
tgcgtccccccctgggctagtgg

SEQ ID NO: 10543 - DNA, 23 bp, Homo sapiens
accctggccatccactagcccgg

SEQ ID NO: 10544 - DNA, 23 bp, Homo sapiens
cagcccagctgccgacgcccagg

SEQ ID NO: 10545 - DNA, 23 bp, Homo sapiens
tccccaaagtggtgagtgagggg

SEQ ID NO: 10546 - DNA, 23 bp, Homo sapiens
actctggccatccactagcccgg

SEQ ID NO: 10547 - DNA, 23 bp, Homo sapiens
cccccacagtggtgagtgagggg

SEQ ID NO: 10548 - DNA, 23 bp, Homo sapiens
ctgggtcccccctggattagtgg

SEQ ID NO: 10549 - DNA, 23 bp, Homo sapiens
ctgggtcccccgtgggctagtgg

SEQ ID NO: 10550 - DNA, 23 bp, Homo sapiens
ggggacacatttgggctcagcgg

SEQ ID NO: 10551 - DNA, 23 bp, Homo sapiens
tcggtattatgatgaggatgagg

SEQ ID NO: 10552 - DNA, 23 bp, Homo sapiens
cagcctacaacattgtgacacgg

SEQ ID NO: 10553 - DNA, 23 bp, Homo sapiens
caagtggctctggctagaagtgg

SEQ ID NO: 10554 - DNA, 23 bp, Homo sapiens
ggagccctcccatttctcaatgg

SEQ ID NO: 10555 - DNA, 23 bp, Homo sapiens
gccacagcaggggaagactgagg

SEQ ID NO: 10556 - DNA, 23 bp, Homo sapiens
ggtccttgagtgttcagggcagg

SEQ ID NO: 10557 - DNA, 23 bp, Homo sapiens
ctgagtggccctggctcagtcgg

SEQ ID NO: 10558 - DNA, 23 bp, Homo sapiens
gcacaccccagaagaagtgaggg

SEQ ID NO: 10559 - DNA, 23 bp, Homo sapiens
gggctgggccagggctagggagg

SEQ ID NO: 10560 - DNA, 23 bp, Homo sapiens
aggaacttatttccttcctaagg

SEQ ID NO: 10561 - DNA, 23 bp, Homo sapiens
cagacctcaactctgcctgaagg

SEQ ID NO: 10562 - DNA, 23 bp, Homo sapiens
cccagaaggactcttctatgagg

SEQ ID NO: 10563 - DNA, 23 bp, Homo sapiens
gtggctcaattctgtgcctccgg

SEQ ID NO: 10564 - DNA, 23 bp, Homo sapiens
aggggccttcagttcaaaaaagg

SEQ ID NO: 10565 - DNA, 23 bp, Homo sapiens
gtcgttcgtacatctctcgtagg

SEQ ID NO: 10566 - DNA, 23 bp, Homo sapiens
cgcaagcagctgctacttcttgg

SEQ ID NO: 10567 - DNA, 23 bp, Homo sapiens
gtgcaagagttagcaattcatgg

SEQ ID NO: 10568 - DNA, 23 bp, Homo sapiens
acaacaaaaccacatgtcatagg

SEQ ID NO: 10569 - DNA, 23 bp, Homo sapiens
gtttcaacctcgagactccaagg

SEQ ID NO: 10570 - DNA, 23 bp, Homo sapiens
aaatgagatcagcaaaacgcagg

SEQ ID NO: 10571 - DNA, 23 bp, Homo sapiens
aatctttactcagtctctgttgg

SEQ ID NO: 10572 - DNA, 23 bp, Homo sapiens
gtcactcacaaaccacaaagcgg

SEQ ID NO: 10573 - DNA, 23 bp, Homo sapiens
aggccaaagccggaggagtgagg

SEQ ID NO: 10574 - DNA, 23 bp, Homo sapiens
ttcatcctggctttagggagtgg

SEQ ID NO: 10575 - DNA, 23 bp, Homo sapiens
ccacgacctggcttagacacagg

SEQ ID NO: 10576 - DNA, 23 bp, Homo sapiens
taactgtagtcccagctacttgg

SEQ ID NO: 10577 - DNA, 23 bp, Homo sapiens
ctgtttacatctgtgagaagagg

SEQ ID NO: 10578 - DNA, 23 bp, Homo sapiens
agttggactactgtcccgacagg

SEQ ID NO: 10579 - DNA, 23 bp, Homo sapiens
agctgtggctggggggatgacgg

SEQ ID NO: 10580 - DNA, 23 bp, Homo sapiens
tcatcttcatgttgaacttgcgg

SEQ ID NO: 10581 - DNA, 23 bp, Homo sapiens
cattttcatgttgaacctcctgg

SEQ ID NO: 10582 - DNA, 23 bp, Homo sapiens
caacatgaagatgatctgagggg

SEQ ID NO: 10583 - DNA, 23 bp, Homo sapiens
aaggaaaggtcagaagagcttgg

SEQ ID NO: 10584 - DNA, 23 bp, Homo sapiens
aacaacttcaaaagtgcagttgg

SEQ ID NO: 10585 - DNA, 23 bp, Homo sapiens
ggggcctggatgccccttggagg

SEQ ID NO: 10586 - DNA, 23 bp, Homo sapiens
acgaagattttttcctgggttgg

SEQ ID NO: 10587 - DNA, 23 bp, Homo sapiens
gggtagacgggggctgcgggggg

SEQ ID NO: 10588 - DNA, 23 bp, Homo sapiens
cttggactttatctgggcaatgg

SEQ ID NO: 10589 - DNA, 23 bp, Homo sapiens
ccactgtggagcttccctgaggg

SEQ ID NO: 10590 - DNA, 23 bp, Homo sapiens
aacagttacaactgcaactctgg

SEQ ID NO: 10591 - DNA, 23 bp, Homo sapiens
aaggcatcttatgtgttctttgg

SEQ ID NO: 10592 - DNA, 23 bp, Homo sapiens
tcacaagcaagtgcatttgatgg

SEQ ID NO: 10593 - DNA, 23 bp, Homo sapiens
gtggcaactgcaatttggaatgg

SEQ ID NO: 10594 - DNA, 23 bp, Homo sapiens
aggtcttggtaaatttcctgagg

SEQ ID NO: 10595 - DNA, 23 bp, Homo sapiens
gtgtcagatgcttcacaatacgg

SEQ ID NO: 10596 - DNA, 23 bp, Homo sapiens
atttcactgtacatccgttgagg

SEQ ID NO: 10597 - DNA, 23 bp, Homo sapiens
ctgtttagtttgtggtcttgtgg

SEQ ID NO: 10598 - DNA, 23 bp, Homo sapiens
ccctgtggactggttgggacagg

SEQ ID NO: 10599 - DNA, 23 bp, Homo sapiens
tgttatgagtactcttcagttgg

SEQ ID NO: 10600 - DNA, 23 bp, Homo sapiens
aggtactcaggaggctgagctgg

SEQ ID NO: 10601 - DNA, 23 bp, Homo sapiens
gggcacctacaagcgtttgtagg

SEQ ID NO: 10602 - DNA, 23 bp, Homo sapiens
ctgtgtggctatcactagcaagg

SEQ ID NO: 10603 - DNA, 23 bp, Homo sapiens
tatgcattcttccaactgctagg

SEQ ID NO: 10604 - DNA, 23 bp, Homo sapiens
gcaccatcttcccgcggtgacgg

SEQ ID NO: 10605 - DNA, 23 bp, Homo sapiens
tataactttatgtgggaggctgg

SEQ ID NO: 10606 - DNA, 23 bp, Homo sapiens
gagtgagcatgaagcagagttgg

SEQ ID NO: 10607 - DNA, 23 bp, Homo sapiens
tgtgccatcctgatcaaatgagg

SEQ ID NO: 10608 - DNA, 23 bp, Homo sapiens
atgcctcccacacctaaccctgg

SEQ ID NO: 10609 - DNA, 23 bp, Homo sapiens
gggtgcagcctcagcaatggcgg

SEQ ID NO: 10610 - DNA, 23 bp, Homo sapiens
tgtgtgctcatcgcgcagcctgg

SEQ ID NO: 10611 - DNA, 23 bp, Homo sapiens
caaggttttaagagtctaccagg

SEQ ID NO: 10612 - DNA, 23 bp, Homo sapiens
tggaccgtagacaaacatgatgg

SEQ ID NO: 10613 - DNA, 23 bp, Homo sapiens
ggctctgaggtgggtcaggcagg

SEQ ID NO: 10614 - DNA, 23 bp, Homo sapiens
gaacaagcgcttctactgagtgg

SEQ ID NO: 10615 - DNA, 23 bp, Homo sapiens
gggctcagtagaagcgctttcgg

SEQ ID NO: 10616 - DNA, 23 bp, Homo sapiens
cagccaagccttctgtaaatggg

SEQ ID NO: 10617 - DNA, 23 bp, Homo sapiens
cacccccagctggaggtcactgg

SEQ ID NO: 10618 - DNA, 23 bp, Homo sapiens
ctgtcaagcagaatagacagagg

SEQ ID NO: 10619 - DNA, 23 bp, Homo sapiens
atcgagagatatcgtccaccagg

SEQ ID NO: 10620 - DNA, 23 bp, Homo sapiens
caagtccaaacgctcctgaaggg

SEQ ID NO: 10621 - DNA, 23 bp, Homo sapiens
ttaatgggttatcacacgagtgg

SEQ ID NO: 10622 - DNA, 23 bp, Homo sapiens
tagacgtgcaccagaaataaagg

SEQ ID NO: 10623 - DNA, 23 bp, Homo sapiens
tatttctggtgcacgtctagagg

SEQ ID NO: 10624 - DNA, 23 bp, Homo sapiens
aacacagctacttctttcgccgg

SEQ ID NO: 10625 - DNA, 23 bp, Homo sapiens
tcttctgtgtatatggcactagg

SEQ ID NO: 10626 - DNA, 23 bp, Homo sapiens
aactgcagcatcatgtaatctgg

SEQ ID NO: 10627 - DNA, 23 bp, Homo sapiens
cagtgcaggctcggcctcagcgg

SEQ ID NO: 10628 - DNA, 23 bp, Homo sapiens
ccagggtctaaagctagggaagg

SEQ ID NO: 10629 - DNA, 23 bp, Homo sapiens
cagcttctattggatgctcttgg

SEQ ID NO: 10630 - DNA, 23 bp, Homo sapiens
catcacgtagcagcctcttgagg

SEQ ID NO: 10631 - DNA, 23 bp, Homo sapiens
accagacctaatcgagcctcagg

SEQ ID NO: 10632 - DNA, 23 bp, Homo sapiens
acacctgccgcggcgcctagggg

SEQ ID NO: 10633 - DNA, 23 bp, Homo sapiens
gcgccgggcgttactgaacttgg

SEQ ID NO: 10634 - DNA, 23 bp, Homo sapiens
acgagtggactaagatcaatggg

SEQ ID NO: 10635 - DNA, 23 bp, Homo sapiens
tgttgatagatcagcgaacctgg

SEQ ID NO: 10636 - DNA, 23 bp, Homo sapiens
tccactactgccagaccagaagg

SEQ ID NO: 10637 - DNA, 23 bp, Homo sapiens
gtatggaggcttacatcacatgg

SEQ ID NO: 10638 - DNA, 23 bp, Homo sapiens
gttgcagatagaagaagaggtgg

SEQ ID NO: 10639 - DNA, 23 bp, Homo sapiens
agctggtaaaatgagaagttagg

SEQ ID NO: 10640 - DNA, 23 bp, Homo sapiens
agtgcccaaactgcttcagtagg

SEQ ID NO: 10641 - DNA, 23 bp, Homo sapiens
tgtttttatcgcagggcttctgg

SEQ ID NO: 10642 - DNA, 23 bp, Homo sapiens
gccaaaagaactggcgtaagagg

SEQ ID NO: 10643 - DNA, 23 bp, Homo sapiens
agacggagaaaaggactaggtgg

SEQ ID NO: 10644 - DNA, 23 bp, Homo sapiens
ttcggggaatcaattctccacgg

SEQ ID NO: 10645 - DNA, 23 bp, Homo sapiens
tgtgaagtaagaattctgcatgg

SEQ ID NO: 10646 - DNA, 23 bp, Homo sapiens
gcgcctggctggctctcaggagg

SEQ ID NO: 10647 - DNA, 23 bp, Homo sapiens
gcagaagcagagtattattcagg

SEQ ID NO: 10648 - DNA, 23 bp, Homo sapiens
acctcaaaagtctcacatggtgg

SEQ ID NO: 10649 - DNA, 23 bp, Homo sapiens
actaagtggagaatctttgacgg

SEQ ID NO: 10650 - DNA, 23 bp, Homo sapiens
ctaactattgtttcttggcctgg

SEQ ID NO: 10651 - DNA, 23 bp, Homo sapiens
aaaatctatacaaggctgccagg

SEQ ID NO: 10652 - DNA, 23 bp, Homo sapiens
tggcttctctcttcactgaatgg

SEQ ID NO: 10653 - DNA, 23 bp, Homo sapiens
ctaccccagcttatggctactgg

SEQ ID NO: 10654 - DNA, 23 bp, Homo sapiens
agacggcagggcaggtgtggtgg

SEQ ID NO: 10655 - DNA, 23 bp, Homo sapiens
tgcagtcactcaacaaacaaagg

SEQ ID NO: 10656 - DNA, 23 bp, Homo sapiens
agggcaatggcaagcaatcttgg

SEQ ID NO: 10657 - DNA, 23 bp, Homo sapiens
tggtggccgtttgttagtgctgg

SEQ ID NO: 10658 - DNA, 23 bp, Homo sapiens
ggagaaaaagatcgatgagaagg

SEQ ID NO: 10659 - DNA, 23 bp, Homo sapiens
cttacgcaaatttctgcaactgg

SEQ ID NO: 10660 - DNA, 23 bp, Homo sapiens
cctgcttctcccactcctgaagg

SEQ ID NO: 10661 - DNA, 23 bp, Homo sapiens
cagaacttcaaagaccaccaagg

SEQ ID NO: 10662 - DNA, 23 bp, Homo sapiens
tttatctctttcctctgctaagg

SEQ ID NO: 10663 - DNA, 23 bp, Homo sapiens
aagagacggcagggcaggtgtgg

SEQ ID NO: 10664 - DNA, 23 bp, Homo sapiens
ctgaccccacagaagcttgctgg

SEQ ID NO: 10665 - DNA, 23 bp, Homo sapiens
tctgggttccgggatctgaaagg

SEQ ID NO: 10666 - DNA, 23 bp, Homo sapiens
ggtgataatcagctcagctctgg

SEQ ID NO: 10667 - DNA, 23 bp, Homo sapiens
gacgaaccctccatctggggggg

SEQ ID NO: 10668 - DNA, 23 bp, Homo sapiens
agaagcatcagaagcagttgagg

SEQ ID NO: 10669 - DNA, 23 bp, Homo sapiens
aaaacatcagaaccagctaaggg

SEQ ID NO: 10670 - DNA, 23 bp, Homo sapiens
gagtggtacatcgtcatagccgg

SEQ ID NO: 10671 - DNA, 23 bp, Homo sapiens
gacgggaacccacgtctggctgg

SEQ ID NO: 10672 - DNA, 23 bp, Homo sapiens
agagagaaaagggctttacttgg

SEQ ID NO: 10673 - DNA, 23 bp, Homo sapiens
tagttcctcagctgcggtgatgg

SEQ ID NO: 10674 - DNA, 23 bp, Homo sapiens
tgctgataatcccagagctttgg

SEQ ID NO: 10675 - DNA, 23 bp, Homo sapiens
tgtgtctgtggggatgtttccgg

SEQ ID NO: 10676 - DNA, 23 bp, Homo sapiens
ttggttcaccccatggtgagagg

SEQ ID NO: 10677 - DNA, 23 bp, Homo sapiens
cccggggtggtgagctctaatgg

SEQ ID NO: 10678 - DNA, 23 bp, Homo sapiens
acattccagaagaaagatgctgg

SEQ ID NO: 10679 - DNA, 23 bp, Homo sapiens
aacaagacgaaggcctcaggagg

SEQ ID NO: 10680 - DNA, 23 bp, Homo sapiens
tcgcgtcgacgtggcctgaacgg

SEQ ID NO: 10681 - DNA, 23 bp, Homo sapiens
cagctgtgccaggctttgggggg

SEQ ID NO: 10682 - DNA, 23 bp, Homo sapiens
tggcttcgtttgggacaaaaagg

SEQ ID NO: 10683 - DNA, 23 bp, Homo sapiens
tgaagatcgtttagggcccatgg

SEQ ID NO: 10684 - DNA, 23 bp, Homo sapiens
tatcagttcaatcaagccagagg

SEQ ID NO: 10685 - DNA, 23 bp, Homo sapiens
ttctaacagttctagaggccagg

SEQ ID NO: 10686 - DNA, 23 bp, Homo sapiens
aacaagggggccaggcacagtgg

SEQ ID NO: 10687 - DNA, 23 bp, Homo sapiens
gggcccgcggcgtacacaatagg

SEQ ID NO: 10688 - DNA, 23 bp, Homo sapiens
gtttgtctgactcctccaagagg

SEQ ID NO: 10689 - DNA, 23 bp, Homo sapiens
ttcacttttaggggacattcagg

SEQ ID NO: 10690 - DNA, 23 bp, Homo sapiens
gtgtactcggggcctcactttgg

SEQ ID NO: 10691 - DNA, 23 bp, Homo sapiens
ctggaagcagaggccagagtagg

SEQ ID NO: 10692 - DNA, 23 bp, Homo sapiens
cctggcctggttgctgcaggagg

SEQ ID NO: 10693 - DNA, 23 bp, Homo sapiens
ctctcatatgttagggagcccgg

SEQ ID NO: 10694 - DNA, 23 bp, Homo sapiens
actccctcctccactcgctcagg

SEQ ID NO: 10695 - DNA, 23 bp, Homo sapiens
tcggctccctcgtcctaagcagg

SEQ ID NO: 10696 - DNA, 23 bp, Homo sapiens
cagctgcaagccaaggagtgagg

SEQ ID NO: 10697 - DNA, 23 bp, Homo sapiens
taaggagtggtcaaaaaatgtgg

SEQ ID NO: 10698 - DNA, 23 bp, Homo sapiens
ggaatcgtagcgacgttcagggg

SEQ ID NO: 10699 - DNA, 23 bp, Homo sapiens
gggatgactggacaagactttgg

SEQ ID NO: 10700 - DNA, 23 bp, Homo sapiens
cagtgtcttgggccgccgcaagg

SEQ ID NO: 10701 - DNA, 23 bp, Homo sapiens
ccacgtccttgtcctatccccgg

SEQ ID NO: 10702 - DNA, 23 bp, Homo sapiens
gtgcaacagttgctggtaaatgg

SEQ ID NO: 10703 - DNA, 23 bp, Homo sapiens
tcttgatgaattgtgcaaactgg

SEQ ID NO: 10704 - DNA, 23 bp, Homo sapiens
tttccaagaaaatggcgctaagg

SEQ ID NO: 10705 - DNA, 23 bp, Homo sapiens
tagcttctgggcacttctagagg

SEQ ID NO: 10706 - DNA, 23 bp, Homo sapiens
ggtcagcttattctgcttgcagg

SEQ ID NO: 10707 - DNA, 23 bp, Homo sapiens
ggggaagtctagagctcttcagg

SEQ ID NO: 10708 - DNA, 23 bp, Homo sapiens
taagccaggtgggatcagtgcgg

SEQ ID NO: 10709 - DNA, 23 bp, Homo sapiens
attcaacaatcacaggacactgg

SEQ ID NO: 10710 - DNA, 23 bp, Homo sapiens
tggcaccaccatgagctttgtgg

SEQ ID NO: 10711 - DNA, 23 bp, Homo sapiens
tgcagaagtcagctgtgaaaagg

SEQ ID NO: 10712 - DNA, 23 bp, Homo sapiens
atggccacagatttggtcacagg

SEQ ID NO: 10713 - DNA, 23 bp, Homo sapiens
tgggaggcacagtggcctgatgg

SEQ ID NO: 10714 - DNA, 23 bp, Homo sapiens
cagcccacgagaagtgacgcagg

SEQ ID NO: 10715 - DNA, 23 bp, Homo sapiens
tgagaccactgttgatgaactgg

SEQ ID NO: 10716 - DNA, 23 bp, Homo sapiens
gcggagtgggcggggcctgaggg

SEQ ID NO: 10717 - DNA, 23 bp, Homo sapiens
aactcagatgtgtccttacatgg

SEQ ID NO: 10718 - DNA, 23 bp, Homo sapiens
ttaggcagatattatcagcctgg

SEQ ID NO: 10719 - DNA, 23 bp, Homo sapiens
atgaggcagtttagaccattcgg

SEQ ID NO: 10720 - DNA, 23 bp, Homo sapiens
ttcagagcaggttattgcgctgg

SEQ ID NO: 10721 - DNA, 23 bp, Homo sapiens
agctagccctgggccaggaccgg

SEQ ID NO: 10722 - DNA, 23 bp, Homo sapiens
caaccgagtgcccgcggggctgg

SEQ ID NO: 10723 - DNA, 23 bp, Homo sapiens
gctgaaaaatctgagtgagaagg

SEQ ID NO: 10724 - DNA, 23 bp, Homo sapiens
atcatttctcatagctcaagcgg

SEQ ID NO: 10725 - DNA, 23 bp, Homo sapiens
gctgaagaagaagcagaagaagg

SEQ ID NO: 10726 - DNA, 23 bp, Homo sapiens
catggtttgcagggcatctgagg

SEQ ID NO: 10727 - DNA, 23 bp, Homo sapiens
ttgaggtgggagattactcgtgg

SEQ ID NO: 10728 - DNA, 23 bp, Homo sapiens
ccagagctggcgcactcctgagg

SEQ ID NO: 10729 - DNA, 23 bp, Homo sapiens
gcccaaagtgctaggattacagg

SEQ ID NO: 10730 - DNA, 23 bp, Homo sapiens
aaagtgctggattacaggcgtgg

SEQ ID NO: 10731 - DNA, 23 bp, Homo sapiens
taaatctttaatgcactggctgg

SEQ ID NO: 10732 - DNA, 23 bp, Homo sapiens
ctagaaagtttgcgaagagatgg

SEQ ID NO: 10733 - DNA, 23 bp, Homo sapiens
aaaactacagttgcatgaacggg

SEQ ID NO: 10734 - DNA, 23 bp, Homo sapiens
cgctggccgtggaacggtgacgg

SEQ ID NO: 10735 - DNA, 23 bp, Homo sapiens
agtttgctatttaacagaccagg

SEQ ID NO: 10736 - DNA, 23 bp, Homo sapiens
ggtcagtatatgctgtatcttgg

SEQ ID NO: 10737 - DNA, 23 bp, Homo sapiens
gcaagagctggctaatgccaggg

SEQ ID NO: 10738 - DNA, 23 bp, Homo sapiens
ggcaatccactcactagttttgg

SEQ ID NO: 10739 - DNA, 23 bp, Homo sapiens
ggtaccctgggggatctatttgg

SEQ ID NO: 10740 - DNA, 23 bp, Homo sapiens
cggtgaaattgtgcagcctgagg

SEQ ID NO: 10741 - DNA, 23 bp, Homo sapiens
cctcttcccttctgtctgagggg

SEQ ID NO: 10742 - DNA, 23 bp, Homo sapiens
ctgggacttgctgcagagtgtgg

SEQ ID NO: 10743 - DNA, 23 bp, Homo sapiens
ttcctggagacgctggagctggg

SEQ ID NO: 10744 - DNA, 23 bp, Homo sapiens
agatgcaacattcactacacagg

SEQ ID NO: 10745 - DNA, 23 bp, Homo sapiens
ccacgcaggcttctttactgcgg

SEQ ID NO: 10746 - DNA, 23 bp, Homo sapiens
gcagtggcacttagataatctgg

SEQ ID NO: 10747 - DNA, 23 bp, Homo sapiens
tgcagtgacagcttcagatgagg

SEQ ID NO: 10748 - DNA, 23 bp, Homo sapiens
aggtttgttacttggattgaggg

SEQ ID NO: 10749 - DNA, 23 bp, Homo sapiens
gaccactctgtggtttagaacgg

SEQ ID NO: 10750 - DNA, 23 bp, Homo sapiens
ctgaagttcaaggtagctaaagg

SEQ ID NO: 10751 - DNA, 23 bp, Homo sapiens
ttttattgcagactgcaccttgg

SEQ ID NO: 10752 - DNA, 23 bp, Homo sapiens
aatgctagaatccaccttttagg

SEQ ID NO: 10753 - DNA, 23 bp, Homo sapiens
gcaatggcatgtgtgttcagagg

SEQ ID NO: 10754 - DNA, 23 bp, Homo sapiens
ttcagattctctgaagttcatgg

SEQ ID NO: 10755 - DNA, 23 bp, Homo sapiens
tgttcgcaagaagctggattagg

SEQ ID NO: 10756 - DNA, 23 bp, Homo sapiens
tcagtcatcttttttgtctgagg

SEQ ID NO: 10757 - DNA, 23 bp, Homo sapiens
ttcacaaagcaatggtgccaagg

SEQ ID NO: 10758 - DNA, 23 bp, Homo sapiens
gtgcaagcacccaagcagaaggg

SEQ ID NO: 10759 - DNA, 23 bp, Homo sapiens
tccacgtcaattcctaaaacagg

SEQ ID NO: 10760 - DNA, 23 bp, Homo sapiens
gcttgggacattttacgctgagg

SEQ ID NO: 10761 - DNA, 23 bp, Homo sapiens
ctggatgacctgtcttgaggcgg

SEQ ID NO: 10762 - DNA, 23 bp, Homo sapiens
agccagggcaggttcagtccagg

SEQ ID NO: 10763 - DNA, 23 bp, Homo sapiens
aagtctctgaataagaagtcagg

SEQ ID NO: 10764 - DNA, 23 bp, Homo sapiens
gggcctcagtgaagaattagggg

SEQ ID NO: 10765 - DNA, 23 bp, Homo sapiens
gaacaggtgactgaatctaaagg

SEQ ID NO: 10766 - DNA, 23 bp, Homo sapiens
tggatcagttggcattacagtgg

SEQ ID NO: 10767 - DNA, 23 bp, Homo sapiens
ccattcttcctatggatggctgg

SEQ ID NO: 10768 - DNA, 23 bp, Homo sapiens
aataccaaacccgctactgatgg

SEQ ID NO: 10769 - DNA, 23 bp, Homo sapiens
actagacatcaccgtaacgaagg

SEQ ID NO: 10770 - DNA, 23 bp, Homo sapiens
atgcacgtgcagacattatgcgg

SEQ ID NO: 10771 - DNA, 23 bp, Homo sapiens
caaggcatctcagctttctgtgg

SEQ ID NO: 10772 - DNA, 23 bp, Homo sapiens
tcaacttactacagctggtgagg

SEQ ID NO: 10773 - DNA, 23 bp, Homo sapiens
cactcggctcctgggttcctagg

SEQ ID NO: 10774 - DNA, 23 bp, Homo sapiens
ccctgctggaccggccttagggg

SEQ ID NO: 10775 - DNA, 23 bp, Homo sapiens
cattccccggaccgggatcctgg

SEQ ID NO: 10776 - DNA, 23 bp, Homo sapiens
gctggagagtaccgtgtgagcgg

SEQ ID NO: 10777 - DNA, 23 bp, Homo sapiens
atggagagcacggtctaggtggg

SEQ ID NO: 10778 - DNA, 23 bp, Homo sapiens
gaacctgtgggaccctagccagg

SEQ ID NO: 10779 - DNA, 23 bp, Homo sapiens
tggaagagagtgtggtgtgatgg

SEQ ID NO: 10780 - DNA, 23 bp, Homo sapiens
ggcagaagctacatcatcaacgg

SEQ ID NO: 10781 - DNA, 23 bp, Homo sapiens
taatgttgaccagattgtccagg

SEQ ID NO: 10782 - DNA, 23 bp, Homo sapiens
acccaagcccctggtctcactgg

SEQ ID NO: 10783 - DNA, 23 bp, Homo sapiens
atcaagtgctagtctacctgcgg

SEQ ID NO: 10784 - DNA, 23 bp, Homo sapiens
cgaatggtttcttctaactccgg

SEQ ID NO: 10785 - DNA, 23 bp, Homo sapiens
gctgttggcaccaaaaagctagg

SEQ ID NO: 10786 - DNA, 23 bp, Homo sapiens
aacattcaagatggtagtgaggg

SEQ ID NO: 10787 - DNA, 23 bp, Homo sapiens
cagaggaagatgggaaagaaagg

SEQ ID NO: 10788 - DNA, 23 bp, Homo sapiens
tcaatgagtacttctgctgaggg

SEQ ID NO: 10789 - DNA, 23 bp, Homo sapiens
ggacaaggagaaaggaggaacgg

SEQ ID NO: 10790 - DNA, 23 bp, Homo sapiens
agaccagagtattattgctaagg

SEQ ID NO: 10791 - DNA, 23 bp, Homo sapiens
acagaagttggcttcagagctgg

SEQ ID NO: 10792 - DNA, 23 bp, Homo sapiens
aggatgtcctgctgtcacactgg

SEQ ID NO: 10793 - DNA, 23 bp, Homo sapiens
ataggggaccccttggcataggg

SEQ ID NO: 10794 - DNA, 23 bp, Homo sapiens
ggtgcccgccgtcgtcagcgggg

SEQ ID NO: 10795 - DNA, 23 bp, Homo sapiens
tgagccactgcttacctgagggg

SEQ ID NO: 10796 - DNA, 23 bp, Homo sapiens
aatcggactacctcataaatggg

SEQ ID NO: 10797 - DNA, 23 bp, Homo sapiens
tgaggctttgttactttgttagg

SEQ ID NO: 10798 - DNA, 23 bp, Homo sapiens
aattggtataagagagacagtgg

SEQ ID NO: 10799 - DNA, 23 bp, Homo sapiens
agtgtcttctgttgcagaatagg

SEQ ID NO: 10800 - DNA, 23 bp, Homo sapiens
gtgaagttcatctgccaatgcgg

SEQ ID NO: 10801 - DNA, 23 bp, Homo sapiens
ccagcggtcaacagaccaacagg

SEQ ID NO: 10802 - DNA, 23 bp, Homo sapiens
agaatgtgggcatttagacctgg

SEQ ID NO: 10803 - DNA, 23 bp, Homo sapiens
aggtcaggatgagtccgtgcagg

SEQ ID NO: 10804 - DNA, 23 bp, Homo sapiens
tcatgtcactcagcagttccagg

SEQ ID NO: 10805 - DNA, 23 bp, Homo sapiens
tgtacagactcctcctgaggagg

SEQ ID NO: 10806 - DNA, 23 bp, Homo sapiens
gaagatgatggactaccctgagg

SEQ ID NO: 10807 - DNA, 23 bp, Homo sapiens
ctcggcacaacgaactctgaagg

SEQ ID NO: 10808 - DNA, 23 bp, Homo sapiens
acagcagctaagaaaattgaggg

SEQ ID NO: 10809 - DNA, 23 bp, Homo sapiens
tatctactaagaccacagtgtgg

SEQ ID NO: 10810 - DNA, 23 bp, Homo sapiens
ggtgaaactctacacagaagtgg

SEQ ID NO: 10811 - DNA, 23 bp, Homo sapiens
cttcctcctaccaactcctgagg

SEQ ID NO: 10812 - DNA, 23 bp, Homo sapiens
taggctcaggtgcccagtcctgg

SEQ ID NO: 10813 - DNA, 23 bp, Homo sapiens
acccagagctacttcatcatagg

SEQ ID NO: 10814 - DNA, 23 bp, Homo sapiens
ctctatttgtttgagtgctctgg

SEQ ID NO: 10815 - DNA, 23 bp, Homo sapiens
gcacccaatgagtgttaaagagg

SEQ ID NO: 10816 - DNA, 23 bp, Homo sapiens
ggcattgaattcatcgatcctgg

SEQ ID NO: 10817 - DNA, 23 bp, Homo sapiens
tattacgctttgcttctttgcgg

SEQ ID NO: 10818 - DNA, 23 bp, Homo sapiens
ccaaggactcctgggaagactgg

SEQ ID NO: 10819 - DNA, 23 bp, Homo sapiens
tcatttgtggtagatgatgatgg

SEQ ID NO: 10820 - DNA, 23 bp, Homo sapiens
ttgaaggctaaaagacactttgg

SEQ ID NO: 10821 - DNA, 23 bp, Homo sapiens
aggatgcctcttcttcaacaagg

SEQ ID NO: 10822 - DNA, 23 bp, Homo sapiens
tgaggagggtggcctaaggtagg

SEQ ID NO: 10823 - DNA, 23 bp, Homo sapiens
gggtgcagaatggggtgcctagg

SEQ ID NO: 10824 - DNA, 23 bp, Homo sapiens
ctgctagatcaatgactgttcgg

SEQ ID NO: 10825 - DNA, 23 bp, Homo sapiens
gcctacgagatccactgctaggg

SEQ ID NO: 10826 - DNA, 23 bp, Homo sapiens
gacatcttaggctcagtgcccgg

SEQ ID NO: 10827 - DNA, 23 bp, Homo sapiens
cgctgccgcccaagcctgagcgg

SEQ ID NO: 10828 - DNA, 23 bp, Homo sapiens
agaccccacccaacctgactcgg

SEQ ID NO: 10829 - DNA, 23 bp, Homo sapiens
ccaggagaagcaggctctgatgg

SEQ ID NO: 10830 - DNA, 23 bp, Homo sapiens
ccctgacacggtcatcagggagg

SEQ ID NO: 10831 - DNA, 23 bp, Homo sapiens
gtccagccacctggtgtcactgg

SEQ ID NO: 10832 - DNA, 23 bp, Homo sapiens
tgagtgtttatcaactcagcagg

SEQ ID NO: 10833 - DNA, 23 bp, Homo sapiens
gacctgaccctaacactctgagg

SEQ ID NO: 10834 - DNA, 23 bp, Homo sapiens
cggaacaggcgctagggccccgg

SEQ ID NO: 10835 - DNA, 23 bp, Homo sapiens
gacaaaaaacacacctgacctgg

SEQ ID NO: 10836 - DNA, 23 bp, Homo sapiens
gacagaggatgtggctctcctgg

SEQ ID NO: 10837 - DNA, 23 bp, Homo sapiens
cagtttactgaaacccaccatgg

SEQ ID NO: 10838 - DNA, 23 bp, Homo sapiens
actgttggttaaacttctgccgg

SEQ ID NO: 10839 - DNA, 23 bp, Homo sapiens
ggagtcttaaagcgttagtatgg

SEQ ID NO: 10840 - DNA, 23 bp, Homo sapiens
tttcatggctgttgacctactgg

SEQ ID NO: 10841 - DNA, 23 bp, Homo sapiens
ccatgctagctctataagccagg

SEQ ID NO: 10842 - DNA, 23 bp, Homo sapiens
gagtgaagccctgccataggagg

SEQ ID NO: 10843 - DNA, 23 bp, Homo sapiens
aaagacaacccatcaatatcagg

SEQ ID NO: 10844 - DNA, 23 bp, Homo sapiens
ggaggatgaagacgaggacaagg

SEQ ID NO: 10845 - DNA, 23 bp, Homo sapiens
acacatacatacaagagtcacgg

SEQ ID NO: 10846 - DNA, 23 bp, Homo sapiens
ccaatctccataaatacggatgg

SEQ ID NO: 10847 - DNA, 23 bp, Homo sapiens
acctgatgatattagcactgtgg

SEQ ID NO: 10848 - DNA, 23 bp, Homo sapiens
ctcctccatcctcagcacagtgg

SEQ ID NO: 10849 - DNA, 23 bp, Homo sapiens
ccataccaaggacaaggtacagg

SEQ ID NO: 10850 - DNA, 23 bp, Homo sapiens
gaccgaattcctacttaacatgg

SEQ ID NO: 10851 - DNA, 23 bp, Homo sapiens
tatgttagcaccatgtgatgggg

SEQ ID NO: 10852 - DNA, 23 bp, Homo sapiens
atgtcttgctgtggaagactggg

SEQ ID NO: 10853 - DNA, 23 bp, Homo sapiens
tttactgcccacgccctacacgg

SEQ ID NO: 10854 - DNA, 23 bp, Homo sapiens
cctcccggcctgtctcactttgg

SEQ ID NO: 10855 - DNA, 23 bp, Homo sapiens
ccccagcacaaccaaaactacgg

SEQ ID NO: 10856 - DNA, 23 bp, Homo sapiens
gtcagcgcacgacagtcacgtgg

SEQ ID NO: 10857 - DNA, 23 bp, Homo sapiens
tttggtctgttatctgctgtagg

SEQ ID NO: 10858 - DNA, 23 bp, Homo sapiens
caagagacgcagatctgaggcgg

SEQ ID NO: 10859 - DNA, 23 bp, Homo sapiens
ttgtgttaactgttgttgtgtgg

SEQ ID NO: 10860 - DNA, 23 bp, Homo sapiens
tctggcaactaaataagctgagg

SEQ ID NO: 10861 - DNA, 23 bp, Homo sapiens
ctggagcaaggccagtgaagagg

SEQ ID NO: 10862 - DNA, 23 bp, Homo sapiens
gcagtgggggctatattaagtgg

SEQ ID NO: 10863 - DNA, 23 bp, Homo sapiens
acttcacgcaaacttcttcttgg

SEQ ID NO: 10864 - DNA, 23 bp, Homo sapiens
aaagttcttcttggttgaacagg

SEQ ID NO: 10865 - DNA, 23 bp, Homo sapiens
acaagctcactgctgagagtcgg

SEQ ID NO: 10866 - DNA, 23 bp, Homo sapiens
agccagatgtttcaaatcagcgg

SEQ ID NO: 10867 - DNA, 23 bp, Homo sapiens
aggccacgttcagaagacgaagg

SEQ ID NO: 10868 - DNA, 23 bp, Homo sapiens
tagaagaatagctctagatgtgg

SEQ ID NO: 10869 - DNA, 23 bp, Homo sapiens
aaatgtctgagtctctttcatgg

SEQ ID NO: 10870 - DNA, 23 bp, Homo sapiens
taacctctttggaattgctcagg

SEQ ID NO: 10871 - DNA, 23 bp, Homo sapiens
taagctcacgttgaataactagg

SEQ ID NO: 10872 - DNA, 23 bp, Homo sapiens
tccattcaaaccttctgacaagg

SEQ ID NO: 10873 - DNA, 23 bp, Homo sapiens
tgttcctgaaaatgaggcacagg

SEQ ID NO: 10874 - DNA, 23 bp, Homo sapiens
agcaggtgggagggggctagggg

SEQ ID NO: 10875 - DNA, 23 bp, Homo sapiens
gaaaggtaccttgaagaggaagg

SEQ ID NO: 10876 - DNA, 23 bp, Homo sapiens
cccagtggagagtcacatctcgg

SEQ ID NO: 10877 - DNA, 23 bp, Homo sapiens
gctcgatgagaagacaggcatgg

SEQ ID NO: 10878 - DNA, 23 bp, Homo sapiens
gccacactccaaggtcacttagg

SEQ ID NO: 10879 - DNA, 23 bp, Homo sapiens
gatccttaaggatgtcagtgagg

SEQ ID NO: 10880 - DNA, 23 bp, Homo sapiens
gctgcagctcagacgtgacatgg

SEQ ID NO: 10881 - DNA, 23 bp, Homo sapiens
caggtgggtggtgggtcacctgg

SEQ ID NO: 10882 - DNA, 23 bp, Homo sapiens
gtggagggctgacaaggagcagg

SEQ ID NO: 10883 - DNA, 23 bp, Homo sapiens
gtctgtaaacgttctgttacagg

SEQ ID NO: 10884 - DNA, 23 bp, Homo sapiens
attctgttttcatttgctcccgg

SEQ ID NO: 10885 - DNA, 23 bp, Homo sapiens
cctgccactcgaagtcaaagagg

SEQ ID NO: 10886 - DNA, 23 bp, Homo sapiens
agtgcgggacaagatggaggagg

SEQ ID NO: 10887 - DNA, 23 bp, Homo sapiens
tcaagctgaaatagcacagctgg

SEQ ID NO: 10888 - DNA, 23 bp, Homo sapiens
attcgagcactaactatgatagg

SEQ ID NO: 10889 - DNA, 23 bp, Homo sapiens
gcctgcctcagcttaggacatgg

SEQ ID NO: 10890 - DNA, 23 bp, Homo sapiens
tcagagctggaatttactgctgg

SEQ ID NO: 10891 - DNA, 23 bp, Homo sapiens
aagggtggttttcctactgctgg

SEQ ID NO: 10892 - DNA, 23 bp, Homo sapiens
caggatcttcaagtaagttgtgg

SEQ ID NO: 10893 - DNA, 23 bp, Homo sapiens
aaaaagacatacgattggagcgg

SEQ ID NO: 10894 - DNA, 23 bp, Homo sapiens
agcatcttgaagtctttcacagg

SEQ ID NO: 10895 - DNA, 23 bp, Homo sapiens
tgtaaaaggaaaaccaggaaagg

SEQ ID NO: 10896 - DNA, 23 bp, Homo sapiens
aggcttgcactcgcaagagaagg

SEQ ID NO: 10897 - DNA, 23 bp, Homo sapiens
tggaagattgatgtcccaaacgg

SEQ ID NO: 10898 - DNA, 23 bp, Homo sapiens
catccagaagctattacatgtgg

SEQ ID NO: 10899 - DNA, 23 bp, Homo sapiens
gctgcccagatcctcagaagggg

SEQ ID NO: 10900 - DNA, 23 bp, Homo sapiens
ctgataaatctctgggaagcagg

SEQ ID NO: 10901 - DNA, 23 bp, Homo sapiens
ccagaagctgggctaactgacgg

SEQ ID NO: 10902 - DNA, 23 bp, Homo sapiens
gccgcaggggcgctctgaaaggg

SEQ ID NO: 10903 - DNA, 23 bp, Homo sapiens
gcagcccgcgagggaatgcgagg

SEQ ID NO: 10904 - DNA, 23 bp, Homo sapiens
ggacccttcatcatcattaatgg

SEQ ID NO: 10905 - DNA, 23 bp, Homo sapiens
gttaagctagctgctgtttatgg

SEQ ID NO: 10906 - DNA, 23 bp, Homo sapiens
ctctggctccagggaatgtgagg

SEQ ID NO: 10907 - DNA, 23 bp, Homo sapiens
tgcaattctctctaggtagatgg

SEQ ID NO: 10908 - DNA, 23 bp, Homo sapiens
cgggcagcactcagctgctgtgg

SEQ ID NO: 10909 - DNA, 23 bp, Homo sapiens
tgagacaaaagctctcaggctgg

SEQ ID NO: 10910 - DNA, 23 bp, Homo sapiens
ccagaagcagatctcttctgtgg

SEQ ID NO: 10911 - DNA, 23 bp, Homo sapiens
accaagcagaatacactttgagg

SEQ ID NO: 10912 - DNA, 23 bp, Homo sapiens
cctgggcctggacctcagcctgg

SEQ ID NO: 10913 - DNA, 23 bp, Homo sapiens
gcctcacaggcctccatgacagg

SEQ ID NO: 10914 - DNA, 23 bp, Homo sapiens
tggaggaagagaaagggtatagg

SEQ ID NO: 10915 - DNA, 23 bp, Homo sapiens
acatcgtagccatctgggggagg

SEQ ID NO: 10916 - DNA, 23 bp, Homo sapiens
ggccgtaccactgtggctgctgg

SEQ ID NO: 10917 - DNA, 23 bp, Homo sapiens
tacaagcacctggatatgtgagg

SEQ ID NO: 10918 - DNA, 23 bp, Homo sapiens
cgagatggaaggacacttatagg

SEQ ID NO: 10919 - DNA, 23 bp, Homo sapiens
tcatcaagagtatctgctcgagg

SEQ ID NO: 10920 - DNA, 23 bp, Homo sapiens
tggcaccgccagcctcatcgagg

SEQ ID NO: 10921 - DNA, 23 bp, Homo sapiens
cccccaaaaaactgtaagtgagg

SEQ ID NO: 10922 - DNA, 23 bp, Homo sapiens
actgtgcaagatgaaccagcagg

SEQ ID NO: 10923 - DNA, 23 bp, Homo sapiens
gtgtacggactcaggatgacagg

SEQ ID NO: 10924 - DNA, 23 bp, Homo sapiens
cacagcttttggaccctaaaagg

SEQ ID NO: 10925 - DNA, 23 bp, Homo sapiens
tcgtgggggccgggagtttgcgg

SEQ ID NO: 10926 - DNA, 23 bp, Homo sapiens
ccgggactggcagggtgtgaggg

SEQ ID NO: 10927 - DNA, 23 bp, Homo sapiens
ccctgcagcagaaacagtgatgg

SEQ ID NO: 10928 - DNA, 23 bp, Homo sapiens
gttgcccctccactgagagttgg

SEQ ID NO: 10929 - DNA, 23 bp, Homo sapiens
aagaagcctggcagacaggcggg

SEQ ID NO: 10930 - DNA, 23 bp, Homo sapiens
agagtctcactggaatgcagtgg

SEQ ID NO: 10931 - DNA, 23 bp, Homo sapiens
aggaaactcattcacacttcagg

SEQ ID NO: 10932 - DNA, 23 bp, Homo sapiens
acatcagtacacagaagagacgg

SEQ ID NO: 10933 - DNA, 23 bp, Homo sapiens
cagcagcaggacgcctagcctgg

SEQ ID NO: 10934 - DNA, 23 bp, Homo sapiens
ttaaattctgtagcacactgagg

SEQ ID NO: 10935 - DNA, 23 bp, Homo sapiens
tggactctgaacaaaactaaagg

SEQ ID NO: 10936 - DNA, 23 bp, Homo sapiens
gatccaaatggcatctcagctgg

SEQ ID NO: 10937 - DNA, 23 bp, Homo sapiens
ggaagggggcccggctccctagg

SEQ ID NO: 10938 - DNA, 23 bp, Homo sapiens
cgactaaactttcccgactcagg

SEQ ID NO: 10939 - DNA, 23 bp, Homo sapiens
gcaggtaggcatgttctcagggg

SEQ ID NO: 10940 - DNA, 23 bp, Homo sapiens
aggtgtctggggtgctcaggtgg

SEQ ID NO: 10941 - DNA, 23 bp, Homo sapiens
ggggggaccatggtttttactgg

SEQ ID NO: 10942 - DNA, 23 bp, Homo sapiens
ttccaagttctacagagcgaagg

SEQ ID NO: 10943 - DNA, 23 bp, Homo sapiens
aattcctttggcgctaaagatgg

SEQ ID NO: 10944 - DNA, 23 bp, Homo sapiens
ggtggggaaagacttaaaagtgg

SEQ ID NO: 10945 - DNA, 23 bp, Homo sapiens
ctcccagctgcccacctcatagg

SEQ ID NO: 10946 - DNA, 23 bp, Homo sapiens
gggccgtgatggtggggtgaggg

SEQ ID NO: 10947 - DNA, 23 bp, Homo sapiens
ttcagttcgtttaacttgagagg

SEQ ID NO: 10948 - DNA, 23 bp, Homo sapiens
gttgtagggtctgctgtcaaagg

SEQ ID NO: 10949 - DNA, 23 bp, Homo sapiens
tgtagattctgtttcactccagg

SEQ ID NO: 10950 - DNA, 23 bp, Homo sapiens
gacccctgactgctactccttgg

SEQ ID NO: 10951 - DNA, 23 bp, Homo sapiens
ggcggcgtcggcggcgtcagcgg

SEQ ID NO: 10952 - DNA, 23 bp, Homo sapiens
cgggtgccagggctcaggcccgg

SEQ ID NO: 10953 - DNA, 23 bp, Homo sapiens
ttctcagactcagtcagtcatgg

SEQ ID NO: 10954 - DNA, 23 bp, Homo sapiens
gggccttggtctcaggcccacgg

SEQ ID NO: 10955 - DNA, 23 bp, Homo sapiens
ttcttcggttttacttcctgagg

SEQ ID NO: 10956 - DNA, 23 bp, Homo sapiens
tggggctcaggagcgataagtgg

SEQ ID NO: 10957 - DNA, 23 bp, Homo sapiens
aaaaacgtctcacgacacagtgg

SEQ ID NO: 10958 - DNA, 23 bp, Homo sapiens
agctataaaagaagagcgcaagg

SEQ ID NO: 10959 - DNA, 23 bp, Homo sapiens
gagacgggttcagatctcgccgg

SEQ ID NO: 10960 - DNA, 23 bp, Homo sapiens
tgtatttcgcacttcggtcccgg

SEQ ID NO: 10961 - DNA, 23 bp, Homo sapiens
ctctgaagagcgcgaagcagggg

SEQ ID NO: 10962 - DNA, 23 bp, Homo sapiens
agacacaaacactgaatcgaagg

SEQ ID NO: 10963 - DNA, 23 bp, Homo sapiens
tggcgactatattacaaatgtgg

SEQ ID NO: 10964 - DNA, 23 bp, Homo sapiens
agacattcatacatatccggtgg

SEQ ID NO: 10965 - DNA, 23 bp, Homo sapiens
acaagaaggtcacatcatcctgg

SEQ ID NO: 10966 - DNA, 23 bp, Homo sapiens
actacacaagcgtcctaaattgg

SEQ ID NO: 10967 - DNA, 23 bp, Homo sapiens
gccaaccaggccctgtgctgagg

SEQ ID NO: 10968 - DNA, 23 bp, Homo sapiens
attgaccagctttgaagggatgg

SEQ ID NO: 10969 - DNA, 23 bp, Homo sapiens
agacatcagagatactcaacagg

SEQ ID NO: 10970 - DNA, 23 bp, Homo sapiens
tcagtccatccatccatcactgg

SEQ ID NO: 10971 - DNA, 23 bp, Homo sapiens
ccaggatagctgcgtggctaagg

SEQ ID NO: 10972 - DNA, 23 bp, Homo sapiens
tctgccaaaggaagtacaactgg

SEQ ID NO: 10973 - DNA, 23 bp, Homo sapiens
ttccctggggggaaggtcacagg

SEQ ID NO: 10974 - DNA, 23 bp, Homo sapiens
gacagggtctgggcggtcagggg

SEQ ID NO: 10975 - DNA, 23 bp, Homo sapiens
ttgcactgtggaattcaggaagg

SEQ ID NO: 10976 - DNA, 23 bp, Homo sapiens
gcaatgaccctcaaaacagaggg

SEQ ID NO: 10977 - DNA, 23 bp, Homo sapiens
agtctcagtgcagcagccagagg

SEQ ID NO: 10978 - DNA, 23 bp, Homo sapiens
ctcttgccaggactgtggagcgg

SEQ ID NO: 10979 - DNA, 23 bp, Homo sapiens
cagatgtcaccaaaatcacctgg

SEQ ID NO: 10980 - DNA, 23 bp, Homo sapiens
aggactgtggagcggataggggg

SEQ ID NO: 10981 - DNA, 23 bp, Homo sapiens
ggcctgccctcctctgggctggg

SEQ ID NO: 10982 - DNA, 23 bp, Homo sapiens
agcgaattttacaacacttgagg

SEQ ID NO: 10983 - DNA, 23 bp, Homo sapiens
gcagtcccgtggctcaagacagg

SEQ ID NO: 10984 - DNA, 23 bp, Homo sapiens
ttgactgtgcacctttgagcagg

SEQ ID NO: 10985 - DNA, 23 bp, Homo sapiens
tcatcagttcgatatgcacaagg

SEQ ID NO: 10986 - DNA, 23 bp, Homo sapiens
ggagcacatgatagtagcattgg

SEQ ID NO: 10987 - DNA, 23 bp, Homo sapiens
tgtgagcgtgcgggagggctagg

SEQ ID NO: 10988 - DNA, 23 bp, Homo sapiens
ttttcataggtaggactttcagg

SEQ ID NO: 10989 - DNA, 23 bp, Homo sapiens
agaagaaatgctcttttgcttgg

SEQ ID NO: 10990 - DNA, 23 bp, Homo sapiens
cagatccgaagaggaactcctgg

SEQ ID NO: 10991 - DNA, 23 bp, Homo sapiens
gccaagtacctcaagagacatgg

SEQ ID NO: 10992 - DNA, 23 bp, Homo sapiens
aagtcattgtctatgtccgatgg

SEQ ID NO: 10993 - DNA, 23 bp, Homo sapiens
ccgctttgagcccagaggtgcgg

SEQ ID NO: 10994 - DNA, 23 bp, Homo sapiens
ctgtgctctaaggctgctgctgg

SEQ ID NO: 10995 - DNA, 23 bp, Homo sapiens
gcctctgcaaccatgactgacgg

SEQ ID NO: 10996 - DNA, 23 bp, Homo sapiens
catctctcatgaaggcgatttgg

SEQ ID NO: 10997 - DNA, 23 bp, Homo sapiens
ctgggcagacacgagcaggaggg

SEQ ID NO: 10998 - DNA, 23 bp, Homo sapiens
tcagctggaattcttcacactgg

SEQ ID NO: 10999 - DNA, 23 bp, Homo sapiens
ttcagcagtgtgccgagaagagg

SEQ ID NO: 11000 - DNA, 23 bp, Homo sapiens
gtgggcggggactctacagtcgg

SEQ ID NO: 11001 - DNA, 23 bp, Homo sapiens
caggtggagaagctcacagtagg

SEQ ID NO: 11002 - DNA, 23 bp, Homo sapiens
gctagatggtcagtccctgaagg

SEQ ID NO: 11003 - DNA, 23 bp, Homo sapiens
tcccagtcctcctgctggtgggg

SEQ ID NO: 11004 - DNA, 23 bp, Homo sapiens
ggttagggctcatgttatagtgg

SEQ ID NO: 11005 - DNA, 23 bp, Homo sapiens
gaatggtggcatcacagcaatgg

SEQ ID NO: 11006 - DNA, 23 bp, Homo sapiens
cttcggggactgctgccctgagg

SEQ ID NO: 11007 - DNA, 23 bp, Homo sapiens
tcttagtgacgtcaatcaattgg

SEQ ID NO: 11008 - DNA, 23 bp, Homo sapiens
gggccagcgactagttagacagg

SEQ ID NO: 11009 - DNA, 23 bp, Homo sapiens
tacaaagctgccaggagaaatgg

SEQ ID NO: 11010 - DNA, 23 bp, Homo sapiens
tcatgagatctgagatatactgg

SEQ ID NO: 11011 - DNA, 23 bp, Homo sapiens
tcaaggcaatatgcagctcaagg

SEQ ID NO: 11012 - DNA, 23 bp, Homo sapiens
ccctgcacaagttggccttgagg

SEQ ID NO: 11013 - DNA, 23 bp, Homo sapiens
ccttggagtaattcgtcgacagg

SEQ ID NO: 11014 - DNA, 23 bp, Homo sapiens
cgttccaatgcactccagcctgg

SEQ ID NO: 11015 - DNA, 23 bp, Homo sapiens
gtccccggcttgctaggtcctgg

SEQ ID NO: 11016 - DNA, 23 bp, Homo sapiens
ttgatgtattctgacgtcatagg

SEQ ID NO: 11017 - DNA, 23 bp, Homo sapiens
aaaactcattgcttctgagttgg

SEQ ID NO: 11018 - DNA, 23 bp, Homo sapiens
gtgtgtgtgtgtgtgtaagcagg

SEQ ID NO: 11019 - DNA, 23 bp, Homo sapiens
caaacactagttcatccctgtgg

SEQ ID NO: 11020 - DNA, 23 bp, Homo sapiens
gtttgaagatttcatcctcctgg

SEQ ID NO: 11021 - DNA, 23 bp, Homo sapiens
aacttccctctatcacagttagg

SEQ ID NO: 11022 - DNA, 23 bp, Homo sapiens
taagcaagagaatcattagctgg

SEQ ID NO: 11023 - DNA, 23 bp, Homo sapiens
tcagtcacctgctgctcaacagg

SEQ ID NO: 11024 - DNA, 23 bp, Homo sapiens
acaaagcttagctccccgcttgg

SEQ ID NO: 11025 - DNA, 23 bp, Homo sapiens
gaagttcattcgcattcacccgg

SEQ ID NO: 11026 - DNA, 23 bp, Homo sapiens
tcatctaaacttcagcttccagg

SEQ ID NO: 11027 - DNA, 23 bp, Homo sapiens
cgtcagtatgttcaaggttgtgg

SEQ ID NO: 11028 - DNA, 23 bp, Homo sapiens
ggctgtgaggtttcctaaactgg

SEQ ID NO: 11029 - DNA, 23 bp, Homo sapiens
gactgtgaggtttcctaaactgg

SEQ ID NO: 11030 - DNA, 23 bp, Homo sapiens
accctggcacggtggctggatgg

SEQ ID NO: 11031 - DNA, 23 bp, Homo sapiens
cccgcaccctgtttcatctcagg

SEQ ID NO: 11032 - DNA, 23 bp, Homo sapiens
gcagttacgcatgtattcacagg

SEQ ID NO: 11033 - DNA, 23 bp, Homo sapiens
tcttgctctggcaagttttgagg

SEQ ID NO: 11034 - DNA, 23 bp, Homo sapiens
caaagatctgaggaaaagactgg

SEQ ID NO: 11035 - DNA, 23 bp, Homo sapiens
ggttcaggagcagctgcacatgg

SEQ ID NO: 11036 - DNA, 23 bp, Homo sapiens
gagctgggcgccgacatctgagg

SEQ ID NO: 11037 - DNA, 23 bp, Homo sapiens
catagccactgagatctgagggg

SEQ ID NO: 11038 - DNA, 23 bp, Homo sapiens
atcactgctactgagatctaggg

SEQ ID NO: 11039 - DNA, 23 bp, Homo sapiens
ccaggtcgatcagatttctgtgg

SEQ ID NO: 11040 - DNA, 23 bp, Homo sapiens
aacgattcttctttttcacctgg

SEQ ID NO: 11041 - DNA, 23 bp, Homo sapiens
gctggtgacttagggccttgagg

SEQ ID NO: 11042 - DNA, 23 bp, Homo sapiens
gggggaggagtcagaagaaaggg

SEQ ID NO: 11043 - DNA, 23 bp, Homo sapiens
aagtaacatggcagcatttgagg

SEQ ID NO: 11044 - DNA, 23 bp, Homo sapiens
cctgaccaacccgaaaagtttgg

SEQ ID NO: 11045 - DNA, 23 bp, Homo sapiens
aaaagcctggacaaactataggg

SEQ ID NO: 11046 - DNA, 23 bp, Homo sapiens
cccagatcggcccgccctgatgg

SEQ ID NO: 11047 - DNA, 23 bp, Homo sapiens
aactgcattctccacttctgagg

SEQ ID NO: 11048 - DNA, 23 bp, Homo sapiens
gcttagacagtgttatcgcttgg

SEQ ID NO: 11049 - DNA, 23 bp, Homo sapiens
gctcccccactacttccccgtgg

SEQ ID NO: 11050 - DNA, 23 bp, Homo sapiens
gaagcgaaggaacaaagaaatgg

SEQ ID NO: 11051 - DNA, 23 bp, Homo sapiens
cgagcctgcaggctacgccacgg

SEQ ID NO: 11052 - DNA, 23 bp, Homo sapiens
aaaattcctgtcaatgactgagg

SEQ ID NO: 11053 - DNA, 23 bp, Homo sapiens
aagaagcactcattcactcgcgg

SEQ ID NO: 11054 - DNA, 23 bp, Homo sapiens
gctcataaaggcagctgaggggg

SEQ ID NO: 11055 - DNA, 23 bp, Homo sapiens
cgggatcagcccctcctgagtgg

SEQ ID NO: 11056 - DNA, 23 bp, Homo sapiens
atttgaggttgatcccttccagg

SEQ ID NO: 11057 - DNA, 23 bp, Homo sapiens
cccggcctgtctctagctgatgg

SEQ ID NO: 11058 - DNA, 23 bp, Homo sapiens
cgagaaggtgtacatcatgtagg

SEQ ID NO: 11059 - DNA, 23 bp, Homo sapiens
ccttacatgtcccaaaaagatgg

SEQ ID NO: 11060 - DNA, 23 bp, Homo sapiens
cactggtaagtacacgatgctgg

SEQ ID NO: 11061 - DNA, 23 bp, Homo sapiens
tcagactcacatgaaaaactcgg

SEQ ID NO: 11062 - DNA, 23 bp, Homo sapiens
ccagtgatctgtatttgatgagg

SEQ ID NO: 11063 - DNA, 23 bp, Homo sapiens
gctcggggtccggcgcctacagg

SEQ ID NO: 11064 - DNA, 23 bp, Homo sapiens
cacgactcacagaaagaactcgg

SEQ ID NO: 11065 - DNA, 23 bp, Homo sapiens
cgggggcgggcactaggagcagg

SEQ ID NO: 11066 - DNA, 23 bp, Homo sapiens
ggcacaccaggccaaactattgg

SEQ ID NO: 11067 - DNA, 23 bp, Homo sapiens
gggcaggaccaggatgcagctgg

SEQ ID NO: 11068 - DNA, 23 bp, Homo sapiens
ggggcactcagtgagattccagg

SEQ ID NO: 11069 - DNA, 23 bp, Homo sapiens
ctgaaatccgggtcaagtgaagg

SEQ ID NO: 11070 - DNA, 23 bp, Homo sapiens
gctttgagagaggaggaagaggg

SEQ ID NO: 11071 - DNA, 23 bp, Homo sapiens
tgtcttactttattcagggtagg

SEQ ID NO: 11072 - DNA, 23 bp, Homo sapiens
gctttgagagaggagggagaggg

SEQ ID NO: 11073 - DNA, 23 bp, Homo sapiens
tgaatgggcttttagagaggggg

SEQ ID NO: 11074 - DNA, 23 bp, Homo sapiens
catgaacgggctttgagagaggg

SEQ ID NO: 11075 - DNA, 23 bp, Homo sapiens
tgagtgggttttgagagaggggg

SEQ ID NO: 11076 - DNA, 23 bp, Homo sapiens
gctttgttagaggaggaagaggg

SEQ ID NO: 11077 - DNA, 23 bp, Homo sapiens
gctccttgacttaatacttgagg

SEQ ID NO: 11078 - DNA, 23 bp, Homo sapiens
tgagtgggctttgagagaggggg

SEQ ID NO: 11079 - DNA, 23 bp, Homo sapiens
gaggagaaaggagtttgagcagg

SEQ ID NO: 11080 - DNA, 23 bp, Homo sapiens
gttttgggagaggagcaagaggg

SEQ ID NO: 11081 - DNA, 23 bp, Homo sapiens
aatctgcctgagttctcacatgg

SEQ ID NO: 11082 - DNA, 23 bp, Homo sapiens
ccctcagactttactgcagttgg

SEQ ID NO: 11083 - DNA, 23 bp, Homo sapiens
gtcagccctgactcaaattctgg

SEQ ID NO: 11084 - DNA, 23 bp, Homo sapiens
gcgccagggccagggctagcagg

SEQ ID NO: 11085 - DNA, 23 bp, Homo sapiens
gcctcagatttcacttagcatgg

SEQ ID NO: 11086 - DNA, 23 bp, Homo sapiens
tacaactctggctcagactccgg

SEQ ID NO: 11087 - DNA, 23 bp, Homo sapiens
tgcttcaacttcactaggcgtgg

SEQ ID NO: 11088 - DNA, 23 bp, Homo sapiens
aatttgccttagatctcacatgg

SEQ ID NO: 11089 - DNA, 23 bp, Homo sapiens
cagtggccaagactgtctcaggg

SEQ ID NO: 11090 - DNA, 23 bp, Homo sapiens
gcattgagactgagagcttaagg

SEQ ID NO: 11091 - DNA, 23 bp, Homo sapiens
acttcactcagaagagaagctgg

SEQ ID NO: 11092 - DNA, 23 bp, Homo sapiens
tcctagacttcactcagaaaagg

SEQ ID NO: 11093 - DNA, 23 bp, Homo sapiens
aaaggcactagggatgatactgg

SEQ ID NO: 11094 - DNA, 23 bp, Homo sapiens
gaagttggtggacatgacactgg

SEQ ID NO: 11095 - DNA, 23 bp, Homo sapiens
tggtgccattggtttcttctggg

SEQ ID NO: 11096 - DNA, 23 bp, Homo sapiens
tcacttgtaggagaaaccacagg

SEQ ID NO: 11097 - DNA, 23 bp, Homo sapiens
agatcgctgcagttcgtcaacgg

SEQ ID NO: 11098 - DNA, 23 bp, Homo sapiens
ccgaaactcttactggatccagg

SEQ ID NO: 11099 - DNA, 23 bp, Homo sapiens
ttgttcacaacttcaggtagagg

SEQ ID NO: 11100 - DNA, 23 bp, Homo sapiens
catattccctagacttcacgtgg

SEQ ID NO: 11101 - DNA, 23 bp, Homo sapiens
ccggcatccacctctggtgaggg

SEQ ID NO: 11102 - DNA, 23 bp, Homo sapiens
tctgcctcagatctacttaaggg

SEQ ID NO: 11103 - DNA, 23 bp, Homo sapiens
atctctgctacacctattagcgg

SEQ ID NO: 11104 - DNA, 23 bp, Homo sapiens
acaaggtgttccggaagtgaggg

SEQ ID NO: 11105 - DNA, 23 bp, Homo sapiens
actcagcgtctcagatactgagg

SEQ ID NO: 11106 - DNA, 23 bp, Homo sapiens
caaattcatggagtcatgccagg

SEQ ID NO: 11107 - DNA, 23 bp, Homo sapiens
tggccgcgcggctcatctgctgg

SEQ ID NO: 11108 - DNA, 23 bp, Homo sapiens
ctattggtatggctgagaaacgg

SEQ ID NO: 11109 - DNA, 23 bp, Homo sapiens
gtgaaacccgagcaacattaagg

SEQ ID NO: 11110 - DNA, 23 bp, Homo sapiens
ggctcagtgtctccgccttccgg

SEQ ID NO: 11111 - DNA, 23 bp, Homo sapiens
tgtttggtcttcagtcttattgg

SEQ ID NO: 11112 - DNA, 23 bp, Homo sapiens
taaaatactcgaaggccttcagg

SEQ ID NO: 11113 - DNA, 23 bp, Homo sapiens
gctacctctgacatggatattgg

SEQ ID NO: 11114 - DNA, 23 bp, Homo sapiens
tgagtgttcaatccgtgcaatgg

SEQ ID NO: 11115 - DNA, 23 bp, Homo sapiens
gagcagccaccggcttctttggg

SEQ ID NO: 11116 - DNA, 23 bp, Homo sapiens
gcatttggaaggctcaagagtgg

SEQ ID NO: 11117 - DNA, 23 bp, Homo sapiens
ttcacaccatagactcctaccgg

SEQ ID NO: 11118 - DNA, 23 bp, Homo sapiens
atgctgaaagggaaatcacgtgg

SEQ ID NO: 11119 - DNA, 23 bp, Homo sapiens
agggttatcgtcttccaccatgg

SEQ ID NO: 11120 - DNA, 23 bp, Homo sapiens
cggtgttctctttaatcagatgg

SEQ ID NO: 11121 - DNA, 23 bp, Homo sapiens
tgggtctggctttacgaagatgg

SEQ ID NO: 11122 - DNA, 23 bp, Homo sapiens
gcctggcgcctgtgcatcagtgg

SEQ ID NO: 11123 - DNA, 23 bp, Homo sapiens
gctatttgagatgatgtgacagg

SEQ ID NO: 11124 - DNA, 23 bp, Homo sapiens
tacttcatctgtgactccagtgg

SEQ ID NO: 11125 - DNA, 23 bp, Homo sapiens
taccatttagtttctctgacagg

SEQ ID NO: 11126 - DNA, 23 bp, Homo sapiens
acaatcatcaggatattctgagg

SEQ ID NO: 11127 - DNA, 23 bp, Homo sapiens
ccaaggagagaaatttcagaagg

SEQ ID NO: 11128 - DNA, 23 bp, Homo sapiens
tggggtggtctacggatcactgg

SEQ ID NO: 11129 - DNA, 23 bp, Homo sapiens
acctgttagggtctcagtaatgg

SEQ ID NO: 11130 - DNA, 23 bp, Homo sapiens
cagagcctggtaatgatgactgg

SEQ ID NO: 11131 - DNA, 23 bp, Homo sapiens
ttggggcctctcttgattagggg

SEQ ID NO: 11132 - DNA, 23 bp, Homo sapiens
gcaagtcacccaggatgctgggg

SEQ ID NO: 11133 - DNA, 23 bp, Homo sapiens
atatgcattctgccgttcagggg

SEQ ID NO: 11134 - DNA, 23 bp, Homo sapiens
tgctggaggatccatggtgatgg

SEQ ID NO: 11135 - DNA, 23 bp, Homo sapiens
aaaggaagttgaaatcagagagg

SEQ ID NO: 11136 - DNA, 23 bp, Homo sapiens
aactgctttcatcgaacagcagg

SEQ ID NO: 11137 - DNA, 23 bp, Homo sapiens
atctggacccctgcctagggtgg

SEQ ID NO: 11138 - DNA, 23 bp, Homo sapiens
gcagcagagcttctttctagcgg

SEQ ID NO: 11139 - DNA, 23 bp, Homo sapiens
atggggtcagtgtctgccccagg

SEQ ID NO: 11140 - DNA, 23 bp, Homo sapiens
aaagtcaggttcacctcaactgg

SEQ ID NO: 11141 - DNA, 23 bp, Homo sapiens
tttcgcctccgcttgggttaggg

SEQ ID NO: 11142 - DNA, 23 bp, Homo sapiens
atggaaggaggtggatggttagg

SEQ ID NO: 11143 - DNA, 23 bp, Homo sapiens
ccgtccacccaaaggaaatccgg

SEQ ID NO: 11144 - DNA, 23 bp, Homo sapiens
ccagccccagggactcagtgtgg

SEQ ID NO: 11145 - DNA, 23 bp, Homo sapiens
gcccaccagcaagaatgagttgg

SEQ ID NO: 11146 - DNA, 23 bp, Homo sapiens
agaaagagactaagaagaagcgg

SEQ ID NO: 11147 - DNA, 23 bp, Homo sapiens
tgcattaagaaacaggcagctgg

SEQ ID NO: 11148 - DNA, 23 bp, Homo sapiens
catgtacagtgatgtcatcccgg

SEQ ID NO: 11149 - DNA, 23 bp, Homo sapiens
ggagcagtggctcatgtgagggg

SEQ ID NO: 11150 - DNA, 23 bp, Homo sapiens
agattgagcagactacaaatcgg

SEQ ID NO: 11151 - DNA, 23 bp, Homo sapiens
gggatctatgtggacatctaagg

SEQ ID NO: 11152 - DNA, 23 bp, Homo sapiens
atgaagagttctccttcatatgg

SEQ ID NO: 11153 - DNA, 23 bp, Homo sapiens
agaacagaacttcaagaccgtgg

SEQ ID NO: 11154 - DNA, 23 bp, Homo sapiens
gacccttctatcaactcccccgg

SEQ ID NO: 11155 - DNA, 23 bp, Homo sapiens
gcttcctggcccacaaaaggggg

SEQ ID NO: 11156 - DNA, 23 bp, Homo sapiens
gaagaaggcaatgatgatgttgg

SEQ ID NO: 11157 - DNA, 23 bp, Homo sapiens
ctttcagaactcaatcttgcagg

SEQ ID NO: 11158 - DNA, 23 bp, Homo sapiens
tacagttcaatcttgcatgcagg

SEQ ID NO: 11159 - DNA, 23 bp, Homo sapiens
actgctggctcagaagccgaagg

SEQ ID NO: 11160 - DNA, 23 bp, Homo sapiens
atgcctcccaggagacgttcggg

SEQ ID NO: 11161 - DNA, 23 bp, Homo sapiens
gtgcctcccaggagacgttcggg

SEQ ID NO: 11162 - DNA, 23 bp, Homo sapiens
cttcccgacatgggctagagagg

SEQ ID NO: 11163 - DNA, 23 bp, Homo sapiens
cgccttcccggcctgcaaggtgg

SEQ ID NO: 11164 - DNA, 23 bp, Homo sapiens
actgctgcactcgctaagcaggg

SEQ ID NO: 11165 - DNA, 23 bp, Homo sapiens
agcacaccaacccatgctgctgg

SEQ ID NO: 11166 - DNA, 23 bp, Homo sapiens
ggagcccggccactgtcacacgg

SEQ ID NO: 11167 - DNA, 23 bp, Homo sapiens
tcctgggagaagactcatagggg

SEQ ID NO: 11168 - DNA, 23 bp, Homo sapiens
gcgatatcaatcgacatacatgg

SEQ ID NO: 11169 - DNA, 23 bp, Homo sapiens
gtgccctgcggcagcctcacggg

SEQ ID NO: 11170 - DNA, 23 bp, Homo sapiens
tgaatccaaaggaacagatgtgg

SEQ ID NO: 11171 - DNA, 23 bp, Homo sapiens
gccaagcagctacctgaagaagg

SEQ ID NO: 11172 - DNA, 23 bp, Homo sapiens
atccagtctttcgtactacatgg

SEQ ID NO: 11173 - DNA, 23 bp, Homo sapiens
cggtggtgggcaggccttagtgg

SEQ ID NO: 11174 - DNA, 23 bp, Homo sapiens
ccggaagcggggccttgagtggg

SEQ ID NO: 11175 - DNA, 23 bp, Homo sapiens
aatacgagtggctttcatggagg

SEQ ID NO: 11176 - DNA, 23 bp, Homo sapiens
atgtgtattccttcattaccagg

SEQ ID NO: 11177 - DNA, 23 bp, Homo sapiens
agcatggccagctggagaacagg

SEQ ID NO: 11178 - DNA, 23 bp, Homo sapiens
ggcctcagaaaccaaagacaagg

SEQ ID NO: 11179 - DNA, 23 bp, Homo sapiens
tactgtggtctcactagtcaagg

SEQ ID NO: 11180 - DNA, 23 bp, Homo sapiens
tcagtgacttctctccaagaagg

SEQ ID NO: 11181 - DNA, 23 bp, Homo sapiens
cttcagctgatgaactcttaagg

SEQ ID NO: 11182 - DNA, 23 bp, Homo sapiens
atcaaaagtttctccatccacgg

SEQ ID NO: 11183 - DNA, 23 bp, Homo sapiens
tgaggaggaggataatgacatgg

SEQ ID NO: 11184 - DNA, 23 bp, Homo sapiens
taaggcacttagtttaagacagg

SEQ ID NO: 11185 - DNA, 23 bp, Homo sapiens
agtacatgagctgtgcaaagtgg

SEQ ID NO: 11186 - DNA, 23 bp, Homo sapiens
cctcgaccattcgtttgtcaagg

SEQ ID NO: 11187 - DNA, 23 bp, Homo sapiens
gatgctgtgcacactgtggaagg

SEQ ID NO: 11188 - DNA, 23 bp, Homo sapiens
attcagctctcagggtccagagg

SEQ ID NO: 11189 - DNA, 23 bp, Homo sapiens
agaactggaccaggatgaaaagg

SEQ ID NO: 11190 - DNA, 23 bp, Homo sapiens
agtcagcagcagaaacgacaagg

SEQ ID NO: 11191 - DNA, 23 bp, Homo sapiens
gaaatccccagctcccctctggg

SEQ ID NO: 11192 - DNA, 23 bp, Homo sapiens
atacagtatcagaagaggcaggg

SEQ ID NO: 11193 - DNA, 23 bp, Homo sapiens
atgcgtacaggcttgtcagcagg

SEQ ID NO: 11194 - DNA, 23 bp, Homo sapiens
caacgcttgaatatggctgaagg

SEQ ID NO: 11195 - DNA, 23 bp, Homo sapiens
atgagatccagcaggagttctgg

SEQ ID NO: 11196 - DNA, 23 bp, Homo sapiens
atggtggtcatggagtagaaggg

SEQ ID NO: 11197 - DNA, 23 bp, Homo sapiens
ccaagcgctcactggtctagtgg

SEQ ID NO: 11198 - DNA, 23 bp, Homo sapiens
gaccttggacagccagatccagg

SEQ ID NO: 11199 - DNA, 23 bp, Homo sapiens
cccccctagggactcattcctgg

SEQ ID NO: 11200 - DNA, 23 bp, Homo sapiens
gggcgtgtctccaccactacagg

SEQ ID NO: 11201 - DNA, 23 bp, Homo sapiens
acaggcccgctgctcttagtagg

SEQ ID NO: 11202 - DNA, 23 bp, Homo sapiens
aactgttttcatgacccgccagg

SEQ ID NO: 11203 - DNA, 23 bp, Homo sapiens
gcaggacttctcttctgagctgg

SEQ ID NO: 11204 - DNA, 23 bp, Homo sapiens
agcaatctctacatcttggctgg

SEQ ID NO: 11205 - DNA, 23 bp, Homo sapiens
gatgaacaataaactggctgagg

SEQ ID NO: 11206 - DNA, 23 bp, Homo sapiens
tgtcaaggggtgagtgtcaaggg

SEQ ID NO: 11207 - DNA, 23 bp, Homo sapiens
gcagtcacacgttgagaatccgg

SEQ ID NO: 11208 - DNA, 23 bp, Homo sapiens
gggcccctgcctcaggtagatgg

SEQ ID NO: 11209 - DNA, 23 bp, Homo sapiens
tccaaggcaaaccctcttaaagg

SEQ ID NO: 11210 - DNA, 23 bp, Homo sapiens
atgctgtatttgtcaacagaagg

SEQ ID NO: 11211 - DNA, 23 bp, Homo sapiens
ttattgtctaaaggtgtctgagg

SEQ ID NO: 11212 - DNA, 23 bp, Homo sapiens
tttgcgaacacagttctgcttgg

SEQ ID NO: 11213 - DNA, 23 bp, Homo sapiens
tttaagatctgtatcctggctgg

SEQ ID NO: 11214 - DNA, 23 bp, Homo sapiens
caggacccctgggttgttgcagg

SEQ ID NO: 11215 - DNA, 23 bp, Homo sapiens
tcagatatatgacaagcagttgg

SEQ ID NO: 11216 - DNA, 23 bp, Homo sapiens
agcctggagattgagcagtgagg

SEQ ID NO: 11217 - DNA, 23 bp, Homo sapiens
gagcccagagatcttcacagagg

SEQ ID NO: 11218 - DNA, 23 bp, Homo sapiens
cggagtggcatgaagctgtaggg

SEQ ID NO: 11219 - DNA, 23 bp, Homo sapiens
accccttgaccaagaagagatgg

SEQ ID NO: 11220 - DNA, 23 bp, Homo sapiens
tcacctcatggatattgaattgg

SEQ ID NO: 11221 - DNA, 23 bp, Homo sapiens
ttttccactcatctataaggagg

SEQ ID NO: 11222 - DNA, 23 bp, Homo sapiens
ggagtagggcggctcacacatgg

SEQ ID NO: 11223 - DNA, 23 bp, Homo sapiens
tggtaagaatgggggccaccagg

SEQ ID NO: 11224 - DNA, 23 bp, Homo sapiens
ctgggggcaggggagcagggggg

SEQ ID NO: 11225 - DNA, 23 bp, Homo sapiens
gagatgtctgtctgggctagggg

SEQ ID NO: 11226 - DNA, 23 bp, Homo sapiens
aggtccgacgacaggctcacagg

SEQ ID NO: 11227 - DNA, 23 bp, Homo sapiens
tctccaaagaaaggtggtgaggg

SEQ ID NO: 11228 - DNA, 23 bp, Homo sapiens
atgctgctgtatgtttgatgagg

SEQ ID NO: 11229 - DNA, 23 bp, Homo sapiens
gcacaggctgggggcctcagggg

SEQ ID NO: 11230 - DNA, 23 bp, Homo sapiens
agtcatctacagcagcccagagg

SEQ ID NO: 11231 - DNA, 23 bp, Homo sapiens
ccaagaatggagttatacggggg

SEQ ID NO: 11232 - DNA, 23 bp, Homo sapiens
cggggctgcacagctactccagg

SEQ ID NO: 11233 - DNA, 23 bp, Homo sapiens
agcggtgggcaggctactccagg

SEQ ID NO: 11234 - DNA, 23 bp, Homo sapiens
ggcagggcagcagcttcactcgg

SEQ ID NO: 11235 - DNA, 23 bp, Homo sapiens
cccgaagtcatcctgggtatggg

SEQ ID NO: 11236 - DNA, 23 bp, Homo sapiens
cctgaggcattaagaaagcatgg

SEQ ID NO: 11237 - DNA, 23 bp, Homo sapiens
ccttgaaggctgtcgatgatagg

SEQ ID NO: 11238 - DNA, 23 bp, Homo sapiens
tgggaagaaagaagcaagaatgg

SEQ ID NO: 11239 - DNA, 23 bp, Homo sapiens
aggccagtgtcactgctgcccgg

SEQ ID NO: 11240 - DNA, 23 bp, Homo sapiens
aaaggatcccagaaagtttcagg

SEQ ID NO: 11241 - DNA, 23 bp, Homo sapiens
agaatcctctgctcacaacctgg

SEQ ID NO: 11242 - DNA, 23 bp, Homo sapiens
aggagggcgcggtggctcagtgg

SEQ ID NO: 11243 - DNA, 23 bp, Homo sapiens
tccaaggccccatgagctactgg

SEQ ID NO: 11244 - DNA, 23 bp, Homo sapiens
aagtctgaagctgtcattattgg

SEQ ID NO: 11245 - DNA, 23 bp, Homo sapiens
tcgagccgtggaacggcgtatgg

SEQ ID NO: 11246 - DNA, 23 bp, Homo sapiens
tactcttcttgctcctcctgtgg

SEQ ID NO: 11247 - DNA, 23 bp, Homo sapiens
ggtcagtactcttcctgctgcgg

SEQ ID NO: 11248 - DNA, 23 bp, Homo sapiens
aagaccaggacgagtactgaggg

SEQ ID NO: 11249 - DNA, 23 bp, Homo sapiens
gccaagcagggtttgtgatcagg

SEQ ID NO: 11250 - DNA, 23 bp, Homo sapiens
ggacatacggttcccattactgg

SEQ ID NO: 11251 - DNA, 23 bp, Homo sapiens
agatctcagtcaatccctcctgg

SEQ ID NO: 11252 - DNA, 23 bp, Homo sapiens
tggtgaccctgtgtatcggatgg

SEQ ID NO: 11253 - DNA, 23 bp, Homo sapiens
ctgaagttgtatcagtctgatgg

SEQ ID NO: 11254 - DNA, 23 bp, Homo sapiens
caaagccaggtcgtctagcaagg

SEQ ID NO: 11255 - DNA, 23 bp, Homo sapiens
ggccagtcctgccattttgaggg

SEQ ID NO: 11256 - DNA, 23 bp, Homo sapiens
agaagataacagctcgggggagg

SEQ ID NO: 11257 - DNA, 23 bp, Homo sapiens
ggagagcccagcattcatactgg

SEQ ID NO: 11258 - DNA, 23 bp, Homo sapiens
ttcggtcaagaggaactcaaagg

SEQ ID NO: 11259 - DNA, 23 bp, Homo sapiens
tgactctcatgaccagctctcgg

SEQ ID NO: 11260 - DNA, 23 bp, Homo sapiens
acagcagcaatatttacgacagg

SEQ ID NO: 11261 - DNA, 23 bp, Homo sapiens
ctttattcttgggatgactgtgg

SEQ ID NO: 11262 - DNA, 23 bp, Homo sapiens
aagaagacggagaccataacagg

SEQ ID NO: 11263 - DNA, 23 bp, Homo sapiens
tgcacagagcctgaagacactgg

SEQ ID NO: 11264 - DNA, 23 bp, Homo sapiens
agggtcactacagtctgaactgg

SEQ ID NO: 11265 - DNA, 23 bp, Homo sapiens
agaagcccccccagcggaggcgg

SEQ ID NO: 11266 - DNA, 23 bp, Homo sapiens
gctgagcagaatgagtagctagg

SEQ ID NO: 11267 - DNA, 23 bp, Homo sapiens
gtggagtgcagcgtctgacccgg

SEQ ID NO: 11268 - DNA, 23 bp, Homo sapiens
tccaaatgggagttaaagcttgg

SEQ ID NO: 11269 - DNA, 23 bp, Homo sapiens
aaatcctaccagtctacaaaagg

SEQ ID NO: 11270 - DNA, 23 bp, Homo sapiens
ttcgcttcaagcgaatatctggg

SEQ ID NO: 11271 - DNA, 23 bp, Homo sapiens
caacgagctgaagctttaacagg

SEQ ID NO: 11272 - DNA, 23 bp, Homo sapiens
gggttacagctttagctcattgg

SEQ ID NO: 11273 - DNA, 23 bp, Homo sapiens
ccgtggtggctcagagctcgagg

SEQ ID NO: 11274 - DNA, 23 bp, Homo sapiens
gctggtcagcttcacactccagg

SEQ ID NO: 11275 - DNA, 23 bp, Homo sapiens
aaaccccctgaagcccctaaagg

SEQ ID NO: 11276 - DNA, 23 bp, Homo sapiens
aagaactgagtttctaggtccgg

SEQ ID NO: 11277 - DNA, 23 bp, Homo sapiens
ggcaagcaggaggtggcgtgagg

SEQ ID NO: 11278 - DNA, 23 bp, Homo sapiens
acatcattcggaaagccgacagg

SEQ ID NO: 11279 - DNA, 23 bp, Homo sapiens
gcaccggaatatctgtggtctgg

SEQ ID NO: 11280 - DNA, 23 bp, Homo sapiens
taaagggctaccgaaaagttagg

SEQ ID NO: 11281 - DNA, 23 bp, Homo sapiens
caattgtctttctggcgccgagg

SEQ ID NO: 11282 - DNA, 23 bp, Homo sapiens
cagggagcacagggtcgatgtgg

SEQ ID NO: 11283 - DNA, 23 bp, Homo sapiens
agtgtctgaaggatgggacgtgg

SEQ ID NO: 11284 - DNA, 23 bp, Homo sapiens
ccaaattcagttcctcactccgg

SEQ ID NO: 11285 - DNA, 23 bp, Homo sapiens
ttgtggagccccaggtggaacgg

SEQ ID NO: 11286 - DNA, 23 bp, Homo sapiens
actaattatgttctcgatccagg

SEQ ID NO: 11287 - DNA, 23 bp, Homo sapiens
ggagctccaggggaggctagagg

SEQ ID NO: 11288 - DNA, 23 bp, Homo sapiens
gacccccttggctatggtcccgg

SEQ ID NO: 11289 - DNA, 23 bp, Homo sapiens
aaagcatcgggatttggcattgg

SEQ ID NO: 11290 - DNA, 23 bp, Homo sapiens
ggcaggggatcagtctcttccgg

SEQ ID NO: 11291 - DNA, 23 bp, Homo sapiens
atgtggtggcaattcatccaagg

SEQ ID NO: 11292 - DNA, 23 bp, Homo sapiens
cacaaaaaggccttgtaacgggg

SEQ ID NO: 11293 - DNA, 23 bp, Homo sapiens
gctcagcacctgactgtatctgg

SEQ ID NO: 11294 - DNA, 23 bp, Homo sapiens
gctctaaaatacaagcttcctgg

SEQ ID NO: 11295 - DNA, 23 bp, Homo sapiens
agctttttgggcacttcccatgg

SEQ ID NO: 11296 - DNA, 23 bp, Homo sapiens
tgacaagagatggagacaaacgg

SEQ ID NO: 11297 - DNA, 23 bp, Homo sapiens
ccgggtggggtcagggctcctgg

SEQ ID NO: 11298 - DNA, 23 bp, Homo sapiens
ctggagaacacagttgtctaagg

SEQ ID NO: 11299 - DNA, 23 bp, Homo sapiens
tgtatctcaggcgattttccagg

SEQ ID NO: 11300 - DNA, 23 bp, Homo sapiens
gatacgagctgaccttgtcctgg

SEQ ID NO: 11301 - DNA, 23 bp, Homo sapiens
agctggccaaccagaagtgaggg

SEQ ID NO: 11302 - DNA, 23 bp, Homo sapiens
agaagaacgcagacagaagaagg

SEQ ID NO: 11303 - DNA, 23 bp, Homo sapiens
tggccccatcaaggcctcacagg

SEQ ID NO: 11304 - DNA, 23 bp, Homo sapiens
ttcactagtgcagacgccgccgg

SEQ ID NO: 11305 - DNA, 23 bp, Homo sapiens
aatgctcttctggagcagcaagg

SEQ ID NO: 11306 - DNA, 23 bp, Homo sapiens
cacttggtagcttgaaatgaagg

SEQ ID NO: 11307 - DNA, 23 bp, Homo sapiens
cctgccccgagtggcttagctgg

SEQ ID NO: 11308 - DNA, 23 bp, Homo sapiens
tttccaactgttttctgccatgg

SEQ ID NO: 11309 - DNA, 23 bp, Homo sapiens
caaccaacttggagctcaccagg

SEQ ID NO: 11310 - DNA, 23 bp, Homo sapiens
ccacagcccacctgctgaggggg

SEQ ID NO: 11311 - DNA, 23 bp, Homo sapiens
gagcggcaggggcctagccctgg

SEQ ID NO: 11312 - DNA, 23 bp, Homo sapiens
tctcaagtttttctgtcctgagg

SEQ ID NO: 11313 - DNA, 23 bp, Homo sapiens
tcaatcctgacgatgtcacaagg

SEQ ID NO: 11314 - DNA, 23 bp, Homo sapiens
accacccaaccccagtattctgg

SEQ ID NO: 11315 - DNA, 23 bp, Homo sapiens
cacctccagcttcgatgatgtgg

SEQ ID NO: 11316 - DNA, 23 bp, Homo sapiens
gaaacacaaatcagggaaccagg

SEQ ID NO: 11317 - DNA, 23 bp, Homo sapiens
ggagctagaaagcagtagactgg

SEQ ID NO: 11318 - DNA, 23 bp, Homo sapiens
gggtgtcctgcagaagaagctgg

SEQ ID NO: 11319 - DNA, 23 bp, Homo sapiens
atggatattgaaatggacagtgg

SEQ ID NO: 11320 - DNA, 23 bp, Homo sapiens
gcaccagggaagcattatggagg

SEQ ID NO: 11321 - DNA, 23 bp, Homo sapiens
ccggagatggagcacgtctaggg

SEQ ID NO: 11322 - DNA, 23 bp, Homo sapiens
tttcttagcgtttttcaggacgg

SEQ ID NO: 11323 - DNA, 23 bp, Homo sapiens
cgggcagaaatgctgacaggtgg

SEQ ID NO: 11324 - DNA, 23 bp, Homo sapiens
tgtcagcatttctgcctgcctgg

SEQ ID NO: 11325 - DNA, 23 bp, Homo sapiens
aggcagaaatgctgacaggtggg

SEQ ID NO: 11326 - DNA, 23 bp, Homo sapiens
ccaattgagcttcatgggattgg

SEQ ID NO: 11327 - DNA, 23 bp, Homo sapiens
ttcagcacatttggtctctgagg

SEQ ID NO: 11328 - DNA, 23 bp, Homo sapiens
ttgtgtcaatgagtggaagcagg

SEQ ID NO: 11329 - DNA, 23 bp, Homo sapiens
gtggagtagtctctgttatctgg

SEQ ID NO: 11330 - DNA, 23 bp, Homo sapiens
gctccaggtatggctgctatggg

SEQ ID NO: 11331 - DNA, 23 bp, Homo sapiens
aaaatattgaggcccacttgcgg

SEQ ID NO: 11332 - DNA, 23 bp, Homo sapiens
tgagaggagtttttcatggaagg

SEQ ID NO: 11333 - DNA, 23 bp, Homo sapiens
ctgtgagttccctatctgaaggg

SEQ ID NO: 11334 - DNA, 23 bp, Homo sapiens
ctctcgaggctgattagtgcagg

SEQ ID NO: 11335 - DNA, 23 bp, Homo sapiens
tcagtatagatactagggcgagg

SEQ ID NO: 11336 - DNA, 23 bp, Homo sapiens
acatctgggtaacatacttgtgg

SEQ ID NO: 11337 - DNA, 23 bp, Homo sapiens
cttgtggctagtcagatgttcgg

SEQ ID NO: 11338 - DNA, 23 bp, Homo sapiens
agtttgtggcaattctattgagg

SEQ ID NO: 11339 - DNA, 23 bp, Homo sapiens
ggctgtggctgttgctgcgaagg

SEQ ID NO: 11340 - DNA, 23 bp, Homo sapiens
ccgttcgctgcaccaactacagg

SEQ ID NO: 11341 - DNA, 23 bp, Homo sapiens
ttaatagagttcagagtctgagg

SEQ ID NO: 11342 - DNA, 23 bp, Homo sapiens
tcatcactaaagcagtgatcggg

SEQ ID NO: 11343 - DNA, 23 bp, Homo sapiens
aagcagaatacagtacaccatgg

SEQ ID NO: 11344 - DNA, 23 bp, Homo sapiens
tgggcgggctcactcaccgcagg

SEQ ID NO: 11345 - DNA, 23 bp, Homo sapiens
tcgtgacagcttactcctcccgg

SEQ ID NO: 11346 - DNA, 23 bp, Homo sapiens
aggtgagctctgaggagtagagg

SEQ ID NO: 11347 - DNA, 23 bp, Homo sapiens
gggttttcagcgtctagccatgg

SEQ ID NO: 11348 - DNA, 23 bp, Homo sapiens
atcaaacaagagccatgaggtgg

SEQ ID NO: 11349 - DNA, 23 bp, Homo sapiens
aaagaccccttcggtgtgaccgg

SEQ ID NO: 11350 - DNA, 23 bp, Homo sapiens
gactctggatggttacagcacgg

SEQ ID NO: 11351 - DNA, 23 bp, Homo sapiens
ccgcgtgcaccgcgctcaccagg

SEQ ID NO: 11352 - DNA, 23 bp, Homo sapiens
tgcagcaggtactggtagaatgg

SEQ ID NO: 11353 - DNA, 23 bp, Homo sapiens
ggctgcaacggcatgaacttggg

SEQ ID NO: 11354 - DNA, 23 bp, Homo sapiens
atctgctagacaagtcacaaagg

SEQ ID NO: 11355 - DNA, 23 bp, Homo sapiens
actttgtgcttaatcccttctgg

SEQ ID NO: 11356 - DNA, 23 bp, Homo sapiens
gagagaaatacatcgatctgagg

SEQ ID NO: 11357 - DNA, 23 bp, Homo sapiens
gcgtctgaaatgaaacttagagg

SEQ ID NO: 11358 - DNA, 23 bp, Homo sapiens
tgagccccctgcagtcatctcgg

SEQ ID NO: 11359 - DNA, 23 bp, Homo sapiens
agcgaagtttcattggtgtgtgg

SEQ ID NO: 11360 - DNA, 23 bp, Homo sapiens
agaatcagacaaaagggaatcgg

SEQ ID NO: 11361 - DNA, 23 bp, Homo sapiens
cggtatcttcaggatgtaactgg

SEQ ID NO: 11362 - DNA, 23 bp, Homo sapiens
caccaagagagccttggaggagg

SEQ ID NO: 11363 - DNA, 23 bp, Homo sapiens
tggtggagtccttgtggaactgg

SEQ ID NO: 11364 - DNA, 23 bp, Homo sapiens
tcctctcatttattgaggtgagg

SEQ ID NO: 11365 - DNA, 23 bp, Homo sapiens
aggagagccatctccgacacagg

SEQ ID NO: 11366 - DNA, 23 bp, Homo sapiens
ctgacaaagccccccgaaaaggg

SEQ ID NO: 11367 - DNA, 23 bp, Homo sapiens
tccgacctgcaggggtagcgcgg

SEQ ID NO: 11368 - DNA, 23 bp, Homo sapiens
cgcagggaggtcagctctcctgg

SEQ ID NO: 11369 - DNA, 23 bp, Homo sapiens
agttcatcttcactcattagtgg

SEQ ID NO: 11370 - DNA, 23 bp, Homo sapiens
tacatcttctgaaaactaggcgg

SEQ ID NO: 11371 - DNA, 23 bp, Homo sapiens
gaggagaggacagaaagcaaagg

SEQ ID NO: 11372 - DNA, 23 bp, Homo sapiens
ccaaagaagagcgactgagaagg

SEQ ID NO: 11373 - DNA, 23 bp, Homo sapiens
ggaccacatcacagctcaactgg

SEQ ID NO: 11374 - DNA, 23 bp, Homo sapiens
tgctggagtaggagctggtttgg

SEQ ID NO: 11375 - DNA, 23 bp, Homo sapiens
tctgaagttcgggttatttaagg

SEQ ID NO: 11376 - DNA, 23 bp, Homo sapiens
atgatcctgcagcagttctgagg

SEQ ID NO: 11377 - DNA, 23 bp, Homo sapiens
atcatcttcctcatctgaggagg

SEQ ID NO: 11378 - DNA, 23 bp, Homo sapiens
ctctgcgctgctagacatggtgg

SEQ ID NO: 11379 - DNA, 23 bp, Homo sapiens
aaggcttcagagcaagcgcacgg

SEQ ID NO: 11380 - DNA, 23 bp, Homo sapiens
gaggcggcgcgactcacttgagg

SEQ ID NO: 11381 - DNA, 23 bp, Homo sapiens
caatcttcgagcaagtagttagg

SEQ ID NO: 11382 - DNA, 23 bp, Homo sapiens
agacaaaagtgatccgtgtccgg

SEQ ID NO: 11383 - DNA, 23 bp, Homo sapiens
cagggttacctcttgaaaaaagg

SEQ ID NO: 11384 - DNA, 23 bp, Homo sapiens
ggaattggatctactagtgcagg

SEQ ID NO: 11385 - DNA, 23 bp, Homo sapiens
tgaagcatttgattgtgactggg

SEQ ID NO: 11386 - DNA, 23 bp, Homo sapiens
cagcagcaaaaatgtgtgaatgg

SEQ ID NO: 11387 - DNA, 23 bp, Homo sapiens
acatccctcacattgaaatatgg

SEQ ID NO: 11388 - DNA, 23 bp, Homo sapiens
atcagaacaggctctgtatgtgg

SEQ ID NO: 11389 - DNA, 23 bp, Homo sapiens
ctagagaaaatagttgtcccagg

SEQ ID NO: 11390 - DNA, 23 bp, Homo sapiens
ctcggaggagcattcgctgctgg

SEQ ID NO: 11391 - DNA, 23 bp, Homo sapiens
cctgcatctgctgtcggaggagg

SEQ ID NO: 11392 - DNA, 23 bp, Homo sapiens
cagcagaataaagatactggagg

SEQ ID NO: 11393 - DNA, 23 bp, Homo sapiens
aacttacccggaggatacagtgg

SEQ ID NO: 11394 - DNA, 23 bp, Homo sapiens
gtcactgtcattgtgacaatagg

SEQ ID NO: 11395 - DNA, 23 bp, Homo sapiens
tgacaataggtagttttcagggg

SEQ ID NO: 11396 - DNA, 23 bp, Homo sapiens
ccgggcgctctaggacttcttgg

SEQ ID NO: 11397 - DNA, 23 bp, Homo sapiens
gaatcaccagctgttcctagtgg

SEQ ID NO: 11398 - DNA, 23 bp, Homo sapiens
cctgccaccactcctcactgtgg

SEQ ID NO: 11399 - DNA, 23 bp, Homo sapiens
tatgggctatgagaaggatctgg

SEQ ID NO: 11400 - DNA, 23 bp, Homo sapiens
aagaagcgcagcgctctctaggg

SEQ ID NO: 11401 - DNA, 23 bp, Homo sapiens
acccttttctctggtgacattgg

SEQ ID NO: 11402 - DNA, 23 bp, Homo sapiens
aaacagcatgctctatgtgttgg

SEQ ID NO: 11403 - DNA, 23 bp, Homo sapiens
catctgcctctccgacaaattgg

SEQ ID NO: 11404 - DNA, 23 bp, Homo sapiens
gagaatgacgcgcctgtttcagg

SEQ ID NO: 11405 - DNA, 23 bp, Homo sapiens
agacactttattagatccacagg

SEQ ID NO: 11406 - DNA, 23 bp, Homo sapiens
agggtagtggagttctcaggtgg

SEQ ID NO: 11407 - DNA, 23 bp, Homo sapiens
gcccccgacagaggctcaggagg

SEQ ID NO: 11408 - DNA, 23 bp, Homo sapiens
cacgcttgttcagagagctgcgg

SEQ ID NO: 11409 - DNA, 23 bp, Homo sapiens
gaaatctgtatggaatgctgtgg

SEQ ID NO: 11410 - DNA, 23 bp, Homo sapiens
atcatctctgcaacgccaagagg

SEQ ID NO: 11411 - DNA, 23 bp, Homo sapiens
ccaggataaggtcaccttcgagg

SEQ ID NO: 11412 - DNA, 23 bp, Homo sapiens
atcattgtctagtcaggcagagg

SEQ ID NO: 11413 - DNA, 23 bp, Homo sapiens
tttgatctgttaggattccacgg

SEQ ID NO: 11414 - DNA, 23 bp, Homo sapiens
ccgtcacagcggctcacttcagg

SEQ ID NO: 11415 - DNA, 23 bp, Homo sapiens
agccaagaaagggaagggaaagg

SEQ ID NO: 11416 - DNA, 23 bp, Homo sapiens
aaaaggaaggagaatttctgggg

SEQ ID NO: 11417 - DNA, 23 bp, Homo sapiens
ggaactggaacattctaccaagg

SEQ ID NO: 11418 - DNA, 23 bp, Homo sapiens
ttcacaaagcttctcttatgtgg

SEQ ID NO: 11419 - DNA, 23 bp, Homo sapiens
cttatagacaggtcaactagggg

SEQ ID NO: 11420 - DNA, 23 bp, Homo sapiens
actttagccactgctactacagg

SEQ ID NO: 11421 - DNA, 23 bp, Homo sapiens
agagattcagctggttattaagg

SEQ ID NO: 11422 - DNA, 23 bp, Homo sapiens
atgtatgcatttatgctctgagg

SEQ ID NO: 11423 - DNA, 23 bp, Homo sapiens
tcttctttctgttctatgggtgg

SEQ ID NO: 11424 - DNA, 23 bp, Homo sapiens
aaactgggtactgagtgatgagg

SEQ ID NO: 11425 - DNA, 23 bp, Homo sapiens
ctttcagtttaggcctcaaatgg

SEQ ID NO: 11426 - DNA, 23 bp, Homo sapiens
gcctttgaggtccagccttgagg

SEQ ID NO: 11427 - DNA, 23 bp, Homo sapiens
tcccagcctccacaactgtgagg

SEQ ID NO: 11428 - DNA, 23 bp, Homo sapiens
acagaccaaagttgaccagtagg

SEQ ID NO: 11429 - DNA, 23 bp, Homo sapiens
taaacattgtttccttgacctgg

SEQ ID NO: 11430 - DNA, 23 bp, Homo sapiens
tgcttctattctgttatcacagg

SEQ ID NO: 11431 - DNA, 23 bp, Homo sapiens
atgaatgttcagacggtctgagg

SEQ ID NO: 11432 - DNA, 23 bp, Homo sapiens
ctctcactgtggtcacttccagg

SEQ ID NO: 11433 - DNA, 23 bp, Homo sapiens
aagggtatcacagatgaagctgg

SEQ ID NO: 11434 - DNA, 23 bp, Homo sapiens
tcataatcaaacatgccagacgg

SEQ ID NO: 11435 - DNA, 23 bp, Homo sapiens
ttcgctttttatggctgctgtgg

SEQ ID NO: 11436 - DNA, 23 bp, Homo sapiens
aaccttgataacgtcatacgtgg

SEQ ID NO: 11437 - DNA, 23 bp, Homo sapiens
gtaaagtcagctaactctctcgg

SEQ ID NO: 11438 - DNA, 23 bp, Homo sapiens
gctcttttgggatgatcacatgg

SEQ ID NO: 11439 - DNA, 23 bp, Homo sapiens
tgtggccctgattgggaattagg

SEQ ID NO: 11440 - DNA, 23 bp, Homo sapiens
ggagggtgagctggttaagaagg

SEQ ID NO: 11441 - DNA, 23 bp, Homo sapiens
ggcctaacaaattcaaactcagg

SEQ ID NO: 11442 - DNA, 23 bp, Homo sapiens
tgagcagatgctggagaactagg

SEQ ID NO: 11443 - DNA, 23 bp, Homo sapiens
cagcccagtaccaacatatttgg

SEQ ID NO: 11444 - DNA, 23 bp, Homo sapiens
ttgcagattcagaagtgtgaagg

SEQ ID NO: 11445 - DNA, 23 bp, Homo sapiens
atgtctcccaattcattttgtgg

SEQ ID NO: 11446 - DNA, 23 bp, Homo sapiens
actgagtgagcaccacaaagtgg

SEQ ID NO: 11447 - DNA, 23 bp, Homo sapiens
agtgtctatggacgcccaccagg

SEQ ID NO: 11448 - DNA, 23 bp, Homo sapiens
ctgcattcattcaacagatgcgg

SEQ ID NO: 11449 - DNA, 23 bp, Homo sapiens
tccctgcagtcttggctaggcgg

SEQ ID NO: 11450 - DNA, 23 bp, Homo sapiens
atccagaggaccgtccgtgacgg

SEQ ID NO: 11451 - DNA, 23 bp, Homo sapiens
ggccattcaaagaagttcagtgg

SEQ ID NO: 11452 - DNA, 23 bp, Homo sapiens
tcttagtcacatgagcctcttgg

SEQ ID NO: 11453 - DNA, 23 bp, Homo sapiens
cagcagcagcctacgctaatagg

SEQ ID NO: 11454 - DNA, 23 bp, Homo sapiens
agctccatacggaacttaactgg

SEQ ID NO: 11455 - DNA, 23 bp, Homo sapiens
agcagcaggtgccggtggctggg

SEQ ID NO: 11456 - DNA, 23 bp, Homo sapiens
gcagtcactagctaccacacagg

SEQ ID NO: 11457 - DNA, 23 bp, Homo sapiens
atccactgatgctatgagtctgg

SEQ ID NO: 11458 - DNA, 23 bp, Homo sapiens
aggctgagtgggtcacgaattgg

SEQ ID NO: 11459 - DNA, 23 bp, Homo sapiens
ggaggctcaggcgtgctcagtgg

SEQ ID NO: 11460 - DNA, 23 bp, Homo sapiens
ctccacaagccatgaacagtggg

SEQ ID NO: 11461 - DNA, 23 bp, Homo sapiens
gtctggcttcactgagttactgg

SEQ ID NO: 11462 - DNA, 23 bp, Homo sapiens
tccagcacctcagtctaatcagg

SEQ ID NO: 11463 - DNA, 23 bp, Homo sapiens
agccattgctgcactctgagggg

SEQ ID NO: 11464 - DNA, 23 bp, Homo sapiens
ggattcagatgagatccatgagg

SEQ ID NO: 11465 - DNA, 23 bp, Homo sapiens
ttatgtctgcttggactgaccgg

SEQ ID NO: 11466 - DNA, 23 bp, Homo sapiens
aatgtcttcagactttccaatgg

SEQ ID NO: 11467 - DNA, 23 bp, Homo sapiens
gccagcgtgggggctactgccgg

SEQ ID NO: 11468 - DNA, 23 bp, Homo sapiens
cctctgccctttgctcacgttgg

SEQ ID NO: 11469 - DNA, 23 bp, Homo sapiens
cctgggggcactctgtgaagtgg

SEQ ID NO: 11470 - DNA, 23 bp, Homo sapiens
gttggtgggtggtgtgcaaaggg

SEQ ID NO: 11471 - DNA, 23 bp, Homo sapiens
taaatgccatgttggcaatgagg

SEQ ID NO: 11472 - DNA, 23 bp, Homo sapiens
ttgctgttgctgctctgccaagg

SEQ ID NO: 11473 - DNA, 23 bp, Homo sapiens
agactcactactactgcttgagg

SEQ ID NO: 11474 - DNA, 23 bp, Homo sapiens
ctaaaggcccccctgaaaaacgg

SEQ ID NO: 11475 - DNA, 23 bp, Homo sapiens
accagaaactgtaaaacctgagg

SEQ ID NO: 11476 - DNA, 23 bp, Homo sapiens
ctcatcaattaggacacacaagg

SEQ ID NO: 11477 - DNA, 23 bp, Homo sapiens
aaaatgcccacctgcagctctgg

SEQ ID NO: 11478 - DNA, 23 bp, Homo sapiens
ttgccagccacactcaccgctgg

SEQ ID NO: 11479 - DNA, 23 bp, Homo sapiens
gtcagcctcactctactccttgg

SEQ ID NO: 11480 - DNA, 23 bp, Homo sapiens
attaccatttccaagtgttctgg

SEQ ID NO: 11481 - DNA, 23 bp, Homo sapiens
atggacgcgtgggtgacctaagg

SEQ ID NO: 11482 - DNA, 23 bp, Homo sapiens
gccaccgggtgatctcctaccgg

SEQ ID NO: 11483 - DNA, 23 bp, Homo sapiens
catgcgactttctgaaggatggg

SEQ ID NO: 11484 - DNA, 23 bp, Homo sapiens
agaggatgcggcttgatacctgg

SEQ ID NO: 11485 - DNA, 23 bp, Homo sapiens
gcagtgttgggcattcagtcagg

SEQ ID NO: 11486 - DNA, 23 bp, Homo sapiens
gcctgagcgccaatcagctctgg

SEQ ID NO: 11487 - DNA, 23 bp, Homo sapiens
cctaagcaagaggacagtggtgg

SEQ ID NO: 11488 - DNA, 23 bp, Homo sapiens
cgctgcctccccggatggtcagg

SEQ ID NO: 11489 - DNA, 23 bp, Homo sapiens
caggacaagcaatcttaagaggg

SEQ ID NO: 11490 - DNA, 23 bp, Homo sapiens
tgcctctactagtgcctcgctgg

SEQ ID NO: 11491 - DNA, 23 bp, Homo sapiens
gagaaccctgggcatgtcagagg

SEQ ID NO: 11492 - DNA, 23 bp, Homo sapiens
agttatgtatgggcgtcgtcagg

SEQ ID NO: 11493 - DNA, 23 bp, Homo sapiens
ctgaggatcagtttctgatgtgg

SEQ ID NO: 11494 - DNA, 23 bp, Homo sapiens
aaggaaatgcatcagaaagttgg

SEQ ID NO: 11495 - DNA, 23 bp, Homo sapiens
tgtgaagaaacttcagagaaggg

SEQ ID NO: 11496 - DNA, 23 bp, Homo sapiens
tttttcacttgtctagttcctgg

SEQ ID NO: 11497 - DNA, 23 bp, Homo sapiens
gaggcaagcagaaacttgtctgg

SEQ ID NO: 11498 - DNA, 23 bp, Homo sapiens
gtttgtttgtttcacctctctgg

SEQ ID NO: 11499 - DNA, 23 bp, Homo sapiens
atatgggcatggaggggcagtgg

SEQ ID NO: 11500 - DNA, 23 bp, Homo sapiens
atatgggcatggatgggcaatgg

SEQ ID NO: 11501 - DNA, 23 bp, Homo sapiens
caatgttggcggacaggttatgg

SEQ ID NO: 11502 - DNA, 23 bp, Homo sapiens
gtttgaacttggaaggagaatgg

SEQ ID NO: 11503 - DNA, 23 bp, Homo sapiens
agacatcctatctagctgcaagg

SEQ ID NO: 11504 - DNA, 23 bp, Homo sapiens
gcaaagagtagggatatgttggg

SEQ ID NO: 11505 - DNA, 23 bp, Homo sapiens
ggcggggcggccgggctcagagg

SEQ ID NO: 11506 - DNA, 23 bp, Homo sapiens
ctgaggattcagagcttcagtgg

SEQ ID NO: 11507 - DNA, 23 bp, Homo sapiens
cgaagtccccagtagttcagagg

SEQ ID NO: 11508 - DNA, 23 bp, Homo sapiens
ccccaatgggcaggaccctgagg

SEQ ID NO: 11509 - DNA, 23 bp, Homo sapiens
gcagaatctcactctgaacttgg

SEQ ID NO: 11510 - DNA, 23 bp, Homo sapiens
agtgcgcatgctctgagctgtgg

SEQ ID NO: 11511 - DNA, 23 bp, Homo sapiens
cagcaggcaggtcacttccttgg

SEQ ID NO: 11512 - DNA, 23 bp, Homo sapiens
ccaggaagaaatatcgtgaaagg

SEQ ID NO: 11513 - DNA, 23 bp, Homo sapiens
ctgtttagggggccacttagtgg

SEQ ID NO: 11514 - DNA, 23 bp, Homo sapiens
ggcagttcaagtgagagcgatgg

SEQ ID NO: 11515 - DNA, 23 bp, Homo sapiens
ggctcagaagtcctgatgtgagg

SEQ ID NO: 11516 - DNA, 23 bp, Homo sapiens
aaaagagaagacctgtgatgggg

SEQ ID NO: 11517 - DNA, 23 bp, Homo sapiens
cctgaggagcccaagtgacaagg

SEQ ID NO: 11518 - DNA, 23 bp, Homo sapiens
cctgggcatcttctactaaatgg

SEQ ID NO: 11519 - DNA, 23 bp, Homo sapiens
ttcatcaactccttctgagctgg

SEQ ID NO: 11520 - DNA, 23 bp, Homo sapiens
gcactatgatgtctcccagaagg

SEQ ID NO: 11521 - DNA, 23 bp, Homo sapiens
ttacatcatgagaggaatgcagg

SEQ ID NO: 11522 - DNA, 23 bp, Homo sapiens
cccggcgacttgacagtgcacgg

SEQ ID NO: 11523 - DNA, 23 bp, Homo sapiens
aaactaccccatgaggcctgagg

SEQ ID NO: 11524 - DNA, 23 bp, Homo sapiens
tgtaaagaagttgtcagcagagg

SEQ ID NO: 11525 - DNA, 23 bp, Homo sapiens
cgaggtggcgctgcactgagggg

SEQ ID NO: 11526 - DNA, 23 bp, Homo sapiens
gaacccttgtgaggttggcacgg

SEQ ID NO: 11527 - DNA, 23 bp, Homo sapiens
agagtaagcagtcagtgaccagg

SEQ ID NO: 11528 - DNA, 23 bp, Homo sapiens
agaggcacacgctcaaacagtgg

SEQ ID NO: 11529 - DNA, 23 bp, Homo sapiens
gtgcagtgcgaacatccacacgg

SEQ ID NO: 11530 - DNA, 23 bp, Homo sapiens
aagtaggtgatgcccctgaacgg

SEQ ID NO: 11531 - DNA, 23 bp, Homo sapiens
cttgtcagatatgctcaagacgg

SEQ ID NO: 11532 - DNA, 23 bp, Homo sapiens
gtcttcaacaattatcgaggtgg

SEQ ID NO: 11533 - DNA, 23 bp, Homo sapiens
agtggcccaaactctttattagg

SEQ ID NO: 11534 - DNA, 23 bp, Homo sapiens
tcacaaatatgcgaagagcctgg

SEQ ID NO: 11535 - DNA, 23 bp, Homo sapiens
tttgatagctgctctaagcttgg

SEQ ID NO: 11536 - DNA, 23 bp, Homo sapiens
ctgcaacaagcctgaaaatttgg

SEQ ID NO: 11537 - DNA, 23 bp, Homo sapiens
acatcctcatcaactctcagagg

SEQ ID NO: 11538 - DNA, 23 bp, Homo sapiens
gatccctctgagagttgatgagg

SEQ ID NO: 11539 - DNA, 23 bp, Homo sapiens
cattattttggtgtaggtggagg

SEQ ID NO: 11540 - DNA, 23 bp, Homo sapiens
ggcatagtggctgccctgctggg

SEQ ID NO: 11541 - DNA, 23 bp, Homo sapiens
aacaaactttcacagactgaagg

SEQ ID NO: 11542 - DNA, 23 bp, Homo sapiens
ccagaaggaggacttataattgg

SEQ ID NO: 11543 - DNA, 23 bp, Homo sapiens
aaaagtttgactgatgactctgg

SEQ ID NO: 11544 - DNA, 23 bp, Homo sapiens
gaggcgatgggtcatgttactgg

SEQ ID NO: 11545 - DNA, 23 bp, Homo sapiens
gctggtcatttcctttgcaaagg

SEQ ID NO: 11546 - DNA, 23 bp, Homo sapiens
tgagttgggtgaatacaagatgg

SEQ ID NO: 11547 - DNA, 23 bp, Homo sapiens
gaaatcactgctgcttcttcagg

SEQ ID NO: 11548 - DNA, 23 bp, Homo sapiens
aaggaggggcttagtttttccgg

SEQ ID NO: 11549 - DNA, 23 bp, Homo sapiens
cgaaccctgcctccctaggccgg

SEQ ID NO: 11550 - DNA, 23 bp, Homo sapiens
tggatctcacttcctcaacctgg

SEQ ID NO: 11551 - DNA, 23 bp, Homo sapiens
tctgtccagcaccagctgagagg

SEQ ID NO: 11552 - DNA, 23 bp, Homo sapiens
tctgtccagcaccagctaagagg

SEQ ID NO: 11553 - DNA, 23 bp, Homo sapiens
ggtttagagatgataccatctgg

SEQ ID NO: 11554 - DNA, 23 bp, Homo sapiens
acagccaggttggactagttggg

SEQ ID NO: 11555 - DNA, 23 bp, Homo sapiens
tattttattgctgtggagtctgg

SEQ ID NO: 11556 - DNA, 23 bp, Homo sapiens
ttgtttgcggggcttttaaaagg

SEQ ID NO: 11557 - DNA, 23 bp, Homo sapiens
ggagtcactgacaccagagaagg

SEQ ID NO: 11558 - DNA, 23 bp, Homo sapiens
acctcagcctctgaagtagttgg

SEQ ID NO: 11559 - DNA, 23 bp, Homo sapiens
ctcatgaaaggtcaggacttagg

SEQ ID NO: 11560 - DNA, 23 bp, Homo sapiens
ggacacaggttatgaagaagtgg

SEQ ID NO: 11561 - DNA, 23 bp, Homo sapiens
ttggtgcgccctcatatctatgg

SEQ ID NO: 11562 - DNA, 23 bp, Homo sapiens
tgggccccacatcatgggaaagg

SEQ ID NO: 11563 - DNA, 23 bp, Homo sapiens
acaaagttcagtcttgtgaaagg

SEQ ID NO: 11564 - DNA, 23 bp, Homo sapiens
tctcttctattcatcctgacagg

SEQ ID NO: 11565 - DNA, 23 bp, Homo sapiens
cgacctccacgtgtttatactgg

SEQ ID NO: 11566 - DNA, 23 bp, Homo sapiens
acggggcttaggagaatattcgg

SEQ ID NO: 11567 - DNA, 23 bp, Homo sapiens
ccatccgcatcttttcttaaagg

SEQ ID NO: 11568 - DNA, 23 bp, Homo sapiens
ttgccagacagctgttactcagg

SEQ ID NO: 11569 - DNA, 23 bp, Homo sapiens
aggaaaagatatgaatggcctgg

SEQ ID NO: 11570 - DNA, 23 bp, Homo sapiens
ccttcaacgacagtattgagtgg

SEQ ID NO: 11571 - DNA, 23 bp, Homo sapiens
aagaagcggaaaactacctaggg

SEQ ID NO: 11572 - DNA, 23 bp, Homo sapiens
agctgtgggagctgctagggtgg

SEQ ID NO: 11573 - DNA, 23 bp, Homo sapiens
ttcagtccacctgatgatatagg

SEQ ID NO: 11574 - DNA, 23 bp, Homo sapiens
ttcggggttggtattagacatgg

SEQ ID NO: 11575 - DNA, 23 bp, Homo sapiens
gaaaatccgccgggcctgaaggg

SEQ ID NO: 11576 - DNA, 23 bp, Homo sapiens
tttcaatgatcacagaccattgg

SEQ ID NO: 11577 - DNA, 23 bp, Homo sapiens
agggctgatgttacctctagcgg

SEQ ID NO: 11578 - DNA, 23 bp, Homo sapiens
tggagctgctgggctgttagtgg

SEQ ID NO: 11579 - DNA, 23 bp, Homo sapiens
tccacagccacaaacgtcactgg

SEQ ID NO: 11580 - DNA, 23 bp, Homo sapiens
taggattcttcattgcttgaagg

SEQ ID NO: 11581 - DNA, 23 bp, Homo sapiens
cctgcagcccagcagatagtggg

SEQ ID NO: 11582 - DNA, 23 bp, Homo sapiens
cccagcagttcaggattcatcgg

SEQ ID NO: 11583 - DNA, 23 bp, Homo sapiens
tatttggtgaatcgtgcccaggg

SEQ ID NO: 11584 - DNA, 23 bp, Homo sapiens
ttacccggcacagacgctcaagg

SEQ ID NO: 11585 - DNA, 23 bp, Homo sapiens
gactaccgaagtatctgatctgg

SEQ ID NO: 11586 - DNA, 23 bp, Homo sapiens
aggctgtcaggagtcagggccgg

SEQ ID NO: 11587 - DNA, 23 bp, Homo sapiens
ccaaaccctggatgttaagatgg

SEQ ID NO: 11588 - DNA, 23 bp, Homo sapiens
gtcgtcacacatttgtgtcctgg

SEQ ID NO: 11589 - DNA, 23 bp, Homo sapiens
agctcagtgcactgattcccagg

SEQ ID NO: 11590 - DNA, 23 bp, Homo sapiens
ggcaacgtggcgggccctagagg

SEQ ID NO: 11591 - DNA, 23 bp, Homo sapiens
gccctcctaagctttaggccagg

SEQ ID NO: 11592 - DNA, 23 bp, Homo sapiens
cagccactcagctcagagaaagg

SEQ ID NO: 11593 - DNA, 23 bp, Homo sapiens
tcttcacccagttttacctctgg

SEQ ID NO: 11594 - DNA, 23 bp, Homo sapiens
tgccagaaaccaggacaaaaggg

SEQ ID NO: 11595 - DNA, 23 bp, Homo sapiens
ctggagtggggttacagctcagg

SEQ ID NO: 11596 - DNA, 23 bp, Homo sapiens
tggccgcgggaggacactgaggg

SEQ ID NO: 11597 - DNA, 23 bp, Homo sapiens
gaggaacactcagactgaaaggg

SEQ ID NO: 11598 - DNA, 23 bp, Homo sapiens
ctcagctacgtgatcacccacgg

SEQ ID NO: 11599 - DNA, 23 bp, Homo sapiens
tgtaagatatgggaggattcagg

SEQ ID NO: 11600 - DNA, 23 bp, Homo sapiens
agcgacactctagtggtgatggg

SEQ ID NO: 11601 - DNA, 23 bp, Homo sapiens
gggcctcaccaagttctgcaggg

SEQ ID NO: 11602 - DNA, 23 bp, Homo sapiens
caacaatgaccccacgacacagg

SEQ ID NO: 11603 - DNA, 23 bp, Homo sapiens
tggaacttgagtagcatttatgg

SEQ ID NO: 11604 - DNA, 23 bp, Homo sapiens
tctgaggctgcttcggctcaagg

SEQ ID NO: 11605 - DNA, 23 bp, Homo sapiens
ggcaggtgctaattccagctagg

SEQ ID NO: 11606 - DNA, 23 bp, Homo sapiens
tggagggtggggagatattaggg

SEQ ID NO: 11607 - DNA, 23 bp, Homo sapiens
ccggggcaaactggacgaggcgg

SEQ ID NO: 11608 - DNA, 23 bp, Homo sapiens
caggcaccattgctgttttaagg

SEQ ID NO: 11609 - DNA, 23 bp, Homo sapiens
tggtttctcagatgatcagttgg

SEQ ID NO: 11610 - DNA, 23 bp, Homo sapiens
tcagaagcccgcagcttagtcgg

SEQ ID NO: 11611 - DNA, 23 bp, Homo sapiens
tcaccaaaacacaaaaggaatgg

SEQ ID NO: 11612 - DNA, 23 bp, Homo sapiens
ccttctcttttccagcatgtggg

SEQ ID NO: 11613 - DNA, 23 bp, Homo sapiens
gctgagcaggtagctgctatagg

SEQ ID NO: 11614 - DNA, 23 bp, Homo sapiens
ggcggattcacagacagccctgg

SEQ ID NO: 11615 - DNA, 23 bp, Homo sapiens
acagtgtcaacaaatgtcacagg

SEQ ID NO: 11616 - DNA, 23 bp, Homo sapiens
accggccaatgcattcagggtgg

SEQ ID NO: 11617 - DNA, 23 bp, Homo sapiens
gctccctattctgaatattctgg

SEQ ID NO: 11618 - DNA, 23 bp, Homo sapiens
gtggcacctcatttttacactgg

SEQ ID NO: 11619 - DNA, 23 bp, Homo sapiens
ctactgcacatactcagtttcgg

SEQ ID NO: 11620 - DNA, 23 bp, Homo sapiens
tttcttccctcagtctcatttgg

SEQ ID NO: 11621 - DNA, 23 bp, Homo sapiens
gctcggccaggctctcagagtgg

SEQ ID NO: 11622 - DNA, 23 bp, Homo sapiens
gttggtatagacgagtaagccgg

SEQ ID NO: 11623 - DNA, 23 bp, Homo sapiens
aagaggcaagataaatgctcagg

SEQ ID NO: 11624 - DNA, 23 bp, Homo sapiens
actttcacaattgttgcacacgg

SEQ ID NO: 11625 - DNA, 23 bp, Homo sapiens
ttactctttccatggcttacagg

SEQ ID NO: 11626 - DNA, 23 bp, Homo sapiens
atattgccaagaaactgaggcgg

SEQ ID NO: 11627 - DNA, 23 bp, Homo sapiens
ggccgtcacctatacttctgggg

SEQ ID NO: 11628 - DNA, 23 bp, Homo sapiens
gttaaaagtggcttgggcagtgg

SEQ ID NO: 11629 - DNA, 23 bp, Homo sapiens
cagcggtaggctgagctcactgg

SEQ ID NO: 11630 - DNA, 23 bp, Homo sapiens
caatgcttcggcttcatttctgg

SEQ ID NO: 11631 - DNA, 23 bp, Homo sapiens
taccctgctaaatagtcagatgg

SEQ ID NO: 11632 - DNA, 23 bp, Homo sapiens
tattgtcaggtttcttgctgtgg

SEQ ID NO: 11633 - DNA, 23 bp, Homo sapiens
cactagccaggactgttcacagg

SEQ ID NO: 11634 - DNA, 23 bp, Homo sapiens
gtcgcaaggctattgaacgaagg

SEQ ID NO: 11635 - DNA, 23 bp, Homo sapiens
gcgcggctcacacgaagatctgg

SEQ ID NO: 11636 - DNA, 23 bp, Homo sapiens
gtttcttgctgacgaccacctgg

SEQ ID NO: 11637 - DNA, 23 bp, Homo sapiens
catgtttctgctgttgctgctgg

SEQ ID NO: 11638 - DNA, 23 bp, Homo sapiens
gggtccactggctccactgaggg

SEQ ID NO: 11639 - DNA, 23 bp, Homo sapiens
ggcccaccctcgtctagccctgg

SEQ ID NO: 11640 - DNA, 23 bp, Homo sapiens
ccagtcaagctccgctgacatgg

SEQ ID NO: 11641 - DNA, 23 bp, Homo sapiens
gaagtgtgtcagccaagaagtgg

SEQ ID NO: 11642 - DNA, 23 bp, Homo sapiens
tgattttcttgatcttcaggagg

SEQ ID NO: 11643 - DNA, 23 bp, Homo sapiens
catctgtgatcccagcactgtgg

SEQ ID NO: 11644 - DNA, 23 bp, Homo sapiens
caggctgtggcccagtgatgggg

SEQ ID NO: 11645 - DNA, 23 bp, Homo sapiens
tgggagctcaggaccagttaagg

SEQ ID NO: 11646 - DNA, 23 bp, Homo sapiens
cagctgagcaggacttgaggagg

SEQ ID NO: 11647 - DNA, 23 bp, Homo sapiens
gtgctgttagctcttgtctctgg

SEQ ID NO: 11648 - DNA, 23 bp, Homo sapiens
acggccctactggctactactgg

SEQ ID NO: 11649 - DNA, 23 bp, Homo sapiens
tagagtctaggtgccctcagtgg

SEQ ID NO: 11650 - DNA, 23 bp, Homo sapiens
tgcagtgtggggttactgtttgg

SEQ ID NO: 11651 - DNA, 23 bp, Homo sapiens
gtctggaaacaagctggaaaagg

SEQ ID NO: 11652 - DNA, 23 bp, Homo sapiens
tgctgtgaagttctttcttcagg

SEQ ID NO: 11653 - DNA, 23 bp, Homo sapiens
caactggagattaaccccattgg

SEQ ID NO: 11654 - DNA, 23 bp, Homo sapiens
acttcaaaggaagacaaggaagg

SEQ ID NO: 11655 - DNA, 23 bp, Homo sapiens
gctgctctgtgcagtccaaatgg

SEQ ID NO: 11656 - DNA, 23 bp, Homo sapiens
ccacgggcgccacgcctcagtgg

SEQ ID NO: 11657 - DNA, 23 bp, Homo sapiens
ctctcctgaaacttaatgacagg

SEQ ID NO: 11658 - DNA, 23 bp, Homo sapiens
gtcagagttcgtggtggcttagg

SEQ ID NO: 11659 - DNA, 23 bp, Homo sapiens
gaggtgctgctgcagacgtaggg

SEQ ID NO: 11660 - DNA, 23 bp, Homo sapiens
cagacaggccctgcttttctagg

SEQ ID NO: 11661 - DNA, 23 bp, Homo sapiens
cccgaggggctgctctaggtggg

SEQ ID NO: 11662 - DNA, 23 bp, Homo sapiens
ctcaagctgcgtcctgcgcacgg

SEQ ID NO: 11663 - DNA, 23 bp, Homo sapiens
ccagagtcctgtgcagtcacagg

SEQ ID NO: 11664 - DNA, 23 bp, Homo sapiens
tccactcctctagctcattgagg

SEQ ID NO: 11665 - DNA, 23 bp, Homo sapiens
ggcattggctcttgaactgatgg

SEQ ID NO: 11666 - DNA, 23 bp, Homo sapiens
tccaagaagcagtctcacatggg

SEQ ID NO: 11667 - DNA, 23 bp, Homo sapiens
tgatccatcagctgacatgctgg

SEQ ID NO: 11668 - DNA, 23 bp, Homo sapiens
gcccgcggccaggagtcagcagg

SEQ ID NO: 11669 - DNA, 23 bp, Homo sapiens
actcaggtcactcagagtgtagg

SEQ ID NO: 11670 - DNA, 23 bp, Homo sapiens
tccctgcggctcttaggcgaagg

SEQ ID NO: 11671 - DNA, 23 bp, Homo sapiens
ccctgatctggaggcctagtcgg

SEQ ID NO: 11672 - DNA, 23 bp, Homo sapiens
tgttatgtccactgggctactgg

SEQ ID NO: 11673 - DNA, 23 bp, Homo sapiens
ccctgggggagctgcagtagagg

SEQ ID NO: 11674 - DNA, 23 bp, Homo sapiens
gtcccacggcagaagccctgagg

SEQ ID NO: 11675 - DNA, 23 bp, Homo sapiens
gctctcttggtgccacctcctgg

SEQ ID NO: 11676 - DNA, 23 bp, Homo sapiens
atgcagtctgactcgtgcttcgg

SEQ ID NO: 11677 - DNA, 23 bp, Homo sapiens
gaatagtgaacgtaaacggaagg

SEQ ID NO: 11678 - DNA, 23 bp, Homo sapiens
tagtgaaggagagcgatctgtgg

SEQ ID NO: 11679 - DNA, 23 bp, Homo sapiens
tacccacatccaacggtcacagg

SEQ ID NO: 11680 - DNA, 23 bp, Homo sapiens
aggccaccatcaactggaatggg

SEQ ID NO: 11681 - DNA, 23 bp, Homo sapiens
tgcatcatgaactggtgacgggg

SEQ ID NO: 11682 - DNA, 23 bp, Homo sapiens
aatgcaggggttgggaatggagg

SEQ ID NO: 11683 - DNA, 23 bp, Homo sapiens
ccacaatcagctctgatgccagg

SEQ ID NO: 11684 - DNA, 23 bp, Homo sapiens
tggaaaatatgtcaaagagcagg

SEQ ID NO: 11685 - DNA, 23 bp, Homo sapiens
tgctaattcacattcttcactgg

SEQ ID NO: 11686 - DNA, 23 bp, Homo sapiens
ttgtaattgtacgctgttagggg

SEQ ID NO: 11687 - DNA, 23 bp, Homo sapiens
aggtggtaacattttatggctgg

SEQ ID NO: 11688 - DNA, 23 bp, Homo sapiens
ggcaggagggtcaccagctcagg

SEQ ID NO: 11689 - DNA, 23 bp, Homo sapiens
tattcagctggagcttctacagg

SEQ ID NO: 11690 - DNA, 23 bp, Homo sapiens
ggacttcgaaactttcctcatgg

SEQ ID NO: 11691 - DNA, 23 bp, Homo sapiens
caatcagatcactgtcctcatgg

SEQ ID NO: 11692 - DNA, 23 bp, Homo sapiens
tggctggagccactgctgaaggg

SEQ ID NO: 11693 - DNA, 23 bp, Homo sapiens
acagaacattagagacaatgtgg

SEQ ID NO: 11694 - DNA, 23 bp, Homo sapiens
tagagttcagcttttacaagtgg

SEQ ID NO: 11695 - DNA, 23 bp, Homo sapiens
ttaggagaaaactctggtattgg

SEQ ID NO: 11696 - DNA, 23 bp, Homo sapiens
ccgcatctacgccagtgaggagg

SEQ ID NO: 11697 - DNA, 23 bp, Homo sapiens
caggaggagcgcaaaccttgagg

SEQ ID NO: 11698 - DNA, 23 bp, Homo sapiens
tctactgttgtttcatgacatgg

SEQ ID NO: 11699 - DNA, 23 bp, Homo sapiens
tggatgattaagattggaagggg

SEQ ID NO: 11700 - DNA, 23 bp, Homo sapiens
cagtatgagcatggaagagacgg

SEQ ID NO: 11701 - DNA, 23 bp, Homo sapiens
gttaagcgtaagcatagccatgg

SEQ ID NO: 11702 - DNA, 23 bp, Homo sapiens
tctgcctttggtaacttttgagg

SEQ ID NO: 11703 - DNA, 23 bp, Homo sapiens
ttcactgtccctatgacttctgg

SEQ ID NO: 11704 - DNA, 23 bp, Homo sapiens
agagacagccaatttgattttgg

SEQ ID NO: 11705 - DNA, 23 bp, Homo sapiens
tgagccagagagctacaagcagg

SEQ ID NO: 11706 - DNA, 23 bp, Homo sapiens
gcctgggggagctcagcagaagg

SEQ ID NO: 11707 - DNA, 23 bp, Homo sapiens
aatctgtgacgttagtcccatgg

SEQ ID NO: 11708 - DNA, 23 bp, Homo sapiens
tcttcagttacagtgtgatgagg

SEQ ID NO: 11709 - DNA, 23 bp, Homo sapiens
cctgacgctcttcgcagctgagg

SEQ ID NO: 11710 - DNA, 23 bp, Homo sapiens
tggagcatttcagagtgctgtgg

SEQ ID NO: 11711 - DNA, 23 bp, Homo sapiens
ggagatgggagggtcaggcgtgg

SEQ ID NO: 11712 - DNA, 23 bp, Homo sapiens
tcttcactcattcacagtaacgg

SEQ ID NO: 11713 - DNA, 23 bp, Homo sapiens
ggacttgtttcatgatgagctgg

SEQ ID NO: 11714 - DNA, 23 bp, Homo sapiens
tcaagtgcattcgcaagtggagg

SEQ ID NO: 11715 - DNA, 23 bp, Homo sapiens
cttcatgcacctttctggagtgg

SEQ ID NO: 11716 - DNA, 23 bp, Homo sapiens
gcacaaccccctgagggcggcgg

SEQ ID NO: 11717 - DNA, 23 bp, Homo sapiens
ggacttgcttcattatgagctgg

SEQ ID NO: 11718 - DNA, 23 bp, Homo sapiens
cattgtgaatggaactctgctgg

SEQ ID NO: 11719 - DNA, 23 bp, Homo sapiens
ctctaatcagaaagacgaagagg

SEQ ID NO: 11720 - DNA, 23 bp, Homo sapiens
ctgctgtgagctaggagaccagg

SEQ ID NO: 11721 - DNA, 23 bp, Homo sapiens
tcttaaaactgctgcaccagcgg

SEQ ID NO: 11722 - DNA, 23 bp, Homo sapiens
gctggctcttaaggtgaataagg

SEQ ID NO: 11723 - DNA, 23 bp, Homo sapiens
tttccgcgtctgggggtcactgg

SEQ ID NO: 11724 - DNA, 23 bp, Homo sapiens
tagtcatttgttctcacaaccgg

SEQ ID NO: 11725 - DNA, 23 bp, Homo sapiens
ggggacaaactccacatcaaagg

SEQ ID NO: 11726 - DNA, 23 bp, Homo sapiens
cccgccgctatgactggtgaggg

SEQ ID NO: 11727 - DNA, 23 bp, Homo sapiens
agactttgtatagatcaggcagg

SEQ ID NO: 11728 - DNA, 23 bp, Homo sapiens
cagtgattctgttctcatggtgg

SEQ ID NO: 11729 - DNA, 23 bp, Homo sapiens
gaatcaagagcttcatgttcagg

SEQ ID NO: 11730 - DNA, 23 bp, Homo sapiens
tagggttcctcaatgatcagagg

SEQ ID NO: 11731 - DNA, 23 bp, Homo sapiens
tccctctgtgcggccctctgtgg

SEQ ID NO: 11732 - DNA, 23 bp, Homo sapiens
gcacgcggcccagggtcatgtgg

SEQ ID NO: 11733 - DNA, 23 bp, Homo sapiens
caacttttctcttgagctacagg

SEQ ID NO: 11734 - DNA, 23 bp, Homo sapiens
ggcgtttcaagaaggagaggtgg

SEQ ID NO: 11735 - DNA, 23 bp, Homo sapiens
tctgacttgcattatctccatgg

SEQ ID NO: 11736 - DNA, 23 bp, Homo sapiens
ttactggcgtgttccaaagatgg

SEQ ID NO: 11737 - DNA, 23 bp, Homo sapiens
gaaacatctggaacatcctgagg

SEQ ID NO: 11738 - DNA, 23 bp, Homo sapiens
gcctcagccaaccaggaaaaagg

SEQ ID NO: 11739 - DNA, 23 bp, Homo sapiens
tccccagcgtggccatcacttgg

SEQ ID NO: 11740 - DNA, 23 bp, Homo sapiens
agcgctaacgtgaagacgatggg

SEQ ID NO: 11741 - DNA, 23 bp, Homo sapiens
ggtggcccaccagtcctaacggg

SEQ ID NO: 11742 - DNA, 23 bp, Homo sapiens
gccttcaatgacagtgtgctggg

SEQ ID NO: 11743 - DNA, 23 bp, Homo sapiens
gaaaaaccagctttactgaccgg

SEQ ID NO: 11744 - DNA, 23 bp, Homo sapiens
accaggattggcaagagattggg

SEQ ID NO: 11745 - DNA, 23 bp, Homo sapiens
gggtctggccaggactataaagg

SEQ ID NO: 11746 - DNA, 23 bp, Homo sapiens
gcttgctgttcttttgaaactgg

SEQ ID NO: 11747 - DNA, 23 bp, Homo sapiens
aagaagtctgctgctagtcctgg

SEQ ID NO: 11748 - DNA, 23 bp, Homo sapiens
gacccatcggccgagtctgaggg

SEQ ID NO: 11749 - DNA, 23 bp, Homo sapiens
tccacatgggagaaaatcaaggg

SEQ ID NO: 11750 - DNA, 23 bp, Homo sapiens
ttcttcataatatggctgtctgg

SEQ ID NO: 11751 - DNA, 23 bp, Homo sapiens
gaagtcctacggactttatgcgg

SEQ ID NO: 11752 - DNA, 23 bp, Homo sapiens
caagtctgggtcacctcatttgg

SEQ ID NO: 11753 - DNA, 23 bp, Homo sapiens
gacttgtctaaagaggcagtagg

SEQ ID NO: 11754 - DNA, 23 bp, Homo sapiens
cttttgaagatcaccaaacccgg

SEQ ID NO: 11755 - DNA, 23 bp, Homo sapiens
agggccttggctaccacacgcgg

SEQ ID NO: 11756 - DNA, 23 bp, Homo sapiens
tgttagaggacaatgcatcttgg

SEQ ID NO: 11757 - DNA, 23 bp, Homo sapiens
ctaatagctggttcaactgcagg

SEQ ID NO: 11758 - DNA, 23 bp, Homo sapiens
taacagctggttacattgctagg

SEQ ID NO: 11759 - DNA, 23 bp, Homo sapiens
ggcatccaagccatggtcagagg

SEQ ID NO: 11760 - DNA, 23 bp, Homo sapiens
ctgaaaagcaatagctggtttgg

SEQ ID NO: 11761 - DNA, 23 bp, Homo sapiens
agacacttaacaccacaaaatgg

SEQ ID NO: 11762 - DNA, 23 bp, Homo sapiens
ccagcgttccctgctggacaagg

SEQ ID NO: 11763 - DNA, 23 bp, Homo sapiens
caagcgctcgctgcaggagtggg

SEQ ID NO: 11764 - DNA, 23 bp, Homo sapiens
taaacgctctatgcaagagtggg

SEQ ID NO: 11765 - DNA, 23 bp, Homo sapiens
gcgctgtgtgtcatagcgtcagg

SEQ ID NO: 11766 - DNA, 23 bp, Homo sapiens
gagcagtcagtattcaaacgtgg

SEQ ID NO: 11767 - DNA, 23 bp, Homo sapiens
tctactcgcctcgaacacaatgg

SEQ ID NO: 11768 - DNA, 23 bp, Homo sapiens
gactggctaggctgctgagctgg

SEQ ID NO: 11769 - DNA, 23 bp, Homo sapiens
ttctatttagcaaccaatccagg

SEQ ID NO: 11770 - DNA, 23 bp, Homo sapiens
acatgttcagtgtggagatatgg

SEQ ID NO: 11771 - DNA, 23 bp, Homo sapiens
tcctggcgagtccgtgtgcgggg

SEQ ID NO: 11772 - DNA, 23 bp, Homo sapiens
gggctgctcacacccattcctgg

SEQ ID NO: 11773 - DNA, 23 bp, Homo sapiens
ggtgtagcctcccgctgatgggg

SEQ ID NO: 11774 - DNA, 23 bp, Homo sapiens
caaaggatccagcatttgtatgg

SEQ ID NO: 11775 - DNA, 23 bp, Homo sapiens
aaggaaaaagcacattcaggagg

SEQ ID NO: 11776 - DNA, 23 bp, Homo sapiens
aagaaacgctttgcaaagcaagg

SEQ ID NO: 11777 - DNA, 23 bp, Homo sapiens
cggggagcgccctgttctgaagg

SEQ ID NO: 11778 - DNA, 23 bp, Homo sapiens
gcggcagtgtcattgaatgatgg

SEQ ID NO: 11779 - DNA, 23 bp, Homo sapiens
acactttgaagagtaacagctgg

SEQ ID NO: 11780 - DNA, 23 bp, Homo sapiens
atgtatccaacctatggaaatgg

SEQ ID NO: 11781 - DNA, 23 bp, Homo sapiens
gagttgcaagaggcaataaatgg

SEQ ID NO: 11782 - DNA, 23 bp, Homo sapiens
ctgcagtgccctgaggactaggg

SEQ ID NO: 11783 - DNA, 23 bp, Homo sapiens
ccccctgttactacatttagtgg

SEQ ID NO: 11784 - DNA, 23 bp, Homo sapiens
gggttcaggtcttaaacatcagg

SEQ ID NO: 11785 - DNA, 23 bp, Homo sapiens
ggactgagggctcagctgccagg

SEQ ID NO: 11786 - DNA, 23 bp, Homo sapiens
acaagatgagatgcagagactgg

SEQ ID NO: 11787 - DNA, 23 bp, Homo sapiens
caacagatttgggacattcgtgg

SEQ ID NO: 11788 - DNA, 23 bp, Homo sapiens
atgcattcagtgggcttttctgg

SEQ ID NO: 11789 - DNA, 23 bp, Homo sapiens
taaaattggccgatgtgaaacgg

SEQ ID NO: 11790 - DNA, 23 bp, Homo sapiens
tctatgtagtcaaagtcttctgg

SEQ ID NO: 11791 - DNA, 23 bp, Homo sapiens
aaggccaagaaaaacaaggaagg

SEQ ID NO: 11792 - DNA, 23 bp, Homo sapiens
atctgcttggtgaagagttcagg

SEQ ID NO: 11793 - DNA, 23 bp, Homo sapiens
agcacactcaagctggcttgagg

SEQ ID NO: 11794 - DNA, 23 bp, Homo sapiens
ctgggccgcggggctcctactgg

SEQ ID NO: 11795 - DNA, 23 bp, Homo sapiens
cttctccaggcaatattggaagg

SEQ ID NO: 11796 - DNA, 23 bp, Homo sapiens
tctgattgataggcgtgagctgg

SEQ ID NO: 11797 - DNA, 23 bp, Homo sapiens
tttggtgcagaacatttgattgg

SEQ ID NO: 11798 - DNA, 23 bp, Homo sapiens
ataacgtctcatcatccaactgg

SEQ ID NO: 11799 - DNA, 23 bp, Homo sapiens
ttttcaatcagttcttggagtgg

SEQ ID NO: 11800 - DNA, 23 bp, Homo sapiens
aacagatgaactaaggtaagcgg

SEQ ID NO: 11801 - DNA, 23 bp, Homo sapiens
gggctcatctctccttcacgtgg

SEQ ID NO: 11802 - DNA, 23 bp, Homo sapiens
gagacccgcggggctctcagtgg

SEQ ID NO: 11803 - DNA, 23 bp, Homo sapiens
gatgaacctcatagaccgcaagg

SEQ ID NO: 11804 - DNA, 23 bp, Homo sapiens
aagtccagacctgggctcagtgg

SEQ ID NO: 11805 - DNA, 23 bp, Homo sapiens
tggggaaagtgaagcatgaaggg

SEQ ID NO: 11806 - DNA, 23 bp, Homo sapiens
ccgtcaaagcttctaggttctgg

SEQ ID NO: 11807 - DNA, 23 bp, Homo sapiens
gagctcagcaacagcatgccagg

SEQ ID NO: 11808 - DNA, 23 bp, Homo sapiens
ggtcccccgtcaaagcttctagg

SEQ ID NO: 11809 - DNA, 23 bp, Homo sapiens
ttttttaggaggtaacatcctgg

SEQ ID NO: 11810 - DNA, 23 bp, Homo sapiens
ggcccatgatcctcatcggtggg

SEQ ID NO: 11811 - DNA, 23 bp, Homo sapiens
aggaaacaaagagtgcttttggg

SEQ ID NO: 11812 - DNA, 23 bp, Homo sapiens
ggaacatttccacagtactgagg

SEQ ID NO: 11813 - DNA, 23 bp, Homo sapiens
ggatggtctctgccatgaactgg

SEQ ID NO: 11814 - DNA, 23 bp, Homo sapiens
aagatgtgacatcactcagaagg

SEQ ID NO: 11815 - DNA, 23 bp, Homo sapiens
ctggaagccctctctggctaagg

SEQ ID NO: 11816 - DNA, 23 bp, Homo sapiens
aaaacaagagtctcgtgctctgg

SEQ ID NO: 11817 - DNA, 23 bp, Homo sapiens
ctcagcagaactccaagtgctgg

SEQ ID NO: 11818 - DNA, 23 bp, Homo sapiens
cacctgcctcaccttcatctagg

SEQ ID NO: 11819 - DNA, 23 bp, Homo sapiens
gggctcaggggctcagcgaaagg

SEQ ID NO: 11820 - DNA, 23 bp, Homo sapiens
catggctgaagactactgaaggg

SEQ ID NO: 11821 - DNA, 23 bp, Homo sapiens
cccaccatagtgcggaaaggcgg

SEQ ID NO: 11822 - DNA, 23 bp, Homo sapiens
cacgcccctcacctattgatggg

SEQ ID NO: 11823 - DNA, 23 bp, Homo sapiens
gcccataatggcttgttcactgg

SEQ ID NO: 11824 - DNA, 23 bp, Homo sapiens
aacaaggtttaaaagtagggtgg

SEQ ID NO: 11825 - DNA, 23 bp, Homo sapiens
tcaaaatggagaatcttgaccgg

SEQ ID NO: 11826 - DNA, 23 bp, Homo sapiens
aataagtgtcagtctgctccagg

SEQ ID NO: 11827 - DNA, 23 bp, Homo sapiens
tcatcaccaagggggactgaagg

SEQ ID NO: 11828 - DNA, 23 bp, Homo sapiens
acttgctgaagatcaagatcagg

SEQ ID NO: 11829 - DNA, 23 bp, Homo sapiens
gctggaggcaaatcacatactgg

SEQ ID NO: 11830 - DNA, 23 bp, Homo sapiens
atctcacgaagctccaagtgagg

SEQ ID NO: 11831 - DNA, 23 bp, Homo sapiens
ccatcggaaagctgtgtgagagg

SEQ ID NO: 11832 - DNA, 23 bp, Homo sapiens
agctgtctgtagacgctcacagg

SEQ ID NO: 11833 - DNA, 23 bp, Homo sapiens
gacacccctggtggcctgcttgg

SEQ ID NO: 11834 - DNA, 23 bp, Homo sapiens
gtggacacggggcctcaccgagg

SEQ ID NO: 11835 - DNA, 23 bp, Homo sapiens
tgaagctttaatttcaggtctgg

SEQ ID NO: 11836 - DNA, 23 bp, Homo sapiens
atgttcaggaagacagaggaagg

SEQ ID NO: 11837 - DNA, 23 bp, Homo sapiens
ctgtcaggcagtgagatttctgg

SEQ ID NO: 11838 - DNA, 23 bp, Homo sapiens
ccgtacctgtcgaaagggctagg

SEQ ID NO: 11839 - DNA, 23 bp, Homo sapiens
cttctataacccagtcacgaggg

SEQ ID NO: 11840 - DNA, 23 bp, Homo sapiens
acctctttgaaagctgaactcgg

SEQ ID NO: 11841 - DNA, 23 bp, Homo sapiens
ccttgctcatgttctaagtatgg

SEQ ID NO: 11842 - DNA, 23 bp, Homo sapiens
actgtgcacagtacttagggtgg

SEQ ID NO: 11843 - DNA, 23 bp, Homo sapiens
agcaagcaagagcattgttaagg

SEQ ID NO: 11844 - DNA, 23 bp, Homo sapiens
ttgagcacggagctcaggtccgg

SEQ ID NO: 11845 - DNA, 23 bp, Homo sapiens
tgcaagtggagccagagtggagg

SEQ ID NO: 11846 - DNA, 23 bp, Homo sapiens
gtcagccactgcagatcagctgg

SEQ ID NO: 11847 - DNA, 23 bp, Homo sapiens
ggagcccagctgatctgcagtgg

SEQ ID NO: 11848 - DNA, 23 bp, Homo sapiens
gcgtgcagctgagtagcagaagg

SEQ ID NO: 11849 - DNA, 23 bp, Homo sapiens
cccagctcatccagggagggcgg

SEQ ID NO: 11850 - DNA, 23 bp, Homo sapiens
ttcttaagaagcttgtttcgggg

SEQ ID NO: 11851 - DNA, 23 bp, Homo sapiens
cctctcagctttttcgtatttgg

SEQ ID NO: 11852 - DNA, 23 bp, Homo sapiens
acaaaggtcccagccatcagggg

SEQ ID NO: 11853 - DNA, 23 bp, Homo sapiens
gcctccccacaagcagaaaaagg

SEQ ID NO: 11854 - DNA, 23 bp, Homo sapiens
ttgatggttctctcttgaattgg

SEQ ID NO: 11855 - DNA, 23 bp, Homo sapiens
tttcggggagagatttaagctgg

SEQ ID NO: 11856 - DNA, 23 bp, Homo sapiens
agtggctgagcaggacacacagg

SEQ ID NO: 11857 - DNA, 23 bp, Homo sapiens
gaatgcttgagaggactttaagg

SEQ ID NO: 11858 - DNA, 23 bp, Homo sapiens
ttaaagccccaggattaagatgg

SEQ ID NO: 11859 - DNA, 23 bp, Homo sapiens
gacagaagcaccctctgccaagg

SEQ ID NO: 11860 - DNA, 23 bp, Homo sapiens
ttgcagaggtgcgcaaaacatgg

SEQ ID NO: 11861 - DNA, 23 bp, Homo sapiens
gtgcctgctgtctgctgtaaagg

SEQ ID NO: 11862 - DNA, 23 bp, Homo sapiens
ttgtattcagtgacagagccagg

SEQ ID NO: 11863 - DNA, 23 bp, Homo sapiens
aagggcatggggatgggaagggg

SEQ ID NO: 11864 - DNA, 23 bp, Homo sapiens
tagatggtggaggcatcagcagg

SEQ ID NO: 11865 - DNA, 23 bp, Homo sapiens
tctatgcagttgtagtttgaagg

SEQ ID NO: 11866 - DNA, 23 bp, Homo sapiens
agctattggcagcagccttgagg

SEQ ID NO: 11867 - DNA, 23 bp, Homo sapiens
agcaatactcaaacattcacagg

SEQ ID NO: 11868 - DNA, 23 bp, Homo sapiens
tgtgcggcgtcctcaagcagggg

SEQ ID NO: 11869 - DNA, 23 bp, Homo sapiens
ccccttacctggcctctaggagg

SEQ ID NO: 11870 - DNA, 23 bp, Homo sapiens
tctacaagcttagtaaacccagg

SEQ ID NO: 11871 - DNA, 23 bp, Homo sapiens
ccagtgggtgcctgtcagctggg

SEQ ID NO: 11872 - DNA, 23 bp, Homo sapiens
gggtacctgttagttgggtcagg

SEQ ID NO: 11873 - DNA, 23 bp, Homo sapiens
tcattgagactcagtatctgagg

SEQ ID NO: 11874 - DNA, 23 bp, Homo sapiens
gggtaccatccacttggctgagg

SEQ ID NO: 11875 - DNA, 23 bp, Homo sapiens
acagtgggtcccaatcagctggg

SEQ ID NO: 11876 - DNA, 23 bp, Homo sapiens
cccattgggtgccagtgagctgg

SEQ ID NO: 11877 - DNA, 23 bp, Homo sapiens
ctttctggtttgaacttgctcgg

SEQ ID NO: 11878 - DNA, 23 bp, Homo sapiens
tggggagcagtcaggagttccgg

SEQ ID NO: 11879 - DNA, 23 bp, Homo sapiens
tgagcatctccaaggcactgagg

SEQ ID NO: 11880 - DNA, 23 bp, Homo sapiens
ttagagcttcaggaaccctgtgg

SEQ ID NO: 11881 - DNA, 23 bp, Homo sapiens
cagggacttgaagaaagactagg

SEQ ID NO: 11882 - DNA, 23 bp, Homo sapiens
cgtaattgagcaggtctcgtggg

SEQ ID NO: 11883 - DNA, 23 bp, Homo sapiens
tgtgtcctgcccagcttcagtgg

SEQ ID NO: 11884 - DNA, 23 bp, Homo sapiens
acctgtcctggaaggcacatcgg

SEQ ID NO: 11885 - DNA, 23 bp, Homo sapiens
tccttgacttctcatttcttcgg

SEQ ID NO: 11886 - DNA, 23 bp, Homo sapiens
ttttcccagcagagtggtgacgg

SEQ ID NO: 11887 - DNA, 23 bp, Homo sapiens
agcagacagttcagtctgctcgg

SEQ ID NO: 11888 - DNA, 23 bp, Homo sapiens
ctcgcaaggataagaaatagcgg

SEQ ID NO: 11889 - DNA, 23 bp, Homo sapiens
tctgtatgggagcactcaaaagg

SEQ ID NO: 11890 - DNA, 23 bp, Homo sapiens
gtcagagtctgtggtgtatgcgg

SEQ ID NO: 11891 - DNA, 23 bp, Homo sapiens
tctaactgtgcatatatgactgg

SEQ ID NO: 11892 - DNA, 23 bp, Homo sapiens
aaggctcaaccaagagaaaaagg

SEQ ID NO: 11893 - DNA, 23 bp, Homo sapiens
tctcttcatagtctgaatccagg

SEQ ID NO: 11894 - DNA, 23 bp, Homo sapiens
gggatctgcaatcatcgatctgg

SEQ ID NO: 11895 - DNA, 23 bp, Homo sapiens
acatcagctctgcaattgagagg

SEQ ID NO: 11896 - DNA, 23 bp, Homo sapiens
gaggaaggggcggcctgacgagg

SEQ ID NO: 11897 - DNA, 23 bp, Homo sapiens
cagagcatgtttctcaatccagg

SEQ ID NO: 11898 - DNA, 23 bp, Homo sapiens
gcaatgtgtgatcttgtgacagg

SEQ ID NO: 11899 - DNA, 23 bp, Homo sapiens
agtgatatgaaagatctcgtggg

SEQ ID NO: 11900 - DNA, 23 bp, Homo sapiens
gaacatcctggtgtcagacatgg

SEQ ID NO: 11901 - DNA, 23 bp, Homo sapiens
ccagagtcaagtatcgaaagggg

SEQ ID NO: 11902 - DNA, 23 bp, Homo sapiens
ttccgtttccaagtccctaaagg

SEQ ID NO: 11903 - DNA, 23 bp, Homo sapiens
ccaaacacagggtaaaacagggg

SEQ ID NO: 11904 - DNA, 23 bp, Homo sapiens
actcgctcttctctatccgccgg

SEQ ID NO: 11905 - DNA, 23 bp, Homo sapiens
agagaagcgagtcttcttgaagg

SEQ ID NO: 11906 - DNA, 23 bp, Homo sapiens
cagggctgagggtctacgtgcgg

SEQ ID NO: 11907 - DNA, 23 bp, Homo sapiens
cgtgggcaccaatgagatggggg

SEQ ID NO: 11908 - DNA, 23 bp, Homo sapiens
ctcaggctgctatgtccaccagg

SEQ ID NO: 11909 - DNA, 23 bp, Homo sapiens
ccaggcgctggagtctcaggagg

SEQ ID NO: 11910 - DNA, 23 bp, Homo sapiens
aggggacagtccctgcccatggg

SEQ ID NO: 11911 - DNA, 23 bp, Homo sapiens
ggagatgtcgagaagcagtctgg

SEQ ID NO: 11912 - DNA, 23 bp, Homo sapiens
ggaagcagattggagcagtgagg

SEQ ID NO: 11913 - DNA, 23 bp, Homo sapiens
gaagcagattggggccatgaggg

SEQ ID NO: 11914 - DNA, 23 bp, Homo sapiens
agagctgagttggttacatctgg

SEQ ID NO: 11915 - DNA, 23 bp, Homo sapiens
tcctgtaatcccagctactcagg

SEQ ID NO: 11916 - DNA, 23 bp, Homo sapiens
tggatatgactggtaaaaactgg

SEQ ID NO: 11917 - DNA, 23 bp, Homo sapiens
aggcaaaatgagggctgacgtgg

SEQ ID NO: 11918 - DNA, 23 bp, Homo sapiens
aagggcactgtgaagcagtgagg

SEQ ID NO: 11919 - DNA, 23 bp, Homo sapiens
agtcacttctgcgtcctcagtgg

SEQ ID NO: 11920 - DNA, 23 bp, Homo sapiens
ttcgatgatgatgtgtgatctgg

SEQ ID NO: 11921 - DNA, 23 bp, Homo sapiens
tatttgcgtagaagaactgcagg

SEQ ID NO: 11922 - DNA, 23 bp, Homo sapiens
cgcctggtgaagctcgcctaagg

SEQ ID NO: 11923 - DNA, 23 bp, Homo sapiens
ggtgactcaagcaacagacgcgg

SEQ ID NO: 11924 - DNA, 23 bp, Homo sapiens
accccaaggaatgtcctaggtgg

SEQ ID NO: 11925 - DNA, 23 bp, Homo sapiens
tatttcttgatggcttacagagg

SEQ ID NO: 11926 - DNA, 23 bp, Homo sapiens
gatggctggaggtcactgcttgg

SEQ ID NO: 11927 - DNA, 23 bp, Homo sapiens
tccggaccccgccgagcctgagg

SEQ ID NO: 11928 - DNA, 23 bp, Homo sapiens
tcagggacgtcacttcttcaagg

SEQ ID NO: 11929 - DNA, 23 bp, Homo sapiens
attagaggggcaaagctcaaggg

SEQ ID NO: 11930 - DNA, 23 bp, Homo sapiens
tgccttgtgtttctaggcagagg

SEQ ID NO: 11931 - DNA, 23 bp, Homo sapiens
gtatctctccctctgaatgttgg

SEQ ID NO: 11932 - DNA, 23 bp, Homo sapiens
ttgacatctttactgtctgtagg

SEQ ID NO: 11933 - DNA, 23 bp, Homo sapiens
cttcgtagttcaacaagtgaagg

SEQ ID NO: 11934 - DNA, 23 bp, Homo sapiens
aaacaggctggctacgagtccgg

SEQ ID NO: 11935 - DNA, 23 bp, Homo sapiens
gtggggcaagggtcacttcttgg

SEQ ID NO: 11936 - DNA, 23 bp, Homo sapiens
gggagaagttcagtgtgacctgg

SEQ ID NO: 11937 - DNA, 23 bp, Homo sapiens
ggtgggcggcaccgtggttctgg

SEQ ID NO: 11938 - DNA, 23 bp, Homo sapiens
tcttatagccgataatcttcagg

SEQ ID NO: 11939 - DNA, 23 bp, Homo sapiens
tcacacaaagttctgagcaatgg

SEQ ID NO: 11940 - DNA, 23 bp, Homo sapiens
tccttggacgggaattcatgagg

SEQ ID NO: 11941 - DNA, 23 bp, Homo sapiens
ctacactcactacacacgtttgg

SEQ ID NO: 11942 - DNA, 23 bp, Homo sapiens
tcaaacaccagggatttaactgg

SEQ ID NO: 11943 - DNA, 23 bp, Homo sapiens
agaaggtggtgtggttctacggg

SEQ ID NO: 11944 - DNA, 23 bp, Homo sapiens
aggaaattgaagcgtcgaaaagg

SEQ ID NO: 11945 - DNA, 23 bp, Homo sapiens
gagtacagggatatcagctttgg

SEQ ID NO: 11946 - DNA, 23 bp, Homo sapiens
ccgtttgttatgatcaacgttgg

SEQ ID NO: 11947 - DNA, 23 bp, Homo sapiens
aatacagcaacagtcctcagtgg

SEQ ID NO: 11948 - DNA, 23 bp, Homo sapiens
ttggcttaaagggttaccctagg

SEQ ID NO: 11949 - DNA, 23 bp, Homo sapiens
ctcggtaatcacaacaaacacgg

SEQ ID NO: 11950 - DNA, 23 bp, Homo sapiens
atcgttcacactctatgatgagg

SEQ ID NO: 11951 - DNA, 23 bp, Homo sapiens
agctggttcgggctgtgacgggg

SEQ ID NO: 11952 - DNA, 23 bp, Homo sapiens
ggagacccggaaatacaagaagg

SEQ ID NO: 11953 - DNA, 23 bp, Homo sapiens
gcctgagggcaccttcaaactgg

SEQ ID NO: 11954 - DNA, 23 bp, Homo sapiens
tggaggagctgtgtggtcactgg

SEQ ID NO: 11955 - DNA, 23 bp, Homo sapiens
aaatgtaatagaaggcgcaccgg

SEQ ID NO: 11956 - DNA, 23 bp, Homo sapiens
tcatgtgctttctgctccacagg

SEQ ID NO: 11957 - DNA, 23 bp, Homo sapiens
aacatctttggtgtcaattctgg

SEQ ID NO: 11958 - DNA, 23 bp, Homo sapiens
gaaacaaagagtcctcttcgtgg

SEQ ID NO: 11959 - DNA, 23 bp, Homo sapiens
taaagagaagactgagggcgggg

SEQ ID NO: 11960 - DNA, 23 bp, Homo sapiens
gactgcgtcgcgatcctcaatgg

SEQ ID NO: 11961 - DNA, 23 bp, Homo sapiens
ccttctggaagaggcgaaactgg

SEQ ID NO: 11962 - DNA, 23 bp, Homo sapiens
tgacgacgtccttctggaagagg

SEQ ID NO: 11963 - DNA, 23 bp, Homo sapiens
atctgtctctgcttgtgcctcgg

SEQ ID NO: 11964 - DNA, 23 bp, Homo sapiens
caaaatgcaaggtgacttcttgg

SEQ ID NO: 11965 - DNA, 23 bp, Homo sapiens
tttgcatggtgctgcgtgagcgg

SEQ ID NO: 11966 - DNA, 23 bp, Homo sapiens
cccacctatggcatctactaagg

SEQ ID NO: 11967 - DNA, 23 bp, Homo sapiens
actctgagactgttccatggagg

SEQ ID NO: 11968 - DNA, 23 bp, Homo sapiens
agatcaaagtaaagcaacagagg

SEQ ID NO: 11969 - DNA, 23 bp, Homo sapiens
aaccgctgtgattctaacagcgg

SEQ ID NO: 11970 - DNA, 23 bp, Homo sapiens
gaggtgcttcacatcaacagtgg

SEQ ID NO: 11971 - DNA, 23 bp, Homo sapiens
caccaaggtgtacacacaagtgg

SEQ ID NO: 11972 - DNA, 23 bp, Homo sapiens
aggaacttcctgcgctagctggg

SEQ ID NO: 11973 - DNA, 23 bp, Homo sapiens
cctccaaaagacagatgatgcgg

SEQ ID NO: 11974 - DNA, 23 bp, Homo sapiens
tggagcttatagccaagtagtgg

SEQ ID NO: 11975 - DNA, 23 bp, Homo sapiens
tggatgacaagggttcaggacgg

SEQ ID NO: 11976 - DNA, 23 bp, Homo sapiens
aggtcactgcccccagaagcagg

SEQ ID NO: 11977 - DNA, 23 bp, Homo sapiens
ccactgtgtgctcagcgtgaagg

SEQ ID NO: 11978 - DNA, 23 bp, Homo sapiens
ctcttcactgtgcttgcacctgg

SEQ ID NO: 11979 - DNA, 23 bp, Homo sapiens
ctgcatccatggcggctagctgg

SEQ ID NO: 11980 - DNA, 23 bp, Homo sapiens
ttttgtcatcaggctagctgagg

SEQ ID NO: 11981 - DNA, 23 bp, Homo sapiens
caggcagctcggcccatcagagg

SEQ ID NO: 11982 - DNA, 23 bp, Homo sapiens
ttttgggcttcagcaagatgtgg

SEQ ID NO: 11983 - DNA, 23 bp, Homo sapiens
ctacagtagctacttcaacttgg

SEQ ID NO: 11984 - DNA, 23 bp, Homo sapiens
ctcttggagaaaggcttctgagg

SEQ ID NO: 11985 - DNA, 23 bp, Homo sapiens
cccccaatttgaaaatcacttgg

SEQ ID NO: 11986 - DNA, 23 bp, Homo sapiens
tctatcgaaacttcccatgtcgg

SEQ ID NO: 11987 - DNA, 23 bp, Homo sapiens
gcaggaagaacaaaggaagcagg

SEQ ID NO: 11988 - DNA, 23 bp, Homo sapiens
gctcttcagtgaagcccctttgg

SEQ ID NO: 11989 - DNA, 23 bp, Homo sapiens
gacaagccgggcgctgatactgg

SEQ ID NO: 11990 - DNA, 23 bp, Homo sapiens
aagaacaagaggttgtagcatgg

SEQ ID NO: 11991 - DNA, 23 bp, Homo sapiens
ctggagccacggtcacttcttgg

SEQ ID NO: 11992 - DNA, 23 bp, Homo sapiens
tggtccgcaatgaatctatgcgg

SEQ ID NO: 11993 - DNA, 23 bp, Homo sapiens
gacaagcaggagggtcgacatgg

SEQ ID NO: 11994 - DNA, 23 bp, Homo sapiens
gagaggactttcacaccataagg

SEQ ID NO: 11995 - DNA, 23 bp, Homo sapiens
agggagagtagatttagatctgg

SEQ ID NO: 11996 - DNA, 23 bp, Homo sapiens
tctgatagtgtttcccagattgg

SEQ ID NO: 11997 - DNA, 23 bp, Homo sapiens
atgaaaatcccttctcatagcgg

SEQ ID NO: 11998 - DNA, 23 bp, Homo sapiens
ctcccagccacaccaagttcagg

SEQ ID NO: 11999 - DNA, 23 bp, Homo sapiens
gaaggctcggaagctgtgatggg

SEQ ID NO: 12000 - DNA, 23 bp, Homo sapiens
gccacgtgcagaagaagtgacgg

SEQ ID NO: 12001 - DNA, 23 bp, Homo sapiens
ctgggatccagcgagcgacatgg

SEQ ID NO: 12002 - DNA, 23 bp, Homo sapiens
tggctgtctttgagtgtctttgg

SEQ ID NO: 12003 - DNA, 23 bp, Homo sapiens
tgcagaagctacagatacagagg

SEQ ID NO: 12004 - DNA, 23 bp, Homo sapiens
atctcttcagcacagtgaagcgg

SEQ ID NO: 12005 - DNA, 23 bp, Homo sapiens
gtgaagatggcccaccgagcagg

SEQ ID NO: 12006 - DNA, 23 bp, Homo sapiens
tgtcagtgatacagcttccaagg

SEQ ID NO: 12007 - DNA, 23 bp, Homo sapiens
aggccctcagagtgctctgtagg

SEQ ID NO: 12008 - DNA, 23 bp, Homo sapiens
acaacaggtatccagcaatgagg

SEQ ID NO: 12009 - DNA, 23 bp, Homo sapiens
caaggatcctgcatatctcaagg

SEQ ID NO: 12010 - DNA, 23 bp, Homo sapiens
tgtttcttcccacaaagaccagg

SEQ ID NO: 12011 - DNA, 23 bp, Homo sapiens
gggaggagagtgaacatcacagg

SEQ ID NO: 12012 - DNA, 23 bp, Homo sapiens
gatccgtggcagggctgctgagg

SEQ ID NO: 12013 - DNA, 23 bp, Homo sapiens
atttttaggaagctgcagaatgg

SEQ ID NO: 12014 - DNA, 23 bp, Homo sapiens
aaggtctcttgcctccctgaagg

SEQ ID NO: 12015 - DNA, 23 bp, Homo sapiens
aaagccgatgcccaggactaagg

SEQ ID NO: 12016 - DNA, 23 bp, Homo sapiens
cacaacgcagggactcctagggg

SEQ ID NO: 12017 - DNA, 23 bp, Homo sapiens
gcaaaggcatctgcctaataggg

SEQ ID NO: 12018 - DNA, 23 bp, Homo sapiens
atcttgagtctttactctcctgg

SEQ ID NO: 12019 - DNA, 23 bp, Homo sapiens
agaagaaaaatcacagctgttgg

SEQ ID NO: 12020 - DNA, 23 bp, Homo sapiens
agaaggttgaacacatagagtgg

SEQ ID NO: 12021 - DNA, 23 bp, Homo sapiens
aagggaaaagagcagcaaaaagg

SEQ ID NO: 12022 - DNA, 23 bp, Homo sapiens
gctggttctggcattctagacgg

SEQ ID NO: 12023 - DNA, 23 bp, Homo sapiens
tcgtaattctgcctccttaaagg

SEQ ID NO: 12024 - DNA, 23 bp, Homo sapiens
ttttctcagcagctttcatctgg

SEQ ID NO: 12025 - DNA, 23 bp, Homo sapiens
agcagccaccatggttattcagg

SEQ ID NO: 12026 - DNA, 23 bp, Homo sapiens
acaaggccagagaggttacgtgg

SEQ ID NO: 12027 - DNA, 23 bp, Homo sapiens
tcacttcttcctcttctttgtgg

SEQ ID NO: 12028 - DNA, 23 bp, Homo sapiens
cctggagactctaccaccagcgg

SEQ ID NO: 12029 - DNA, 23 bp, Homo sapiens
ttacgtggaagaaacgctaaggg

SEQ ID NO: 12030 - DNA, 23 bp, Homo sapiens
cagtctcagaggacaccattagg

SEQ ID NO: 12031 - DNA, 23 bp, Homo sapiens
ccccagtggactttcatccaagg

SEQ ID NO: 12032 - DNA, 23 bp, Homo sapiens
ggcagaactggacaggcatctgg

SEQ ID NO: 12033 - DNA, 23 bp, Homo sapiens
atccacggggctgttcctaacgg

SEQ ID NO: 12034 - DNA, 23 bp, Homo sapiens
cattgcctcctatggtatgaagg

SEQ ID NO: 12035 - DNA, 23 bp, Homo sapiens
tcagaagatgatgactgaaaggg

SEQ ID NO: 12036 - DNA, 23 bp, Homo sapiens
tgagcagcctacagagcagtagg

SEQ ID NO: 12037 - DNA, 23 bp, Homo sapiens
ggagagctgtcattttctattgg

SEQ ID NO: 12038 - DNA, 23 bp, Homo sapiens
tggctcttcagtttgcagtctgg

SEQ ID NO: 12039 - DNA, 23 bp, Homo sapiens
agctgagtagttgttgcatctgg

SEQ ID NO: 12040 - DNA, 23 bp, Homo sapiens
tgatcttacatctgttactgagg

SEQ ID NO: 12041 - DNA, 23 bp, Homo sapiens
cagccctgagttatccagtcagg

SEQ ID NO: 12042 - DNA, 23 bp, Homo sapiens
ctgctactcagacgactccttgg

SEQ ID NO: 12043 - DNA, 23 bp, Homo sapiens
gacaagccatctcatctaccagg

SEQ ID NO: 12044 - DNA, 23 bp, Homo sapiens
tgtgcaaatcagctatttcttgg

SEQ ID NO: 12045 - DNA, 23 bp, Homo sapiens
atgggaggagacatttcccctgg

SEQ ID NO: 12046 - DNA, 23 bp, Homo sapiens
cttgattacacagaattgggagg

SEQ ID NO: 12047 - DNA, 23 bp, Homo sapiens
acaccacttaatgaggtttgagg

SEQ ID NO: 12048 - DNA, 23 bp, Homo sapiens
tcagaagatgggcggccgggcgg

SEQ ID NO: 12049 - DNA, 23 bp, Homo sapiens
cacaatcacaatcctctgagtgg

SEQ ID NO: 12050 - DNA, 23 bp, Homo sapiens
taggcaaggttaagtgaagccgg

SEQ ID NO: 12051 - DNA, 23 bp, Homo sapiens
tcaaaaatgactcatgactgtgg

SEQ ID NO: 12052 - DNA, 23 bp, Homo sapiens
tgctgtgctgcggtggaaacagg

SEQ ID NO: 12053 - DNA, 23 bp, Homo sapiens
tgctcactgctgtgctgcagtgg

SEQ ID NO: 12054 - DNA, 23 bp, Homo sapiens
aaaagagttcttcacggtcttgg

SEQ ID NO: 12055 - DNA, 23 bp, Homo sapiens
tgtagccttacttatttgcttgg

SEQ ID NO: 12056 - DNA, 23 bp, Homo sapiens
catcaccaagtccagcgtctagg

SEQ ID NO: 12057 - DNA, 23 bp, Homo sapiens
gagtgcctggaaaaagccattgg

SEQ ID NO: 12058 - DNA, 23 bp, Homo sapiens
catcctttctgggacttggtagg

SEQ ID NO: 12059 - DNA, 23 bp, Homo sapiens
cccaaagtcttagggcgaattgg

SEQ ID NO: 12060 - DNA, 23 bp, Homo sapiens
agacttcgaattcagaaagaagg

SEQ ID NO: 12061 - DNA, 23 bp, Homo sapiens
tgtggaaccaccgcttaaatcgg

SEQ ID NO: 12062 - DNA, 23 bp, Homo sapiens
gggctctgggctctctgccgcgg

SEQ ID NO: 12063 - DNA, 23 bp, Homo sapiens
aaagggcatttgtttcaccttgg

SEQ ID NO: 12064 - DNA, 23 bp, Homo sapiens
gtggacagaggagttcaacatgg

SEQ ID NO: 12065 - DNA, 23 bp, Homo sapiens
ttctggaacttgttcagtcctgg

SEQ ID NO: 12066 - DNA, 23 bp, Homo sapiens
gacactggaaggactctcagagg

SEQ ID NO: 12067 - DNA, 23 bp, Homo sapiens
aagtttgcctggctagtgaaagg

SEQ ID NO: 12068 - DNA, 23 bp, Homo sapiens
gccaccgtcccctgcttcagtgg

SEQ ID NO: 12069 - DNA, 23 bp, Homo sapiens
gggaactgatagccatagcttgg

SEQ ID NO: 12070 - DNA, 23 bp, Homo sapiens
acaaatggataccattgagcagg

SEQ ID NO: 12071 - DNA, 23 bp, Homo sapiens
aaacacctcaccggacgtgtagg

SEQ ID NO: 12072 - DNA, 23 bp, Homo sapiens
gcagctaaaaacgtcgttactgg

SEQ ID NO: 12073 - DNA, 23 bp, Homo sapiens
tgtaacctcagcaccatgcctgg

SEQ ID NO: 12074 - DNA, 23 bp, Homo sapiens
ttacagcaccaagaacccccggg

SEQ ID NO: 12075 - DNA, 23 bp, Homo sapiens
tagcctccaccctggcctgaggg

SEQ ID NO: 12076 - DNA, 23 bp, Homo sapiens
agacctgttctgtcagtgaatgg

SEQ ID NO: 12077 - DNA, 23 bp, Homo sapiens
acatggtgggatcgaatttttgg

SEQ ID NO: 12078 - DNA, 23 bp, Homo sapiens
gatgatcagttgagtttagctgg

SEQ ID NO: 12079 - DNA, 23 bp, Homo sapiens
aaattcgtcaatgcgctgcttgg

SEQ ID NO: 12080 - DNA, 23 bp, Homo sapiens
ccaacccacctgatcttaagagg

SEQ ID NO: 12081 - DNA, 23 bp, Homo sapiens
tgttcacattctgaagatgctgg

SEQ ID NO: 12082 - DNA, 23 bp, Homo sapiens
accggcgtgtcctgcccagtggg

SEQ ID NO: 12083 - DNA, 23 bp, Homo sapiens
agctgctgaatattcagaatcgg

SEQ ID NO: 12084 - DNA, 23 bp, Homo sapiens
gaagatggtcagtgtttccttgg

SEQ ID NO: 12085 - DNA, 23 bp, Homo sapiens
cccggcccaggcagacaaagcgg

SEQ ID NO: 12086 - DNA, 23 bp, Homo sapiens
tagaagagaaagtggacggcggg

SEQ ID NO: 12087 - DNA, 23 bp, Homo sapiens
caaggtcatgagactgggttagg

SEQ ID NO: 12088 - DNA, 23 bp, Homo sapiens
agcccaagaactaagtcaagtgg

SEQ ID NO: 12089 - DNA, 23 bp, Homo sapiens
aatctcatgagcacccacagcgg

SEQ ID NO: 12090 - DNA, 23 bp, Homo sapiens
cagcttcatggatgctggagtgg

SEQ ID NO: 12091 - DNA, 23 bp, Homo sapiens
actgggaactttagtccacgagg

SEQ ID NO: 12092 - DNA, 23 bp, Homo sapiens
catgtaccacctgacatagaggg

SEQ ID NO: 12093 - DNA, 23 bp, Homo sapiens
ggcatgtaccacctgtcctaagg

SEQ ID NO: 12094 - DNA, 23 bp, Homo sapiens
ccagggctgcatctgcaaagggg

SEQ ID NO: 12095 - DNA, 23 bp, Homo sapiens
cccaacatcaggcacagcagcgg

SEQ ID NO: 12096 - DNA, 23 bp, Homo sapiens
tgcagctgctgtgcctgatgtgg

SEQ ID NO: 12097 - DNA, 23 bp, Homo sapiens
atggtctggggctgtggctaagg

SEQ ID NO: 12098 - DNA, 23 bp, Homo sapiens
ccagggctgtgtttgcaaagggg

SEQ ID NO: 12099 - DNA, 23 bp, Homo sapiens
ctgcatctgcaaaggggcatcgg

SEQ ID NO: 12100 - DNA, 23 bp, Homo sapiens
ctgcatccgcaaaggggcttcgg

SEQ ID NO: 12101 - DNA, 23 bp, Homo sapiens
atagaacaagctgcacaacctgg

SEQ ID NO: 12102 - DNA, 23 bp, Homo sapiens
cccagggctgcatctgcaaaggg

SEQ ID NO: 12103 - DNA, 23 bp, Homo sapiens
ctgcatctgcaaaggggcgtcgg

SEQ ID NO: 12104 - DNA, 23 bp, Homo sapiens
aggtctcagggtccatgtcgagg

SEQ ID NO: 12105 - DNA, 23 bp, Homo sapiens
gcacgatggatggctttcatggg

SEQ ID NO: 12106 - DNA, 23 bp, Homo sapiens
atgttactgcggtttggtcctgg

SEQ ID NO: 12107 - DNA, 23 bp, Homo sapiens
ccatcgtcatcgaggactagggg

SEQ ID NO: 12108 - DNA, 23 bp, Homo sapiens
ccacaggtgctcagtcctccagg

SEQ ID NO: 12109 - DNA, 23 bp, Homo sapiens
ctacagtcatcacaatggtctgg

SEQ ID NO: 12110 - DNA, 23 bp, Homo sapiens
catcttacattctgccctaatgg

SEQ ID NO: 12111 - DNA, 23 bp, Homo sapiens
gccatgctactttaatgtcttgg

SEQ ID NO: 12112 - DNA, 23 bp, Homo sapiens
agcaaacaacaatgctgtacagg

SEQ ID NO: 12113 - DNA, 23 bp, Homo sapiens
tagatgattcaggttactccagg

SEQ ID NO: 12114 - DNA, 23 bp, Homo sapiens
acaacaataagtcttcccaaagg

SEQ ID NO: 12115 - DNA, 23 bp, Homo sapiens
cgggcagggctagagtccccagg

SEQ ID NO: 12116 - DNA, 23 bp, Homo sapiens
cttttgcctgatgactaacctgg

SEQ ID NO: 12117 - DNA, 23 bp, Homo sapiens
aaaatttcacgtttctcgtctgg

SEQ ID NO: 12118 - DNA, 23 bp, Homo sapiens
aagttaagcagatttgcctaagg

SEQ ID NO: 12119 - DNA, 23 bp, Homo sapiens
tcaacatttaatggtgccacagg

SEQ ID NO: 12120 - DNA, 23 bp, Homo sapiens
gtgggaacttgacaatgatgtgg

SEQ ID NO: 12121 - DNA, 23 bp, Homo sapiens
gattgccaaagcatcagtacagg

SEQ ID NO: 12122 - DNA, 23 bp, Homo sapiens
ctacgctaagcgccctgcccagg

SEQ ID NO: 12123 - DNA, 23 bp, Homo sapiens
ggatgaggacgacgacgaggagg

SEQ ID NO: 12124 - DNA, 23 bp, Homo sapiens
cagcagcttctccaagtgaaggg

SEQ ID NO: 12125 - DNA, 23 bp, Homo sapiens
cagtatcttgtggaatgggaagg

SEQ ID NO: 12126 - DNA, 23 bp, Homo sapiens
tgagagtctgaaatctgcattgg

SEQ ID NO: 12127 - DNA, 23 bp, Homo sapiens
ggtaccagagtatgatcaggagg

SEQ ID NO: 12128 - DNA, 23 bp, Homo sapiens
gcacctgggtgggtttgagctgg

SEQ ID NO: 12129 - DNA, 23 bp, Homo sapiens
aatcctgtatcacctccctttgg

SEQ ID NO: 12130 - DNA, 23 bp, Homo sapiens
gaagccaacaggaaaaatgaagg

SEQ ID NO: 12131 - DNA, 23 bp, Homo sapiens
aaggaggaagtttgctctaaagg

SEQ ID NO: 12132 - DNA, 23 bp, Homo sapiens
agcagctttgcagacatgatggg

SEQ ID NO: 12133 - DNA, 23 bp, Homo sapiens
acacaagccttctaaactcaagg

SEQ ID NO: 12134 - DNA, 23 bp, Homo sapiens
gttcagggcaaagtctcagccgg

SEQ ID NO: 12135 - DNA, 23 bp, Homo sapiens
agggccgccagccgctcaggtgg

SEQ ID NO: 12136 - DNA, 23 bp, Homo sapiens
cctgaaacagaacaggtgaatgg

SEQ ID NO: 12137 - DNA, 23 bp, Homo sapiens
ggagtgcaggcgcgtgatctagg

SEQ ID NO: 12138 - DNA, 23 bp, Homo sapiens
agttaaaggcttgttctaagtgg

SEQ ID NO: 12139 - DNA, 23 bp, Homo sapiens
gctgaagtctaaagagcttgggg

SEQ ID NO: 12140 - DNA, 23 bp, Homo sapiens
gtgcccatgaaaagatcatctgg

SEQ ID NO: 12141 - DNA, 23 bp, Homo sapiens
aaaaaagatgactgtggatgggg

SEQ ID NO: 12142 - DNA, 23 bp, Homo sapiens
tgatttttttagctgccagaagg

SEQ ID NO: 12143 - DNA, 23 bp, Homo sapiens
tttcccatgctggagtgcagtgg

SEQ ID NO: 12144 - DNA, 23 bp, Homo sapiens
ccagaatgcgagagaaacggagg

SEQ ID NO: 12145 - DNA, 23 bp, Homo sapiens
ggcgctggccaggcagcagaggg

SEQ ID NO: 12146 - DNA, 23 bp, Homo sapiens
gccaagacttcttgggatccagg

SEQ ID NO: 12147 - DNA, 23 bp, Homo sapiens
gacactttgaacaaagaccatgg

SEQ ID NO: 12148 - DNA, 23 bp, Homo sapiens
gtgcaaactcacttctgaggggg

SEQ ID NO: 12149 - DNA, 23 bp, Homo sapiens
acttcctagttcattccatgagg

SEQ ID NO: 12150 - DNA, 23 bp, Homo sapiens
cgtccacacctcggtctgatggg

SEQ ID NO: 12151 - DNA, 23 bp, Homo sapiens
ttttaagtggggccaaaatatgg

SEQ ID NO: 12152 - DNA, 23 bp, Homo sapiens
cagagggggatctggggtagagg

SEQ ID NO: 12153 - DNA, 23 bp, Homo sapiens
ttaacatctggttatccagaagg

SEQ ID NO: 12154 - DNA, 23 bp, Homo sapiens
aaacaggtcacacatcccctagg

SEQ ID NO: 12155 - DNA, 23 bp, Homo sapiens
catgggctggcttcttcacaagg

SEQ ID NO: 12156 - DNA, 23 bp, Homo sapiens
acaggagtgacacactgtgcagg

SEQ ID NO: 12157 - DNA, 23 bp, Homo sapiens
ccaggtcactgagcttcagttgg

SEQ ID NO: 12158 - DNA, 23 bp, Homo sapiens
gtttctccccggcattcaactgg

SEQ ID NO: 12159 - DNA, 23 bp, Homo sapiens
ggtcagcttagagtatggtgtgg

SEQ ID NO: 12160 - DNA, 23 bp, Homo sapiens
acttcaggcagtgagaaacacgg

SEQ ID NO: 12161 - DNA, 23 bp, Homo sapiens
gtaactaactcactgatgcttgg

SEQ ID NO: 12162 - DNA, 23 bp, Homo sapiens
gatgcaggagagtccctgaaagg

SEQ ID NO: 12163 - DNA, 23 bp, Homo sapiens
acattattgttggtcatcagtgg

SEQ ID NO: 12164 - DNA, 23 bp, Homo sapiens
caggcagatgctctctagcctgg

SEQ ID NO: 12165 - DNA, 23 bp, Homo sapiens
gaccactcaacgaagacagtcgg

SEQ ID NO: 12166 - DNA, 23 bp, Homo sapiens
tgggcctccagttaccagaaagg

SEQ ID NO: 12167 - DNA, 23 bp, Homo sapiens
actaattgttctcttcccactgg

SEQ ID NO: 12168 - DNA, 23 bp, Homo sapiens
aaatggcttggacccattttggg

SEQ ID NO: 12169 - DNA, 23 bp, Homo sapiens
agaagccattgctgaacttttgg

SEQ ID NO: 12170 - DNA, 23 bp, Homo sapiens
ctcagctgaagcatcaggtatgg

SEQ ID NO: 12171 - DNA, 23 bp, Homo sapiens
ctgttggaagatgaactatccgg

SEQ ID NO: 12172 - DNA, 23 bp, Homo sapiens
tgaacttgtacagtcattgaagg

SEQ ID NO: 12173 - DNA, 23 bp, Homo sapiens
gcccagtgacatatgtttaatgg

SEQ ID NO: 12174 - DNA, 23 bp, Homo sapiens
ttgacctatccgcgaagaggcgg

SEQ ID NO: 12175 - DNA, 23 bp, Homo sapiens
tggtctgatgtaggcttatgtgg

SEQ ID NO: 12176 - DNA, 23 bp, Homo sapiens
ggaggttgaattatgctccgagg

SEQ ID NO: 12177 - DNA, 23 bp, Homo sapiens
tccaacacaggtatgctctaagg

SEQ ID NO: 12178 - DNA, 23 bp, Homo sapiens
agtgacaagcctacggaggctgg

SEQ ID NO: 12179 - DNA, 23 bp, Homo sapiens
aaactgacctgcctgtgaagagg

SEQ ID NO: 12180 - DNA, 23 bp, Homo sapiens
gttgaactaggagtctatcttgg

SEQ ID NO: 12181 - DNA, 23 bp, Homo sapiens
tgacctgcccgtgaagaggcggg

SEQ ID NO: 12182 - DNA, 23 bp, Homo sapiens
caactgacctgcccgtgaagagg

SEQ ID NO: 12183 - DNA, 23 bp, Homo sapiens
aacgctaccttcaggatatttgg

SEQ ID NO: 12184 - DNA, 23 bp, Homo sapiens
ctcagcccctcgcttttcttagg

SEQ ID NO: 12185 - DNA, 23 bp, Homo sapiens
cggcgccccgcatcttatgatgg

SEQ ID NO: 12186 - DNA, 23 bp, Homo sapiens
tcagtttcaaaaccatccgctgg

SEQ ID NO: 12187 - DNA, 23 bp, Homo sapiens
ggagcccccagatttactgctgg

SEQ ID NO: 12188 - DNA, 23 bp, Homo sapiens
gactttggggaggtgtcatctgg

SEQ ID NO: 12189 - DNA, 23 bp, Homo sapiens
ggccgtgtagtggcgtcatctgg

SEQ ID NO: 12190 - DNA, 23 bp, Homo sapiens
catggctgaggaggatgaagagg

SEQ ID NO: 12191 - DNA, 23 bp, Homo sapiens
accagtgcgtcaagttcagtagg

SEQ ID NO: 12192 - DNA, 23 bp, Homo sapiens
ttgaagatcgtggtaaaggcagg

SEQ ID NO: 12193 - DNA, 23 bp, Homo sapiens
acatcctgagcagttattttagg

SEQ ID NO: 12194 - DNA, 23 bp, Homo sapiens
actctcagggcgaaagccgttgg

SEQ ID NO: 12195 - DNA, 23 bp, Homo sapiens
ccacttctgccaacttgtagggg

SEQ ID NO: 12196 - DNA, 23 bp, Homo sapiens
gctacgatcggtactgctagggg

SEQ ID NO: 12197 - DNA, 23 bp, Homo sapiens
gcccccgttggctcacacagtgg

SEQ ID NO: 12198 - DNA, 23 bp, Homo sapiens
catgctgctgtgtcttgaatagg

SEQ ID NO: 12199 - DNA, 23 bp, Homo sapiens
ttctatacagaagtacgaagtgg

SEQ ID NO: 12200 - DNA, 23 bp, Homo sapiens
cctggaggatctgcaatgactgg

SEQ ID NO: 12201 - DNA, 23 bp, Homo sapiens
aatgatgtcgtcattacctgagg

SEQ ID NO: 12202 - DNA, 23 bp, Homo sapiens
tcagcattaactgtacatgaagg

SEQ ID NO: 12203 - DNA, 23 bp, Homo sapiens
catctggggagcgggtgagcggg

SEQ ID NO: 12204 - DNA, 23 bp, Homo sapiens
tgcgtgtcaggagaggctaacgg

SEQ ID NO: 12205 - DNA, 23 bp, Homo sapiens
agatgagcgggaggaacagcggg

SEQ ID NO: 12206 - DNA, 23 bp, Homo sapiens
ccactccatggtgtcctcagtgg

SEQ ID NO: 12207 - DNA, 23 bp, Homo sapiens
gccccgcagggctcacactgagg

SEQ ID NO: 12208 - DNA, 23 bp, Homo sapiens
gctgaggccttgccttgaagggg

SEQ ID NO: 12209 - DNA, 23 bp, Homo sapiens
cggcagtgctggtcagtgcatgg

SEQ ID NO: 12210 - DNA, 23 bp, Homo sapiens
agaacgttctcagacagcagtgg

SEQ ID NO: 12211 - DNA, 23 bp, Homo sapiens
gtggcctgtggagactagcaggg

SEQ ID NO: 12212 - DNA, 23 bp, Homo sapiens
cagaattattgacgacatggtgg

SEQ ID NO: 12213 - DNA, 23 bp, Homo sapiens
ggtagagtgtgtccctgagatgg

SEQ ID NO: 12214 - DNA, 23 bp, Homo sapiens
aactattagctgttgtacagggg

SEQ ID NO: 12215 - DNA, 23 bp, Homo sapiens
ggaaccggcgccgtcggtgaggg

SEQ ID NO: 12216 - DNA, 23 bp, Homo sapiens
aggaccatgtctaggctacaggg

SEQ ID NO: 12217 - DNA, 23 bp, Homo sapiens
cacggcataagctcaggtcaagg

SEQ ID NO: 12218 - DNA, 23 bp, Homo sapiens
gagggaactgtgagtgtctaagg

SEQ ID NO: 12219 - DNA, 23 bp, Homo sapiens
ggacccaccaagagtgtcttcgg

SEQ ID NO: 12220 - DNA, 23 bp, Homo sapiens
aatatcatcaagcacctgaacgg

SEQ ID NO: 12221 - DNA, 23 bp, Homo sapiens
ggggctttcagaggtgtcactgg

SEQ ID NO: 12222 - DNA, 23 bp, Homo sapiens
ggtgagggactatgagacgctgg

SEQ ID NO: 12223 - DNA, 23 bp, Homo sapiens
caccccgacaaggcctcacctgg

SEQ ID NO: 12224 - DNA, 23 bp, Homo sapiens
cagcagatcccgcagtcctgagg

SEQ ID NO: 12225 - DNA, 23 bp, Homo sapiens
tgctgaggcagtcaggcagctgg

SEQ ID NO: 12226 - DNA, 23 bp, Homo sapiens
gtgtcgtgggctcctctcagagg

SEQ ID NO: 12227 - DNA, 23 bp, Homo sapiens
atcaggagttagcgcagtacagg

SEQ ID NO: 12228 - DNA, 23 bp, Homo sapiens
cagtgtgcgtgcacgtctacggg

SEQ ID NO: 12229 - DNA, 23 bp, Homo sapiens
ctggacagagtgtggttaaccgg

SEQ ID NO: 12230 - DNA, 23 bp, Homo sapiens
caggcatcgccgcccttcagtgg

SEQ ID NO: 12231 - DNA, 23 bp, Homo sapiens
gacagtcacaaggcgtgtcttgg

SEQ ID NO: 12232 - DNA, 23 bp, Homo sapiens
acggccaacagtgtcagtgatgg

SEQ ID NO: 12233 - DNA, 23 bp, Homo sapiens
gggtgaggaacatcatagccagg

SEQ ID NO: 12234 - DNA, 23 bp, Homo sapiens
agagggcacgggcctacgagagg

SEQ ID NO: 12235 - DNA, 23 bp, Homo sapiens
agtgaatgaaagtttgacactgg

SEQ ID NO: 12236 - DNA, 23 bp, Homo sapiens
aatccacatttcagaagacgtgg

SEQ ID NO: 12237 - DNA, 23 bp, Homo sapiens
gaccaaagaggagctggaggagg

SEQ ID NO: 12238 - DNA, 23 bp, Homo sapiens
cagtctacatgtcgtagagccgg

SEQ ID NO: 12239 - DNA, 23 bp, Homo sapiens
ggacctaaggaacttgctacagg

SEQ ID NO: 12240 - DNA, 23 bp, Homo sapiens
gaatgtcttcaggcccccagcgg

SEQ ID NO: 12241 - DNA, 23 bp, Homo sapiens
aaggagaactgcaaatagggagg

SEQ ID NO: 12242 - DNA, 23 bp, Homo sapiens
tgcccacctggtttttgtcaagg

SEQ ID NO: 12243 - DNA, 23 bp, Homo sapiens
gggctgccactgtgggctacagg

SEQ ID NO: 12244 - DNA, 23 bp, Homo sapiens
tgtctcacatgaccagcgtccgg

SEQ ID NO: 12245 - DNA, 23 bp, Homo sapiens
tcccagcctgcttcagagtgggg

SEQ ID NO: 12246 - DNA, 23 bp, Homo sapiens
aagcacaggtgaggaaggcaggg

SEQ ID NO: 12247 - DNA, 23 bp, Homo sapiens
gagagctcttgaagtactactgg

SEQ ID NO: 12248 - DNA, 23 bp, Homo sapiens
cggaccctcatcttgtcctgagg

SEQ ID NO: 12249 - DNA, 23 bp, Homo sapiens
ggagattgaatgcaaactggagg

SEQ ID NO: 12250 - DNA, 23 bp, Homo sapiens
gacaaccagtcttcctggagggg

SEQ ID NO: 12251 - DNA, 23 bp, Homo sapiens
gcaatcctgaggaatactgaggg

SEQ ID NO: 12252 - DNA, 23 bp, Homo sapiens
ttctgcagactcctcttgcaagg

SEQ ID NO: 12253 - DNA, 23 bp, Homo sapiens
gtaggggacaggtctcactgcgg

SEQ ID NO: 12254 - DNA, 23 bp, Homo sapiens
aggagccagcctggtcactgagg

SEQ ID NO: 12255 - DNA, 23 bp, Homo sapiens
cctcccgtgacttcagtgtgcgg

SEQ ID NO: 12256 - DNA, 23 bp, Homo sapiens
cttcttaggtgtcctcaattagg

SEQ ID NO: 12257 - DNA, 23 bp, Homo sapiens
ctacggaactcttgtgcgtaagg

SEQ ID NO: 12258 - DNA, 23 bp, Homo sapiens
ggaggagaagcgtgctgaatagg

SEQ ID NO: 12259 - DNA, 23 bp, Homo sapiens
tctgcgtgttctaaaaagtgtgg

SEQ ID NO: 12260 - DNA, 23 bp, Homo sapiens
ggcccgagagtcacctgcagagg

SEQ ID NO: 12261 - DNA, 23 bp, Homo sapiens
gggcagcttcagccaaagagagg

SEQ ID NO: 12262 - DNA, 23 bp, Homo sapiens
tggtcagttagtagccagtgagg

SEQ ID NO: 12263 - DNA, 23 bp, Homo sapiens
gctggaaaaggaaaaattgcagg

SEQ ID NO: 12264 - DNA, 23 bp, Homo sapiens
ttgaaactggaaacatccagagg

SEQ ID NO: 12265 - DNA, 23 bp, Homo sapiens
gcattcccagattcctgagtagg

SEQ ID NO: 12266 - DNA, 23 bp, Homo sapiens
ctcagaacagtcttcagggcagg

SEQ ID NO: 12267 - DNA, 23 bp, Homo sapiens
tggggatcagtcgcttctgatgg

SEQ ID NO: 12268 - DNA, 23 bp, Homo sapiens
cagctcagtgcgcgatgccttgg

SEQ ID NO: 12269 - DNA, 23 bp, Homo sapiens
cagagaaattgatgttcgcttgg

SEQ ID NO: 12270 - DNA, 23 bp, Homo sapiens
atcatcatcctcacttgttgagg

SEQ ID NO: 12271 - DNA, 23 bp, Homo sapiens
tagcacatgatagataagcctgg

SEQ ID NO: 12272 - DNA, 23 bp, Homo sapiens
cccctgcgtggaggaagtggtgg

SEQ ID NO: 12273 - DNA, 23 bp, Homo sapiens
gctgagggtgaagagcagggagg

SEQ ID NO: 12274 - DNA, 23 bp, Homo sapiens
tcctgcaactttactctgactgg

SEQ ID NO: 12275 - DNA, 23 bp, Homo sapiens
agttgcttattcactggccttgg

SEQ ID NO: 12276 - DNA, 23 bp, Homo sapiens
catcactgcgaagtttcctgtgg

SEQ ID NO: 12277 - DNA, 23 bp, Homo sapiens
agggccaagagccgagacgtggg

SEQ ID NO: 12278 - DNA, 23 bp, Homo sapiens
tggggacagggtagggtcactgg

SEQ ID NO: 12279 - DNA, 23 bp, Homo sapiens
agcaagagagtttgggaaaaagg

SEQ ID NO: 12280 - DNA, 23 bp, Homo sapiens
tgacttttgtgtgaacctcccgg

SEQ ID NO: 12281 - DNA, 23 bp, Homo sapiens
tggctcactcttcactctcgtgg

SEQ ID NO: 12282 - DNA, 23 bp, Homo sapiens
gctgagagtgaagagtcgggagg

SEQ ID NO: 12283 - DNA, 23 bp, Homo sapiens
cgagccaagagccgtgacattgg

SEQ ID NO: 12284 - DNA, 23 bp, Homo sapiens
gagccgtgacattggcacgaagg

SEQ ID NO: 12285 - DNA, 23 bp, Homo sapiens
gcacggacccgggacgccctggg

SEQ ID NO: 12286 - DNA, 23 bp, Homo sapiens
tgatttttgtgtgaacctctcgg

SEQ ID NO: 12287 - DNA, 23 bp, Homo sapiens
tgcaggagaagaggcttattcgg

SEQ ID NO: 12288 - DNA, 23 bp, Homo sapiens
gcacatcatgtctatctgaatgg

SEQ ID NO: 12289 - DNA, 23 bp, Homo sapiens
acggtgaagagaaggattagggg

SEQ ID NO: 12290 - DNA, 23 bp, Homo sapiens
ttcacacgcatcctgaaacatgg

SEQ ID NO: 12291 - DNA, 23 bp, Homo sapiens
ggagaagagaaggactaggaggg

SEQ ID NO: 12292 - DNA, 23 bp, Homo sapiens
ttcatagttgatgcagccattgg

SEQ ID NO: 12293 - DNA, 23 bp, Homo sapiens
ttgtcaagcacatcatgtcaggg

SEQ ID NO: 12294 - DNA, 23 bp, Homo sapiens
cacccacggggaggagaaggagg

SEQ ID NO: 12295 - DNA, 23 bp, Homo sapiens
gcatatcctgtcggggtgacggg

SEQ ID NO: 12296 - DNA, 23 bp, Homo sapiens
cgcatggtgctgaatggctgagg

SEQ ID NO: 12297 - DNA, 23 bp, Homo sapiens
gcttaggatgtgtttcaagaagg

SEQ ID NO: 12298 - DNA, 23 bp, Homo sapiens
agacgagaaagaggaatgagggg

SEQ ID NO: 12299 - DNA, 23 bp, Homo sapiens
cgccaaggataaagacgactagg

SEQ ID NO: 12300 - DNA, 23 bp, Homo sapiens
tgggaacatctgcctcagctcgg

SEQ ID NO: 12301 - DNA, 23 bp, Homo sapiens
tacagtcagattgagaagactgg

SEQ ID NO: 12302 - DNA, 23 bp, Homo sapiens
aggtgaaggggaaggggaagagg

SEQ ID NO: 12303 - DNA, 23 bp, Homo sapiens
gggggcactgatggctctggggg

SEQ ID NO: 12304 - DNA, 23 bp, Homo sapiens
gttgaagattagggagaagttgg

SEQ ID NO: 12305 - DNA, 23 bp, Homo sapiens
gctgcctcctgtagactatttgg

SEQ ID NO: 12306 - DNA, 23 bp, Homo sapiens
acgccaaggaccaggagtagggg

SEQ ID NO: 12307 - DNA, 23 bp, Homo sapiens
atcagacacaagcacagcacagg

SEQ ID NO: 12308 - DNA, 23 bp, Homo sapiens
aggttaggcccccaaaagtgagg

SEQ ID NO: 12309 - DNA, 23 bp, Homo sapiens
tgttgaggtcaactgtgaatggg

SEQ ID NO: 12310 - DNA, 23 bp, Homo sapiens
ggctctgtcccgccttcacctgg

SEQ ID NO: 12311 - DNA, 23 bp, Homo sapiens
gctgggggctgggtcagagcagg

SEQ ID NO: 12312 - DNA, 23 bp, Homo sapiens
gtggcccagcatcaactgagagg

SEQ ID NO: 12313 - DNA, 23 bp, Homo sapiens
tgggacaccaccatttgatgtgg

SEQ ID NO: 12314 - DNA, 23 bp, Homo sapiens
cgacacagaggccaagctgacgg

SEQ ID NO: 12315 - DNA, 23 bp, Homo sapiens
gaagaaatacctccagaagtagg

SEQ ID NO: 12316 - DNA, 23 bp, Homo sapiens
cagggaaaagctctatgcaaagg

SEQ ID NO: 12317 - DNA, 23 bp, Homo sapiens
cttctgccttcactgggctgggg

SEQ ID NO: 12318 - DNA, 23 bp, Homo sapiens
gaggtgactgtgcagtgaggagg

SEQ ID NO: 12319 - DNA, 23 bp, Homo sapiens
agagaggaggcgccagttaaggg

SEQ ID NO: 12320 - DNA, 23 bp, Homo sapiens
tcgccccacggctgaattctcgg

SEQ ID NO: 12321 - DNA, 23 bp, Homo sapiens
accagcgggaagggatcccctgg

SEQ ID NO: 12322 - DNA, 23 bp, Homo sapiens
ctccgcggggcgtcagttcccgg

SEQ ID NO: 12323 - DNA, 23 bp, Homo sapiens
tggagaacttgttggagtgctgg

SEQ ID NO: 12324 - DNA, 23 bp, Homo sapiens
aactatgtgaccaagatctgagg

SEQ ID NO: 12325 - DNA, 23 bp, Homo sapiens
tacgtggagaagatctgagctgg

SEQ ID NO: 12326 - DNA, 23 bp, Homo sapiens
cggcgggtgcgggcgctcagcgg

SEQ ID NO: 12327 - DNA, 23 bp, Homo sapiens
tcctctatcaggacttcctccgg

SEQ ID NO: 12328 - DNA, 23 bp, Homo sapiens
cgttgaacggttaggactgctgg

SEQ ID NO: 12329 - DNA, 23 bp, Homo sapiens
agcaaaagagtctccttttgagg

SEQ ID NO: 12330 - DNA, 23 bp, Homo sapiens
cggcctgggcttcatttcacggg

SEQ ID NO: 12331 - DNA, 23 bp, Homo sapiens
tgcatcttcagacttcattgagg

SEQ ID NO: 12332 - DNA, 23 bp, Homo sapiens
tcaagctaggctttctgaatagg

SEQ ID NO: 12333 - DNA, 23 bp, Homo sapiens
ctttaacagactctgcagcatgg

SEQ ID NO: 12334 - DNA, 23 bp, Homo sapiens
accaaaagactttcaggccctgg

SEQ ID NO: 12335 - DNA, 23 bp, Homo sapiens
gactgttcacttgccgctcctgg

SEQ ID NO: 12336 - DNA, 23 bp, Homo sapiens
cagcatccgctgctaggtgctgg

SEQ ID NO: 12337 - DNA, 23 bp, Homo sapiens
aaccaacagctagcactctttgg

SEQ ID NO: 12338 - DNA, 23 bp, Homo sapiens
cagctgtggctctcagccattgg

SEQ ID NO: 12339 - DNA, 23 bp, Homo sapiens
gcctcggaaggtcagtattaagg

SEQ ID NO: 12340 - DNA, 23 bp, Homo sapiens
cttggaggcttttcacatcttgg

SEQ ID NO: 12341 - DNA, 23 bp, Homo sapiens
tggaccttcacttgcagcagtgg

SEQ ID NO: 12342 - DNA, 23 bp, Homo sapiens
gatataccaggtgctctgagggg

SEQ ID NO: 12343 - DNA, 23 bp, Homo sapiens
cggcaaagagtagaggagcacgg

SEQ ID NO: 12344 - DNA, 23 bp, Homo sapiens
gcttggaagacaatctcagttgg

SEQ ID NO: 12345 - DNA, 23 bp, Homo sapiens
tggcaagaaggccaagtgaccgg

SEQ ID NO: 12346 - DNA, 23 bp, Homo sapiens
ggctaggaaaacgccttcactgg

SEQ ID NO: 12347 - DNA, 23 bp, Homo sapiens
tcacatgctcttcagctccttgg

SEQ ID NO: 12348 - DNA, 23 bp, Homo sapiens
tgggctgggtcaggacgcccagg

SEQ ID NO: 12349 - DNA, 23 bp, Homo sapiens
cagcgtttggcagctcaatctgg

SEQ ID NO: 12350 - DNA, 23 bp, Homo sapiens
ggagaaacagaggagctgtgagg

SEQ ID NO: 12351 - DNA, 23 bp, Homo sapiens
tttcataggtcttctgattctgg

SEQ ID NO: 12352 - DNA, 23 bp, Homo sapiens
aggctagggctacagctcctcgg

SEQ ID NO: 12353 - DNA, 23 bp, Homo sapiens
atgctcttctcggagtgtagtgg

SEQ ID NO: 12354 - DNA, 23 bp, Homo sapiens
gatttcacggagatttccatcgg

SEQ ID NO: 12355 - DNA, 23 bp, Homo sapiens
ggagggcagctcagtcacacagg

SEQ ID NO: 12356 - DNA, 23 bp, Homo sapiens
tcaactgatccttattttgctgg

SEQ ID NO: 12357 - DNA, 23 bp, Homo sapiens
atcacagctgactccagagcagg

SEQ ID NO: 12358 - DNA, 23 bp, Homo sapiens
aaccgaagagaactgtacaaagg

SEQ ID NO: 12359 - DNA, 23 bp, Homo sapiens
ggtaccacacggcctagacctgg

SEQ ID NO: 12360 - DNA, 23 bp, Homo sapiens
gctcagtcacttaccatgtgcgg

SEQ ID NO: 12361 - DNA, 23 bp, Homo sapiens
gcaggctgtgagaggaattcagg

SEQ ID NO: 12362 - DNA, 23 bp, Homo sapiens
taacatccagctgccgcacatgg

SEQ ID NO: 12363 - DNA, 23 bp, Homo sapiens
ttttcttcatggttaactccagg

SEQ ID NO: 12364 - DNA, 23 bp, Homo sapiens
ggactagagctcttctcttgtgg

SEQ ID NO: 12365 - DNA, 23 bp, Homo sapiens
ggatcttctggtgcctcagcagg

SEQ ID NO: 12366 - DNA, 23 bp, Homo sapiens
gcgtcccggctggagctactcgg

SEQ ID NO: 12367 - DNA, 23 bp, Homo sapiens
caaggctactgaagcactgaagg

SEQ ID NO: 12368 - DNA, 23 bp, Homo sapiens
acgcagggcagcacctaggatgg

SEQ ID NO: 12369 - DNA, 23 bp, Homo sapiens
acacggggcagcacctaggatgg

SEQ ID NO: 12370 - DNA, 23 bp, Homo sapiens
aggtaacatgtagcctttgctgg

SEQ ID NO: 12371 - DNA, 23 bp, Homo sapiens
tgcgctttctgccatggtgttgg

SEQ ID NO: 12372 - DNA, 23 bp, Homo sapiens
agcatgactttcaagcaccctgg

SEQ ID NO: 12373 - DNA, 23 bp, Homo sapiens
agtcacatgtaaggaacataagg

SEQ ID NO: 12374 - DNA, 23 bp, Homo sapiens
aaatccaccgaatgaaagaacgg

SEQ ID NO: 12375 - DNA, 23 bp, Homo sapiens
cataccgttctttcattcggtgg

SEQ ID NO: 12376 - DNA, 23 bp, Homo sapiens
catggaccccattcagtagttgg

SEQ ID NO: 12377 - DNA, 23 bp, Homo sapiens
gttgtcaccatggatattagagg

SEQ ID NO: 12378 - DNA, 23 bp, Homo sapiens
cagaggtggggaggctctcttgg

SEQ ID NO: 12379 - DNA, 23 bp, Homo sapiens
cttgcaatggaagatgtcagtgg

SEQ ID NO: 12380 - DNA, 23 bp, Homo sapiens
ctcgagtcctccaagatctgagg

SEQ ID NO: 12381 - DNA, 23 bp, Homo sapiens
acacactgtatgctaagacttgg

SEQ ID NO: 12382 - DNA, 23 bp, Homo sapiens
gggatggggcaggctctaggagg

SEQ ID NO: 12383 - DNA, 23 bp, Homo sapiens
cttaagcatgctctaggaggtgg

SEQ ID NO: 12384 - DNA, 23 bp, Homo sapiens
ttctgcagaagctgaagaactgg

SEQ ID NO: 12385 - DNA, 23 bp, Homo sapiens
gtatggttcagtgccacattagg

SEQ ID NO: 12386 - DNA, 23 bp, Homo sapiens
tggacagtattctttggctttgg

SEQ ID NO: 12387 - DNA, 23 bp, Homo sapiens
ttacctttgactcttgtcccagg

SEQ ID NO: 12388 - DNA, 23 bp, Homo sapiens
cagggttattcaatgtcttcagg

SEQ ID NO: 12389 - DNA, 23 bp, Homo sapiens
ggatttcttctcagtatccctgg

SEQ ID NO: 12390 - DNA, 23 bp, Homo sapiens
gcactcacttctggaaatggggg

SEQ ID NO: 12391 - DNA, 23 bp, Homo sapiens
atgcactgcgacttaaactgtgg

SEQ ID NO: 12392 - DNA, 23 bp, Homo sapiens
tctcaaacaagtttcacaacagg

SEQ ID NO: 12393 - DNA, 23 bp, Homo sapiens
cgccatcgtggtcagagatacgg

SEQ ID NO: 12394 - DNA, 23 bp, Homo sapiens
aagtggctctgagagttcagtgg

SEQ ID NO: 12395 - DNA, 23 bp, Homo sapiens
acatctgcattctgaccagaagg

SEQ ID NO: 12396 - DNA, 23 bp, Homo sapiens
gaacaagggggcgcaataaaggg

SEQ ID NO: 12397 - DNA, 23 bp, Homo sapiens
gctgcccagccgacatcacatgg

SEQ ID NO: 12398 - DNA, 23 bp, Homo sapiens
tcctcagcaggtcagctgaatgg

SEQ ID NO: 12399 - DNA, 23 bp, Homo sapiens
acaagcaaacctcagcctggagg

SEQ ID NO: 12400 - DNA, 23 bp, Homo sapiens
ctgctgacttactttctactcgg

SEQ ID NO: 12401 - DNA, 23 bp, Homo sapiens
tttacaattcaagcagcagcagg

SEQ ID NO: 12402 - DNA, 23 bp, Homo sapiens
agaaagagggctggggtcagagg

SEQ ID NO: 12403 - DNA, 23 bp, Homo sapiens
tgttcaagagtgtcttggatggg

SEQ ID NO: 12404 - DNA, 23 bp, Homo sapiens
cacagctatcttgaatcttcagg

SEQ ID NO: 12405 - DNA, 23 bp, Homo sapiens
ctgaggccagccggcagtgaggg

SEQ ID NO: 12406 - DNA, 23 bp, Homo sapiens
catcttttaaaggctctccgagg

SEQ ID NO: 12407 - DNA, 23 bp, Homo sapiens
gctatctcttgctgctcctccgg

SEQ ID NO: 12408 - DNA, 23 bp, Homo sapiens
cagagggagtcaaggaacaaagg

SEQ ID NO: 12409 - DNA, 23 bp, Homo sapiens
tactgttgttcttcagggctcgg

SEQ ID NO: 12410 - DNA, 23 bp, Homo sapiens
tactgttgttcttcagagctcgg

SEQ ID NO: 12411 - DNA, 23 bp, Homo sapiens
gcttccggtcagtggctacatgg

SEQ ID NO: 12412 - DNA, 23 bp, Homo sapiens
gaggctgggcgggttactgcagg

SEQ ID NO: 12413 - DNA, 23 bp, Homo sapiens
ctatgcagggaccttgtaagcgg

SEQ ID NO: 12414 - DNA, 23 bp, Homo sapiens
ggaggaggaggaggagggctagg

SEQ ID NO: 12415 - DNA, 23 bp, Homo sapiens
ctgtgcttcttgaacagtgaagg

SEQ ID NO: 12416 - DNA, 23 bp, Homo sapiens
tccctggacggcgtggactgagg

SEQ ID NO: 12417 - DNA, 23 bp, Homo sapiens
gtgcttgcttactctacaactgg

SEQ ID NO: 12418 - DNA, 23 bp, Homo sapiens
agtgagtcacacaaactttttgg

SEQ ID NO: 12419 - DNA, 23 bp, Homo sapiens
tgcatagtcacctaatagtaagg

SEQ ID NO: 12420 - DNA, 23 bp, Homo sapiens
ctggagatgtcccagcagtgagg

SEQ ID NO: 12421 - DNA, 23 bp, Homo sapiens
ttcctacaccttttcctaggggg

SEQ ID NO: 12422 - DNA, 23 bp, Homo sapiens
gcgaatctatcaccaagagccgg

SEQ ID NO: 12423 - DNA, 23 bp, Homo sapiens
cttgaggcttcagtccttgaagg

SEQ ID NO: 12424 - DNA, 23 bp, Homo sapiens
catggtgagggtcagctgcctgg

SEQ ID NO: 12425 - DNA, 23 bp, Homo sapiens
ggcctgacccctgccctcactgg

SEQ ID NO: 12426 - DNA, 23 bp, Homo sapiens
ttctgaatgattggagagaacgg

SEQ ID NO: 12427 - DNA, 23 bp, Homo sapiens
tgaccttctggatatttaggtgg

SEQ ID NO: 12428 - DNA, 23 bp, Homo sapiens
actggaagcagcacatcattagg

SEQ ID NO: 12429 - DNA, 23 bp, Homo sapiens
actcatcttcacacgtcttcagg

SEQ ID NO: 12430 - DNA, 23 bp, Homo sapiens
taggaagatcacttgagggcagg

SEQ ID NO: 12431 - DNA, 23 bp, Homo sapiens
ctggcaagaagctgcgctgaagg

SEQ ID NO: 12432 - DNA, 23 bp, Homo sapiens
gcgcaactcggccggacgcaggg

SEQ ID NO: 12433 - DNA, 23 bp, Homo sapiens
tccctccatgtccacctaggagg

SEQ ID NO: 12434 - DNA, 23 bp, Homo sapiens
gcccttttatgtgctttaagtgg

SEQ ID NO: 12435 - DNA, 23 bp, Homo sapiens
tgacaccatcatggaagaattgg

SEQ ID NO: 12436 - DNA, 23 bp, Homo sapiens
atagttactgcagccaacgttgg

SEQ ID NO: 12437 - DNA, 23 bp, Homo sapiens
cactgctgcttgcactctgctgg

SEQ ID NO: 12438 - DNA, 23 bp, Homo sapiens
tgtcttctactaatgcctcaagg

SEQ ID NO: 12439 - DNA, 23 bp, Homo sapiens
tactatactggagaagtcaatgg

SEQ ID NO: 12440 - DNA, 23 bp, Homo sapiens
tgatgcggaaattaaccccaagg

SEQ ID NO: 12441 - DNA, 23 bp, Homo sapiens
gatgacgccaagaagtaaggggg

SEQ ID NO: 12442 - DNA, 23 bp, Homo sapiens
ggctgggtggggcttagcgcagg

SEQ ID NO: 12443 - DNA, 23 bp, Homo sapiens
caaggggatggagaaggagatgg

SEQ ID NO: 12444 - DNA, 23 bp, Homo sapiens
aatgaagctctagagagatacgg

SEQ ID NO: 12445 - DNA, 23 bp, Homo sapiens
gaggaagatgaatactcaggagg

SEQ ID NO: 12446 - DNA, 23 bp, Homo sapiens
agccccgctccgagtctcagggg

SEQ ID NO: 12447 - DNA, 23 bp, Homo sapiens
cgcttcacttgggcgtcacccgg

SEQ ID NO: 12448 - DNA, 23 bp, Homo sapiens
cacacagcctggacatcaagtgg

SEQ ID NO: 12449 - DNA, 23 bp, Homo sapiens
gcctgggcatccggtggtagggg

SEQ ID NO: 12450 - DNA, 23 bp, Homo sapiens
atggttatggcgtgcaacgctgg

SEQ ID NO: 12451 - DNA, 23 bp, Homo sapiens
tcattcatgccttttatagctgg

SEQ ID NO: 12452 - DNA, 23 bp, Homo sapiens
gaaagcactgcatgttaagaggg

SEQ ID NO: 12453 - DNA, 23 bp, Homo sapiens
agaaagcttgtgcccaaacatgg

SEQ ID NO: 12454 - DNA, 23 bp, Homo sapiens
cttcaacttcttgctctgtttgg

SEQ ID NO: 12455 - DNA, 23 bp, Homo sapiens
ctgtcagtctgtagcttcacagg

SEQ ID NO: 12456 - DNA, 23 bp, Homo sapiens
ctgctggaggccgacatctgagg

SEQ ID NO: 12457 - DNA, 23 bp, Homo sapiens
atagtaagggatccatcaccagg

SEQ ID NO: 12458 - DNA, 23 bp, Homo sapiens
tggatggaaaaagacatctgagg

SEQ ID NO: 12459 - DNA, 23 bp, Homo sapiens
acctcccttcttctaaggtaggg

SEQ ID NO: 12460 - DNA, 23 bp, Homo sapiens
acctcccttctgctcaggcaggg

SEQ ID NO: 12461 - DNA, 23 bp, Homo sapiens
ctaccgcctgcagctgcgcgagg

SEQ ID NO: 12462 - DNA, 23 bp, Homo sapiens
cacaaggcccagccatcagcagg

SEQ ID NO: 12463 - DNA, 23 bp, Homo sapiens
gctcgtggtagctcttcacatgg

SEQ ID NO: 12464 - DNA, 23 bp, Homo sapiens
gagcatctgccacaggtcaaggg

SEQ ID NO: 12465 - DNA, 23 bp, Homo sapiens
accttcaggcaacactttaaggg

SEQ ID NO: 12466 - DNA, 23 bp, Homo sapiens
ttggagtccactctgtgacaggg

SEQ ID NO: 12467 - DNA, 23 bp, Homo sapiens
taacttttttcaccctctagagg

SEQ ID NO: 12468 - DNA, 23 bp, Homo sapiens
ggtttcaaagagcttgctgaagg

SEQ ID NO: 12469 - DNA, 23 bp, Homo sapiens
gtgtctatcgtctgcagtgaggg

SEQ ID NO: 12470 - DNA, 23 bp, Homo sapiens
cagcacagcactgggtgtgaggg

SEQ ID NO: 12471 - DNA, 23 bp, Homo sapiens
ttatttctctacttctccggagg

SEQ ID NO: 12472 - DNA, 23 bp, Homo sapiens
ctgatcactggcatggcttctgg

SEQ ID NO: 12473 - DNA, 23 bp, Homo sapiens
cggctcagccagatttcagctgg

SEQ ID NO: 12474 - DNA, 23 bp, Homo sapiens
caggttcagcgcgcctcagtagg

SEQ ID NO: 12475 - DNA, 23 bp, Homo sapiens
gaagagggggctgaggactgagg

SEQ ID NO: 12476 - DNA, 23 bp, Homo sapiens
cagaactagaagagtggctaagg

SEQ ID NO: 12477 - DNA, 23 bp, Homo sapiens
ttagtaagggctgcttactgtgg

SEQ ID NO: 12478 - DNA, 23 bp, Homo sapiens
ctccacctggtgttccagatggg

SEQ ID NO: 12479 - DNA, 23 bp, Homo sapiens
caggctcagcagcgtgctgatgg

SEQ ID NO: 12480 - DNA, 23 bp, Homo sapiens
ttactaagggctgcttattgtgg

SEQ ID NO: 12481 - DNA, 23 bp, Homo sapiens
ttagtaagagctgcttattgtgg

SEQ ID NO: 12482 - DNA, 23 bp, Homo sapiens
ttagtaagggctgcctattgtgg

SEQ ID NO: 12483 - DNA, 23 bp, Homo sapiens
ttagtaagggctgtttattgtgg

SEQ ID NO: 12484 - DNA, 23 bp, Homo sapiens
ttagtaagggctgcttagtgtgg

SEQ ID NO: 12485 - DNA, 23 bp, Homo sapiens
ggaaggacgcaaaggatggcagg

SEQ ID NO: 12486 - DNA, 23 bp, Homo sapiens
gaaaggatgcaaaggatgatagg

SEQ ID NO: 12487 - DNA, 23 bp, Homo sapiens
actgcagggctccttcactgagg

SEQ ID NO: 12488 - DNA, 23 bp, Homo sapiens
ttagtaagggctgcttattgtgg

SEQ ID NO: 12489 - DNA, 23 bp, Homo sapiens
aatgaactgtacttagaaccagg

SEQ ID NO: 12490 - DNA, 23 bp, Homo sapiens
tcagtccctgatcagatcagagg

SEQ ID NO: 12491 - DNA, 23 bp, Homo sapiens
tggtacagccaacgctattgagg

SEQ ID NO: 12492 - DNA, 23 bp, Homo sapiens
gtgggcgcagggctcagaactgg

SEQ ID NO: 12493 - DNA, 23 bp, Homo sapiens
gaacgagagcaaagcatgatggg

SEQ ID NO: 12494 - DNA, 23 bp, Homo sapiens
gactcttcttttgctctgttagg

SEQ ID NO: 12495 - DNA, 23 bp, Homo sapiens
gtggtggagaaagaatgactagg

SEQ ID NO: 12496 - DNA, 23 bp, Homo sapiens
aaacacgcaagacaaacttatgg

SEQ ID NO: 12497 - DNA, 23 bp, Homo sapiens
aagctgcaagcagaattggaggg

SEQ ID NO: 12498 - DNA, 23 bp, Homo sapiens
tgcctttaaaggaagaagatggg

SEQ ID NO: 12499 - DNA, 23 bp, Homo sapiens
ttgactcactttgaactccatgg

SEQ ID NO: 12500 - DNA, 23 bp, Homo sapiens
aggactgggagaaggacgaaggg

SEQ ID NO: 12501 - DNA, 23 bp, Homo sapiens
ggctcgcaggcacagatcctagg

SEQ ID NO: 12502 - DNA, 23 bp, Homo sapiens
ggtgggaggcgctgtttagttgg

SEQ ID NO: 12503 - DNA, 23 bp, Homo sapiens
cttcattgagaaattgggcaagg

SEQ ID NO: 12504 - DNA, 23 bp, Homo sapiens
tgaatcatcatcaagaactctgg

SEQ ID NO: 12505 - DNA, 23 bp, Homo sapiens
tgcctcagtcccaattggctagg

SEQ ID NO: 12506 - DNA, 23 bp, Homo sapiens
tctgatgttcttgtgaggcaagg

SEQ ID NO: 12507 - DNA, 23 bp, Homo sapiens
gcagaacctgagctgtgaactgg

SEQ ID NO: 12508 - DNA, 23 bp, Homo sapiens
tccatggcccagccctgagtggg

SEQ ID NO: 12509 - DNA, 23 bp, Homo sapiens
tctgtgccctgcaggcctaaggg

SEQ ID NO: 12510 - DNA, 23 bp, Homo sapiens
acagagctctcaccactcactgg

SEQ ID NO: 12511 - DNA, 23 bp, Homo sapiens
cattctggtagaggaggctttgg

SEQ ID NO: 12512 - DNA, 23 bp, Homo sapiens
ggaaagcagctctggttcagagg

SEQ ID NO: 12513 - DNA, 23 bp, Homo sapiens
tgtgcagctccgggagtgactgg

SEQ ID NO: 12514 - DNA, 23 bp, Homo sapiens
gtgcctgtcagagccctgagggg

SEQ ID NO: 12515 - DNA, 23 bp, Homo sapiens
tggaagttttgctcctttacagg

SEQ ID NO: 12516 - DNA, 23 bp, Homo sapiens
gactgcgctccagcctcagacgg

SEQ ID NO: 12517 - DNA, 23 bp, Homo sapiens
aagcactcggagagaagtctagg

SEQ ID NO: 12518 - DNA, 23 bp, Homo sapiens
gctccagcaggtctttcaatagg

SEQ ID NO: 12519 - DNA, 23 bp, Homo sapiens
cacgcagaaggacaactacaggg

SEQ ID NO: 12520 - DNA, 23 bp, Homo sapiens
atgttctacaagttcttccatgg

SEQ ID NO: 12521 - DNA, 23 bp, Homo sapiens
tcgtcagggccctgcagtgacgg

SEQ ID NO: 12522 - DNA, 23 bp, Homo sapiens
acccggccggccagctttagagg

SEQ ID NO: 12523 - DNA, 23 bp, Homo sapiens
cactttgtttgtagacagcatgg

SEQ ID NO: 12524 - DNA, 23 bp, Homo sapiens
tactggcaggcattcagtttagg

SEQ ID NO: 12525 - DNA, 23 bp, Homo sapiens
aatggttttggagctggaagggg

SEQ ID NO: 12526 - DNA, 23 bp, Homo sapiens
ttgtgggagtcagggctgagggg

SEQ ID NO: 12527 - DNA, 23 bp, Homo sapiens
gaggacagcaaggtgctagctgg

SEQ ID NO: 12528 - DNA, 23 bp, Homo sapiens
aacttcgtcttctttccttgtgg

SEQ ID NO: 12529 - DNA, 23 bp, Homo sapiens
gtggctgtgtcactgtgtcttgg

SEQ ID NO: 12530 - DNA, 23 bp, Homo sapiens
gaggtcatcgcgtctccacctgg

SEQ ID NO: 12531 - DNA, 23 bp, Homo sapiens
attcagtcagtagctgctgaagg

SEQ ID NO: 12532 - DNA, 23 bp, Homo sapiens
ctgtggtgactacagactagagg

SEQ ID NO: 12533 - DNA, 23 bp, Homo sapiens
agcaggagggagacacaacacgg

SEQ ID NO: 12534 - DNA, 23 bp, Homo sapiens
cccatgtctggcatgcctatggg

SEQ ID NO: 12535 - DNA, 23 bp, Homo sapiens
atcaactttaagctgcatacagg

SEQ ID NO: 12536 - DNA, 23 bp, Homo sapiens
gggaattttcagatcccatgtgg

SEQ ID NO: 12537 - DNA, 23 bp, Homo sapiens
gcttggctgtgtcttcagcgagg

SEQ ID NO: 12538 - DNA, 23 bp, Homo sapiens
tttagcttcagtaatgcctctgg

SEQ ID NO: 12539 - DNA, 23 bp, Homo sapiens
cgcagtcctgcttgtttacttgg

SEQ ID NO: 12540 - DNA, 23 bp, Homo sapiens
agttcaggatctggaggtgtggg

SEQ ID NO: 12541 - DNA, 23 bp, Homo sapiens
caaacagagagtgggaaggtagg

SEQ ID NO: 12542 - DNA, 23 bp, Homo sapiens
ttcagtcatcactatccgacagg

SEQ ID NO: 12543 - DNA, 23 bp, Homo sapiens
tgttctgagtcactcgctgtcgg

SEQ ID NO: 12544 - DNA, 23 bp, Homo sapiens
ccacttgggaaggcaggagaagg

SEQ ID NO: 12545 - DNA, 23 bp, Homo sapiens
catatggtggaaaaccatgatgg

SEQ ID NO: 12546 - DNA, 23 bp, Homo sapiens
tatttctctctctacaggtgagg

SEQ ID NO: 12547 - DNA, 23 bp, Homo sapiens
tggaagggaaagttcagagttgg

SEQ ID NO: 12548 - DNA, 23 bp, Homo sapiens
gacaatcaggctcagcctcctgg

SEQ ID NO: 12549 - DNA, 23 bp, Homo sapiens
tgaagaggactagggacatctgg

SEQ ID NO: 12550 - DNA, 23 bp, Homo sapiens
gtccatcaggcatttactgtagg

SEQ ID NO: 12551 - DNA, 23 bp, Homo sapiens
gctgtccctctacgacgggctgg

SEQ ID NO: 12552 - DNA, 23 bp, Homo sapiens
ggagctgtgtcatactgaggagg

SEQ ID NO: 12553 - DNA, 23 bp, Homo sapiens
ccggatttcaggaagccttgtgg

SEQ ID NO: 12554 - DNA, 23 bp, Homo sapiens
atgcatgtcagaagatctctcgg

SEQ ID NO: 12555 - DNA, 23 bp, Homo sapiens
gaccaagaacaggcttcagcagg

SEQ ID NO: 12556 - DNA, 23 bp, Homo sapiens
atatttcccacgttgttcatggg

SEQ ID NO: 12557 - DNA, 23 bp, Homo sapiens
ctaggcactcacacactgagagg

SEQ ID NO: 12558 - DNA, 23 bp, Homo sapiens
ggatctcttacggaaagtagggg

SEQ ID NO: 12559 - DNA, 23 bp, Homo sapiens
aataaagagaactctggtcctgg

SEQ ID NO: 12560 - DNA, 23 bp, Homo sapiens
tggcagctgctcatagaacaagg

SEQ ID NO: 12561 - DNA, 23 bp, Homo sapiens
ccctcgcagcagtgtctctgagg

SEQ ID NO: 12562 - DNA, 23 bp, Homo sapiens
tttatgtcataggacatgggggg

SEQ ID NO: 12563 - DNA, 23 bp, Homo sapiens
cagacagagacgtgggcctgagg

SEQ ID NO: 12564 - DNA, 23 bp, Homo sapiens
gtccatgccagcggacgtctcgg

SEQ ID NO: 12565 - DNA, 23 bp, Homo sapiens
tgcgaggaatgcaattcctgagg

SEQ ID NO: 12566 - DNA, 23 bp, Homo sapiens
catggaggtctcctgctaggcgg

SEQ ID NO: 12567 - DNA, 23 bp, Homo sapiens
catggaggtctcctgttgaatgg

SEQ ID NO: 12568 - DNA, 23 bp, Homo sapiens
gggaggagcatctgcttagcagg

SEQ ID NO: 12569 - DNA, 23 bp, Homo sapiens
gcgggatcaagggcttcaacagg

SEQ ID NO: 12570 - DNA, 23 bp, Homo sapiens
ctgtggtggccacggctacctgg

SEQ ID NO: 12571 - DNA, 23 bp, Homo sapiens
gctgggacatcagcccagactgg

SEQ ID NO: 12572 - DNA, 23 bp, Homo sapiens
gtaagactcgctgtctaggccgg

SEQ ID NO: 12573 - DNA, 23 bp, Homo sapiens
tgggtcagcctctgccatcctgg

SEQ ID NO: 12574 - DNA, 23 bp, Homo sapiens
tctgccatcgtggctgagacagg

SEQ ID NO: 12575 - DNA, 23 bp, Homo sapiens
tgatcgttactatgtgtcaaagg

SEQ ID NO: 12576 - DNA, 23 bp, Homo sapiens
aggtgggagacaagtggatctgg

SEQ ID NO: 12577 - DNA, 23 bp, Homo sapiens
tcgtgtccaagatagttgctagg

SEQ ID NO: 12578 - DNA, 23 bp, Homo sapiens
tggatctggctgaagtgaacggg

SEQ ID NO: 12579 - DNA, 23 bp, Homo sapiens
tggaagagggctaagagatctgg

SEQ ID NO: 12580 - DNA, 23 bp, Homo sapiens
caggcacagggctcacaccttgg

SEQ ID NO: 12581 - DNA, 23 bp, Homo sapiens
ttagtgggggaagacaaatatgg

SEQ ID NO: 12582 - DNA, 23 bp, Homo sapiens
tacttgtaaggtgttgaaggtgg

SEQ ID NO: 12583 - DNA, 23 bp, Homo sapiens
cggcttcatgtggtacacgtagg

SEQ ID NO: 12584 - DNA, 23 bp, Homo sapiens
gccctggagaacgttctaagtgg

SEQ ID NO: 12585 - DNA, 23 bp, Homo sapiens
tctttaactattctgcaccctgg

SEQ ID NO: 12586 - DNA, 23 bp, Homo sapiens
acagtttcttcagccactccagg

SEQ ID NO: 12587 - DNA, 23 bp, Homo sapiens
ggattacagcaagctgaagaagg

SEQ ID NO: 12588 - DNA, 23 bp, Homo sapiens
ccacgtcgcttggcactcagagg

SEQ ID NO: 12589 - DNA, 23 bp, Homo sapiens
ctcctgccgatcagtggaaatgg

SEQ ID NO: 12590 - DNA, 23 bp, Homo sapiens
ctgaatgacttcatggatcgtgg

SEQ ID NO: 12591 - DNA, 23 bp, Homo sapiens
ccgtgagggtgcagtgtcacagg

SEQ ID NO: 12592 - DNA, 23 bp, Homo sapiens
gccacggacccatctttacttgg

SEQ ID NO: 12593 - DNA, 23 bp, Homo sapiens
tgacctgggagaactgtcaaagg

SEQ ID NO: 12594 - DNA, 23 bp, Homo sapiens
caggaggcactaaatgttgacgg

SEQ ID NO: 12595 - DNA, 23 bp, Homo sapiens
atggccatggaagacgaatttgg

SEQ ID NO: 12596 - DNA, 23 bp, Homo sapiens
attctccagagcttaacccaagg

SEQ ID NO: 12597 - DNA, 23 bp, Homo sapiens
ttgtggctcttgccatctcgtgg

SEQ ID NO: 12598 - DNA, 23 bp, Homo sapiens
tggcggttcattgagcagcttgg

SEQ ID NO: 12599 - DNA, 23 bp, Homo sapiens
cgtattgctttcttgtcttcagg

SEQ ID NO: 12600 - DNA, 23 bp, Homo sapiens
tattgtgattttttccccggtgg

SEQ ID NO: 12601 - DNA, 23 bp, Homo sapiens
tggctttaatactctgactgtgg

SEQ ID NO: 12602 - DNA, 23 bp, Homo sapiens
tcttctgctgtaaagatgggtgg

SEQ ID NO: 12603 - DNA, 23 bp, Homo sapiens
ctgggtttagtgaacttgcttgg

SEQ ID NO: 12604 - DNA, 23 bp, Homo sapiens
ctggagggaggctgttaggaggg

SEQ ID NO: 12605 - DNA, 23 bp, Homo sapiens
aaaaacaggatctaacaccgagg

SEQ ID NO: 12606 - DNA, 23 bp, Homo sapiens
tttgctttcccgttggttcaagg

SEQ ID NO: 12607 - DNA, 23 bp, Homo sapiens
tctagccagtctttacttccagg

SEQ ID NO: 12608 - DNA, 23 bp, Homo sapiens
gcacccacagctgcctcaggagg

SEQ ID NO: 12609 - DNA, 23 bp, Homo sapiens
gcaactggtcactcatcctctgg

SEQ ID NO: 12610 - DNA, 23 bp, Homo sapiens
ctcctgatgatgaagactgaagg

SEQ ID NO: 12611 - DNA, 23 bp, Homo sapiens
tatctttattcagggactccagg

SEQ ID NO: 12612 - DNA, 23 bp, Homo sapiens
attgccagacttaatatgagagg

SEQ ID NO: 12613 - DNA, 23 bp, Homo sapiens
tgggagctctgtgtggatttggg

SEQ ID NO: 12614 - DNA, 23 bp, Homo sapiens
atgtgagaggagatggaccctgg

SEQ ID NO: 12615 - DNA, 23 bp, Homo sapiens
taattgtcaggagttgctttcgg

SEQ ID NO: 12616 - DNA, 23 bp, Homo sapiens
tcaggaaattctttcattggtgg

SEQ ID NO: 12617 - DNA, 23 bp, Homo sapiens
gtggggggtgcaccccctacagg

SEQ ID NO: 12618 - DNA, 23 bp, Homo sapiens
cctcttcctcactcagcccaagg

SEQ ID NO: 12619 - DNA, 23 bp, Homo sapiens
gttcactatgagatctgaggagg

SEQ ID NO: 12620 - DNA, 23 bp, Homo sapiens
gaggtctctctctttctacatgg

SEQ ID NO: 12621 - DNA, 23 bp, Homo sapiens
aacccaactttcagccagtcagg

SEQ ID NO: 12622 - DNA, 23 bp, Homo sapiens
gtacaaaagaagaaatgggctgg

SEQ ID NO: 12623 - DNA, 23 bp, Homo sapiens
gaagacttcaacgtattggatgg

SEQ ID NO: 12624 - DNA, 23 bp, Homo sapiens
tcgccagcttctatatattacgg

SEQ ID NO: 12625 - DNA, 23 bp, Homo sapiens
tgctcctgaggatcaccaccagg

SEQ ID NO: 12626 - DNA, 23 bp, Homo sapiens
ctagtagaagcttcagcatatgg

SEQ ID NO: 12627 - DNA, 23 bp, Homo sapiens
ggagaagtagatcggtgagcagg

SEQ ID NO: 12628 - DNA, 23 bp, Homo sapiens
ggatacctctactacacaatagg

SEQ ID NO: 12629 - DNA, 23 bp, Homo sapiens
atgcgttccctggagctacttgg

SEQ ID NO: 12630 - DNA, 23 bp, Homo sapiens
agagtatccacaaaataggttgg

SEQ ID NO: 12631 - DNA, 23 bp, Homo sapiens
ggaaaatcctttgatgggttggg

SEQ ID NO: 12632 - DNA, 23 bp, Homo sapiens
agctgctctgttcagggccgagg

SEQ ID NO: 12633 - DNA, 23 bp, Homo sapiens
cggcgtgccacacgctctagtgg

SEQ ID NO: 12634 - DNA, 23 bp, Homo sapiens
ggcggcggcggcgctacctgcgg

SEQ ID NO: 12635 - DNA, 23 bp, Homo sapiens
tccaggctgactacttgtatcgg

SEQ ID NO: 12636 - DNA, 23 bp, Homo sapiens
ggccagggtggtgggctaagagg

SEQ ID NO: 12637 - DNA, 23 bp, Homo sapiens
cctggatttggtgtacaagcagg

SEQ ID NO: 12638 - DNA, 23 bp, Homo sapiens
gggagtcacctcgacactgaggg

SEQ ID NO: 12639 - DNA, 23 bp, Homo sapiens
atagcttcaacgtagttggctgg

SEQ ID NO: 12640 - DNA, 23 bp, Homo sapiens
acaaactcaatgtaattcgctgg

SEQ ID NO: 12641 - DNA, 23 bp, Homo sapiens
aggagacctcgtcttcatcctgg

SEQ ID NO: 12642 - DNA, 23 bp, Homo sapiens
ctaggaacatctagttgttcagg

SEQ ID NO: 12643 - DNA, 23 bp, Homo sapiens
tgcttggtgcacggtgggacggg

SEQ ID NO: 12644 - DNA, 23 bp, Homo sapiens
gttattcattatccaccaggagg

SEQ ID NO: 12645 - DNA, 23 bp, Homo sapiens
caactgggtccagttctgaatgg

SEQ ID NO: 12646 - DNA, 23 bp, Homo sapiens
aaccgtgctcaggtcagaactgg

SEQ ID NO: 12647 - DNA, 23 bp, Homo sapiens
cctcagctggcctgtgtttgggg

SEQ ID NO: 12648 - DNA, 23 bp, Homo sapiens
acaagagctaggatgttctgagg

SEQ ID NO: 12649 - DNA, 23 bp, Homo sapiens
ctttcatttccaagaaggagtgg

SEQ ID NO: 12650 - DNA, 23 bp, Homo sapiens
gtaaggacaaccgaacctcgagg

SEQ ID NO: 12651 - DNA, 23 bp, Homo sapiens
cgggcagtttatgtgtgacctgg

SEQ ID NO: 12652 - DNA, 23 bp, Homo sapiens
catggcagctcacacatacatgg

SEQ ID NO: 12653 - DNA, 23 bp, Homo sapiens
aatcacacataatgttctcgtgg

SEQ ID NO: 12654 - DNA, 23 bp, Homo sapiens
atcctcgatgtcagcagttgagg

SEQ ID NO: 12655 - DNA, 23 bp, Homo sapiens
ccgtaatttccaggagggagtgg

SEQ ID NO: 12656 - DNA, 23 bp, Homo sapiens
aggcaggcctgggtcagaccagg

SEQ ID NO: 12657 - DNA, 23 bp, Homo sapiens
ctcagtgaatgaaggtttagtgg

SEQ ID NO: 12658 - DNA, 23 bp, Homo sapiens
gaaaacacccagggctttgatgg

SEQ ID NO: 12659 - DNA, 23 bp, Homo sapiens
tgctcaaggatttgaaggggtgg

SEQ ID NO: 12660 - DNA, 23 bp, Homo sapiens
gaggtggtcttaggcagtgatgg

SEQ ID NO: 12661 - DNA, 23 bp, Homo sapiens
caagcgctctttgctggagatgg

SEQ ID NO: 12662 - DNA, 23 bp, Homo sapiens
ttcagtggaggttcacaagctgg

SEQ ID NO: 12663 - DNA, 23 bp, Homo sapiens
aaggccgccaaggggaagtaagg

SEQ ID NO: 12664 - DNA, 23 bp, Homo sapiens
gaaagttgaaggtgctggggagg

SEQ ID NO: 12665 - DNA, 23 bp, Homo sapiens
gactcaaatcttagtcactctgg

SEQ ID NO: 12666 - DNA, 23 bp, Homo sapiens
attgtagaatggcattcttcagg

SEQ ID NO: 12667 - DNA, 23 bp, Homo sapiens
ggggacctcagcctcttagcagg

SEQ ID NO: 12668 - DNA, 23 bp, Homo sapiens
acaatcatttgctgaagcagagg

SEQ ID NO: 12669 - DNA, 23 bp, Homo sapiens
gagcagtgccagttctcctaagg

SEQ ID NO: 12670 - DNA, 23 bp, Homo sapiens
atctacagatattagcatccagg

SEQ ID NO: 12671 - DNA, 23 bp, Homo sapiens
cttcatttagtcatggcagatgg

SEQ ID NO: 12672 - DNA, 23 bp, Homo sapiens
aggagccagcacgttttatgtgg

SEQ ID NO: 12673 - DNA, 23 bp, Homo sapiens
tcttttggttgggtgattcttgg

SEQ ID NO: 12674 - DNA, 23 bp, Homo sapiens
acatctgaccttggataccatgg

SEQ ID NO: 12675 - DNA, 23 bp, Homo sapiens
gaggatgccacatctgaccttgg

SEQ ID NO: 12676 - DNA, 23 bp, Homo sapiens
gcaactgctcttcaaagtacagg

SEQ ID NO: 12677 - DNA, 23 bp, Homo sapiens
ttttgatagttgcctagagatgg

SEQ ID NO: 12678 - DNA, 23 bp, Homo sapiens
atcctgggcatgcgctagccagg

SEQ ID NO: 12679 - DNA, 23 bp, Homo sapiens
tcaacttggtcaacagaagctgg

SEQ ID NO: 12680 - DNA, 23 bp, Homo sapiens
tgggcaacaaagtgagactctgg

SEQ ID NO: 12681 - DNA, 23 bp, Homo sapiens
tcaggcattatctgtcgcacagg

SEQ ID NO: 12682 - DNA, 23 bp, Homo sapiens
ggaggatgaatttgatagagagg

SEQ ID NO: 12683 - DNA, 23 bp, Homo sapiens
gtacgtttgcgggagcacatggg

SEQ ID NO: 12684 - DNA, 23 bp, Homo sapiens
gagaagtagactatcacatcagg

SEQ ID NO: 12685 - DNA, 23 bp, Homo sapiens
gtgcatccacgctcaggtgctgg

SEQ ID NO: 12686 - DNA, 23 bp, Homo sapiens
atgtttatgacgtagcaaagagg

SEQ ID NO: 12687 - DNA, 23 bp, Homo sapiens
ggtgaatccgggtgcctcagggg

SEQ ID NO: 12688 - DNA, 23 bp, Homo sapiens
aggctcaggagactagaggctgg

SEQ ID NO: 12689 - DNA, 23 bp, Homo sapiens
caggtggttctaggacacattgg

SEQ ID NO: 12690 - DNA, 23 bp, Homo sapiens
ccgcccctgccccgctctgaggg

SEQ ID NO: 12691 - DNA, 23 bp, Homo sapiens
aggcgagcatgaccctgtgacgg

SEQ ID NO: 12692 - DNA, 23 bp, Homo sapiens
aaccttgtggatggcttctaggg

SEQ ID NO: 12693 - DNA, 23 bp, Homo sapiens
tggaagagtctgttgttctgtgg

SEQ ID NO: 12694 - DNA, 23 bp, Homo sapiens
gttaacttcacagttcctgaagg

SEQ ID NO: 12695 - DNA, 23 bp, Homo sapiens
gcagacactttcactttgccagg

SEQ ID NO: 12696 - DNA, 23 bp, Homo sapiens
acagaacaactttctaacctagg

SEQ ID NO: 12697 - DNA, 23 bp, Homo sapiens
gtcgcatgtcaggcagtactcgg

SEQ ID NO: 12698 - DNA, 23 bp, Homo sapiens
ccagccccattttgacatcaagg

SEQ ID NO: 12699 - DNA, 23 bp, Homo sapiens
atgctgttgtgatagcgtttagg

SEQ ID NO: 12700 - DNA, 23 bp, Homo sapiens
aatgtcatctgtctccttaatgg

SEQ ID NO: 12701 - DNA, 23 bp, Homo sapiens
ctggtcctcaggggaggactagg

SEQ ID NO: 12702 - DNA, 23 bp, Homo sapiens
tggcaaacggaaagagactttgg

SEQ ID NO: 12703 - DNA, 23 bp, Homo sapiens
aaggagtttgccttttattcagg

SEQ ID NO: 12704 - DNA, 23 bp, Homo sapiens
gtttgcttagagacccaatgagg

SEQ ID NO: 12705 - DNA, 23 bp, Homo sapiens
agcagaagattagaagtcaatgg

SEQ ID NO: 12706 - DNA, 23 bp, Homo sapiens
tggccaaaatcagtgtctatggg

SEQ ID NO: 12707 - DNA, 23 bp, Homo sapiens
cactgaggcaggtactcagctgg

SEQ ID NO: 12708 - DNA, 23 bp, Homo sapiens
aattggcttgggttcctaccagg

SEQ ID NO: 12709 - DNA, 23 bp, Homo sapiens
gtgctgctggccctcctgacagg

SEQ ID NO: 12710 - DNA, 23 bp, Homo sapiens
ccgcaacgggctaggagctgcgg

SEQ ID NO: 12711 - DNA, 23 bp, Homo sapiens
aggacgtcattaagatctacagg

SEQ ID NO: 12712 - DNA, 23 bp, Homo sapiens
ccacctgcccaaagaacttaagg

SEQ ID NO: 12713 - DNA, 23 bp, Homo sapiens
tgctcctttgtatcactaggcgg

SEQ ID NO: 12714 - DNA, 23 bp, Homo sapiens
cgccccgctctgggccgtgatgg

SEQ ID NO: 12715 - DNA, 23 bp, Homo sapiens
ggttgaggaaggctcatgaaagg

SEQ ID NO: 12716 - DNA, 23 bp, Homo sapiens
gctggtacgggtggaatgagggg

SEQ ID NO: 12717 - DNA, 23 bp, Homo sapiens
catgaaatatggcattgagctgg

SEQ ID NO: 12718 - DNA, 23 bp, Homo sapiens
cgaccggggccccatgtacgagg

SEQ ID NO: 12719 - DNA, 23 bp, Homo sapiens
aatacagtcttcactgagtgagg

SEQ ID NO: 12720 - DNA, 23 bp, Homo sapiens
catcttgcattgtgagagattgg

SEQ ID NO: 12721 - DNA, 23 bp, Homo sapiens
agtgtctacaaagggcctagtgg

SEQ ID NO: 12722 - DNA, 23 bp, Homo sapiens
gcagctctagatacaatccctgg

SEQ ID NO: 12723 - DNA, 23 bp, Homo sapiens
ctgcttgagcccaggcagtctgg

SEQ ID NO: 12724 - DNA, 23 bp, Homo sapiens
cgagtctcttcttcaaacacagg

SEQ ID NO: 12725 - DNA, 23 bp, Homo sapiens
gaaactttcccagaagatggagg

SEQ ID NO: 12726 - DNA, 23 bp, Homo sapiens
gtgcagaagcaaagaagcgctgg

SEQ ID NO: 12727 - DNA, 23 bp, Homo sapiens
tgctcctgtagaaacattttggg

SEQ ID NO: 12728 - DNA, 23 bp, Homo sapiens
cttctttgaagagctctagcagg

SEQ ID NO: 12729 - DNA, 23 bp, Homo sapiens
ttgagggctcaaatgcagatagg

SEQ ID NO: 12730 - DNA, 23 bp, Homo sapiens
atggcaaggagggctttagcagg

SEQ ID NO: 12731 - DNA, 23 bp, Homo sapiens
ctatctactctctggcctaacgg

SEQ ID NO: 12732 - DNA, 23 bp, Homo sapiens
gggtggggctggtcagtgccagg

SEQ ID NO: 12733 - DNA, 23 bp, Homo sapiens
cttgactggctccttttaactgg

SEQ ID NO: 12734 - DNA, 23 bp, Homo sapiens
ctgctgtggcagcagggccgggg

SEQ ID NO: 12735 - DNA, 23 bp, Homo sapiens
gccgtgaacatgagcgcgtgggg

SEQ ID NO: 12736 - DNA, 23 bp, Homo sapiens
tccaatgtggcaactaggagtgg

SEQ ID NO: 12737 - DNA, 23 bp, Homo sapiens
tgatagacacacaccttagctgg

SEQ ID NO: 12738 - DNA, 23 bp, Homo sapiens
ttttacgtctgatttctggcagg

SEQ ID NO: 12739 - DNA, 23 bp, Homo sapiens
ggggacctcattgaggtctgggg

SEQ ID NO: 12740 - DNA, 23 bp, Homo sapiens
ctcctttctggagaatctagagg

SEQ ID NO: 12741 - DNA, 23 bp, Homo sapiens
tcccagcaggaagatatctgagg

SEQ ID NO: 12742 - DNA, 23 bp, Homo sapiens
tggatttaggaagatctgatggg

SEQ ID NO: 12743 - DNA, 23 bp, Homo sapiens
acagttcacgtggttcaggcagg

SEQ ID NO: 12744 - DNA, 23 bp, Homo sapiens
ttgctctgcatgtttgctgaggg

SEQ ID NO: 12745 - DNA, 23 bp, Homo sapiens
atggaggccacagactgagctgg

SEQ ID NO: 12746 - DNA, 23 bp, Homo sapiens
ttccccaggctcactttctccgg

SEQ ID NO: 12747 - DNA, 23 bp, Homo sapiens
aacatctggcttcttacttttgg

SEQ ID NO: 12748 - DNA, 23 bp, Homo sapiens
ctcactttctctttcccttttgg

SEQ ID NO: 12749 - DNA, 23 bp, Homo sapiens
catcgcttcatctgagccaaggg

SEQ ID NO: 12750 - DNA, 23 bp, Homo sapiens
cccttctcaactctgtaacatgg

SEQ ID NO: 12751 - DNA, 23 bp, Homo sapiens
gacgctgcaacttttatcccagg

SEQ ID NO: 12752 - DNA, 23 bp, Homo sapiens
aagcagaaacaagcaactgaggg

SEQ ID NO: 12753 - DNA, 23 bp, Homo sapiens
tcctggtacctgggctagcttgg

SEQ ID NO: 12754 - DNA, 23 bp, Homo sapiens
aaccgttcctttgtgggattagg

SEQ ID NO: 12755 - DNA, 23 bp, Homo sapiens
cctttgctatcccagataccagg

SEQ ID NO: 12756 - DNA, 23 bp, Homo sapiens
caatctctgcttcagactctggg

SEQ ID NO: 12757 - DNA, 23 bp, Homo sapiens
tcttttgtcgatcttatcagagg

SEQ ID NO: 12758 - DNA, 23 bp, Homo sapiens
tgttcagaaagttgccgtcccgg

SEQ ID NO: 12759 - DNA, 23 bp, Homo sapiens
ggctaaattttgccttctagagg

SEQ ID NO: 12760 - DNA, 23 bp, Homo sapiens
gcagcaggtcagtgcacctgagg

SEQ ID NO: 12761 - DNA, 23 bp, Homo sapiens
gcgctcataacgtcagacgctgg

SEQ ID NO: 12762 - DNA, 23 bp, Homo sapiens
acaatgaaacaaatcacacgggg

SEQ ID NO: 12763 - DNA, 23 bp, Homo sapiens
gtctgggtttgagtcctaagagg

SEQ ID NO: 12764 - DNA, 23 bp, Homo sapiens
agaccctgcctggcttcagtcgg

SEQ ID NO: 12765 - DNA, 23 bp, Homo sapiens
ttcttccctagggtcacttgagg

SEQ ID NO: 12766 - DNA, 23 bp, Homo sapiens
ccaagctaatggagctaatacgg

SEQ ID NO: 12767 - DNA, 23 bp, Homo sapiens
tctcataatcattgttgctcagg

SEQ ID NO: 12768 - DNA, 23 bp, Homo sapiens
gggccctattcttctagtgttgg

SEQ ID NO: 12769 - DNA, 23 bp, Homo sapiens
ggaggtagaaggcgtagaacagg

SEQ ID NO: 12770 - DNA, 23 bp, Homo sapiens
catcatgatcttcttagtcctgg

SEQ ID NO: 12771 - DNA, 23 bp, Homo sapiens
tgctataaacatgcgtgtgcagg

SEQ ID NO: 12772 - DNA, 23 bp, Homo sapiens
gacatcatgggtgatgtaccagg

SEQ ID NO: 12773 - DNA, 23 bp, Homo sapiens
tggcgtggggttaggacactcgg

SEQ ID NO: 12774 - DNA, 23 bp, Homo sapiens
attttgttgttgaccgtctgtgg

SEQ ID NO: 12775 - DNA, 23 bp, Homo sapiens
cccaggtgaccggcgactgaggg

SEQ ID NO: 12776 - DNA, 23 bp, Homo sapiens
aggctgggatggcgagtaagagg

SEQ ID NO: 12777 - DNA, 23 bp, Homo sapiens
cagaaaggtcggaagaaaaaagg

SEQ ID NO: 12778 - DNA, 23 bp, Homo sapiens
gtgggggtcattgccgattccgg

SEQ ID NO: 12779 - DNA, 23 bp, Homo sapiens
tgtgtgtgtgctcagcaggaagg

SEQ ID NO: 12780 - DNA, 23 bp, Homo sapiens
ctccccggttgggctcacaccgg

SEQ ID NO: 12781 - DNA, 23 bp, Homo sapiens
tggtgccactgaagttattttgg

SEQ ID NO: 12782 - DNA, 23 bp, Homo sapiens
ttaagctttgtctaaacagctgg

SEQ ID NO: 12783 - DNA, 23 bp, Homo sapiens
ttcctgtacagaatttgagtcgg

SEQ ID NO: 12784 - DNA, 23 bp, Homo sapiens
gattaactgaagagaccccttgg

SEQ ID NO: 12785 - DNA, 23 bp, Homo sapiens
gagttcagacgtccagcacgtgg

SEQ ID NO: 12786 - DNA, 23 bp, Homo sapiens
cacgtcctggacgtgtagggcgg

SEQ ID NO: 12787 - DNA, 23 bp, Homo sapiens
taaagttgactgggggtgatggg

SEQ ID NO: 12788 - DNA, 23 bp, Homo sapiens
gcatagctccagtagagctcagg

SEQ ID NO: 12789 - DNA, 23 bp, Homo sapiens
gcagtctatgtagcagaaattgg

SEQ ID NO: 12790 - DNA, 23 bp, Homo sapiens
tgtctgggtcctgtgggtggggg

SEQ ID NO: 12791 - DNA, 23 bp, Homo sapiens
gggcttgaccattatcacacagg

SEQ ID NO: 12792 - DNA, 23 bp, Homo sapiens
gtgctaccggagcccctcatagg

SEQ ID NO: 12793 - DNA, 23 bp, Homo sapiens
aggcagtctatgttgaactctgg

SEQ ID NO: 12794 - DNA, 23 bp, Homo sapiens
tctctgagcgaggagagttaggg

SEQ ID NO: 12795 - DNA, 23 bp, Homo sapiens
agaccactaacccactggctcgg

SEQ ID NO: 12796 - DNA, 23 bp, Homo sapiens
cttgctctcctacacttgaatgg

SEQ ID NO: 12797 - DNA, 23 bp, Homo sapiens
ttcgatacagtcaactcccaagg

SEQ ID NO: 12798 - DNA, 23 bp, Homo sapiens
gtctacccctactgcccaacagg

SEQ ID NO: 12799 - DNA, 23 bp, Homo sapiens
tgacagggaccctcttcaggtgg

SEQ ID NO: 12800 - DNA, 23 bp, Homo sapiens
agaggatgacatttattccttgg

SEQ ID NO: 12801 - DNA, 23 bp, Homo sapiens
ctcaaacacctacacattcacgg

SEQ ID NO: 12802 - DNA, 23 bp, Homo sapiens
aagggtcccgtgtctacagaggg

SEQ ID NO: 12803 - DNA, 23 bp, Homo sapiens
aatagcagcccagttttcacagg

SEQ ID NO: 12804 - DNA, 23 bp, Homo sapiens
tggtttggctatgacctcaaagg

SEQ ID NO: 12805 - DNA, 23 bp, Homo sapiens
tgtaaaactggagttaaagctgg

SEQ ID NO: 12806 - DNA, 23 bp, Homo sapiens
ctacggatggccactggctctgg

SEQ ID NO: 12807 - DNA, 23 bp, Homo sapiens
gtcccaggctgcattcagagagg

SEQ ID NO: 12808 - DNA, 23 bp, Homo sapiens
taatctgtctttacacagagagg

SEQ ID NO: 12809 - DNA, 23 bp, Homo sapiens
cagacattggggaatatgtgcgg

SEQ ID NO: 12810 - DNA, 23 bp, Homo sapiens
tagatttgttcatctccccaagg

SEQ ID NO: 12811 - DNA, 23 bp, Homo sapiens
gaaaatgtctcccgaagaaatgg

SEQ ID NO: 12812 - DNA, 23 bp, Homo sapiens
gtaacgtcatcattgtatcctgg

SEQ ID NO: 12813 - DNA, 23 bp, Homo sapiens
ccaaagtggagagaagaaagagg

SEQ ID NO: 12814 - DNA, 23 bp, Homo sapiens
taggataagctatgtgaatctgg

SEQ ID NO: 12815 - DNA, 23 bp, Homo sapiens
aggcgagtctcattccttcttgg

SEQ ID NO: 12816 - DNA, 23 bp, Homo sapiens
caggtgcttgaattactcaaagg

SEQ ID NO: 12817 - DNA, 23 bp, Homo sapiens
cttgtcttgctctgtcacccagg

SEQ ID NO: 12818 - DNA, 23 bp, Homo sapiens
catattccaagcttcaggaatgg

SEQ ID NO: 12819 - DNA, 23 bp, Homo sapiens
cttcaggggtgaggcggaggagg

SEQ ID NO: 12820 - DNA, 23 bp, Homo sapiens
ttagctggaagtcccatccttgg

SEQ ID NO: 12821 - DNA, 23 bp, Homo sapiens
tgtaggcagcatcactgcagagg

SEQ ID NO: 12822 - DNA, 23 bp, Homo sapiens
tagaaactctacagctttactgg

SEQ ID NO: 12823 - DNA, 23 bp, Homo sapiens
ttcagtggtgaaaacgatgtagg

SEQ ID NO: 12824 - DNA, 23 bp, Homo sapiens
ttcaatggtgaaaatgatgcagg

SEQ ID NO: 12825 - DNA, 23 bp, Homo sapiens
gatgtgggcatcagagcaattgg

SEQ ID NO: 12826 - DNA, 23 bp, Homo sapiens
gcttcactcactcatctccgagg

SEQ ID NO: 12827 - DNA, 23 bp, Homo sapiens
tggctgtggcctgggctagccgg

SEQ ID NO: 12828 - DNA, 23 bp, Homo sapiens
gaagtcaagtcttaagacagtgg

SEQ ID NO: 12829 - DNA, 23 bp, Homo sapiens
tgccctacgtcaccctcaagagg

SEQ ID NO: 12830 - DNA, 23 bp, Homo sapiens
gcgatcagacctctatgctgtgg

SEQ ID NO: 12831 - DNA, 23 bp, Homo sapiens
gctgcagcctctgtacacgtcgg

SEQ ID NO: 12832 - DNA, 23 bp, Homo sapiens
tgtaaatgagatgtcttctgagg

SEQ ID NO: 12833 - DNA, 23 bp, Homo sapiens
cggctgctgaacttgacttaggg

SEQ ID NO: 12834 - DNA, 23 bp, Homo sapiens
agctgtttcctcacttacgcagg

SEQ ID NO: 12835 - DNA, 23 bp, Homo sapiens
ttacagaaagaccaaagggaagg

SEQ ID NO: 12836 - DNA, 23 bp, Homo sapiens
tctttttgtgcaccatctctcgg

SEQ ID NO: 12837 - DNA, 23 bp, Homo sapiens
ctggggaggggctctatgtctgg

SEQ ID NO: 12838 - DNA, 23 bp, Homo sapiens
gcttggcagtggcgctaggacgg

SEQ ID NO: 12839 - DNA, 23 bp, Homo sapiens
tagccaagtctgcagtcagacgg

SEQ ID NO: 12840 - DNA, 23 bp, Homo sapiens
gctcttgccttctgctcacaagg

SEQ ID NO: 12841 - DNA, 23 bp, Homo sapiens
tgcctgggaggaaaaacaaaggg

SEQ ID NO: 12842 - DNA, 23 bp, Homo sapiens
ggcagctcttcagccatccaagg

SEQ ID NO: 12843 - DNA, 23 bp, Homo sapiens
ggggctgggtgagtggaattagg

SEQ ID NO: 12844 - DNA, 23 bp, Homo sapiens
cagcccaggtgggccttaaatgg

SEQ ID NO: 12845 - DNA, 23 bp, Homo sapiens
gaggcataacaagctcgtaatgg

SEQ ID NO: 12846 - DNA, 23 bp, Homo sapiens
actgtatctgctgctctcactgg

SEQ ID NO: 12847 - DNA, 23 bp, Homo sapiens
gaggtgcggcgcgtagaaggcgg

SEQ ID NO: 12848 - DNA, 23 bp, Homo sapiens
gggctccggattcatagacgcgg

SEQ ID NO: 12849 - DNA, 23 bp, Homo sapiens
atacggtcggacctggtgagagg

SEQ ID NO: 12850 - DNA, 23 bp, Homo sapiens
tccaggcccagcagtggacttgg

SEQ ID NO: 12851 - DNA, 23 bp, Homo sapiens
tgacccgccccgtccctaccagg

SEQ ID NO: 12852 - DNA, 23 bp, Homo sapiens
acctgctctatggcaggacgtgg

SEQ ID NO: 12853 - DNA, 23 bp, Homo sapiens
acgcgggtcccttccctaccagg

SEQ ID NO: 12854 - DNA, 23 bp, Homo sapiens
cttttcggctctagggtccttgg

SEQ ID NO: 12855 - DNA, 23 bp, Homo sapiens
tcggtggctcccagtgcacttgg

SEQ ID NO: 12856 - DNA, 23 bp, Homo sapiens
cgctgcagggtgtcagggcctgg

SEQ ID NO: 12857 - DNA, 23 bp, Homo sapiens
ctggtctcctggaactggtgagg

SEQ ID NO: 12858 - DNA, 23 bp, Homo sapiens
gcagctggagcccagctttttgg

SEQ ID NO: 12859 - DNA, 23 bp, Homo sapiens
ctcagcccaagcgggttcactgg

SEQ ID NO: 12860 - DNA, 23 bp, Homo sapiens
ggcgttcaggatgagctctccgg

SEQ ID NO: 12861 - DNA, 23 bp, Homo sapiens
ccaccccgcgggtcctcacaagg

SEQ ID NO: 12862 - DNA, 23 bp, Homo sapiens
gtcagacgctgtgcgctcccagg

SEQ ID NO: 12863 - DNA, 23 bp, Homo sapiens
gtgggaaggacaaatgcctccgg

SEQ ID NO: 12864 - DNA, 23 bp, Homo sapiens
tctcttatctggctataccctgg

SEQ ID NO: 12865 - DNA, 23 bp, Homo sapiens
ctccaccactcgggtataggggg

SEQ ID NO: 12866 - DNA, 23 bp, Homo sapiens
ctctgagttggagctatacccgg

SEQ ID NO: 12867 - DNA, 23 bp, Homo sapiens
agggcaaagctatactctagtgg

SEQ ID NO: 12868 - DNA, 23 bp, Homo sapiens
agggaaaagctatactctagtgg

SEQ ID NO: 12869 - DNA, 23 bp, Homo sapiens
tgcaagaggcacgtttgtgtggg

SEQ ID NO: 12870 - DNA, 23 bp, Homo sapiens
ctcctctggtgtgggagtgatgg

SEQ ID NO: 12871 - DNA, 23 bp, Homo sapiens
ggcctgcatgctccgtgaactgg

SEQ ID NO: 12872 - DNA, 23 bp, Homo sapiens
tcacatttcaacagtgcacgtgg

SEQ ID NO: 12873 - DNA, 23 bp, Homo sapiens
aagaagctaggcttgttgggtgg

SEQ ID NO: 12874 - DNA, 23 bp, Homo sapiens
aggccccttggggtacttgatgg

SEQ ID NO: 12875 - DNA, 23 bp, Homo sapiens
tgctgggcactagtatctcctgg

SEQ ID NO: 12876 - DNA, 23 bp, Homo sapiens
ttgatacttcagctgctgagtgg

SEQ ID NO: 12877 - DNA, 23 bp, Homo sapiens
tggaaaaggcagagggacagagg

SEQ ID NO: 12878 - DNA, 23 bp, Homo sapiens
tacgtacaacatgatcaaagggg

SEQ ID NO: 12879 - DNA, 23 bp, Homo sapiens
tttggacattggctgctgaatgg

SEQ ID NO: 12880 - DNA, 23 bp, Homo sapiens
catgcaggctgcagaaactcggg

SEQ ID NO: 12881 - DNA, 23 bp, Homo sapiens
cctctctcactacattgtgcagg

SEQ ID NO: 12882 - DNA, 23 bp, Homo sapiens
aagaagatgtgtcttggtggtgg

SEQ ID NO: 12883 - DNA, 23 bp, Homo sapiens
atcatgaagtcatgagaagaagg

SEQ ID NO: 12884 - DNA, 23 bp, Homo sapiens
catgtttctcagttatcagcagg

SEQ ID NO: 12885 - DNA, 23 bp, Homo sapiens
cgtctttgagccttcttggtagg

SEQ ID NO: 12886 - DNA, 23 bp, Homo sapiens
cgactgtgacacaatcacaaggg

SEQ ID NO: 12887 - DNA, 23 bp, Homo sapiens
atgaagatgaccggtactggtgg

SEQ ID NO: 12888 - DNA, 23 bp, Homo sapiens
ctggccaccagagcctcagaagg

SEQ ID NO: 12889 - DNA, 23 bp, Homo sapiens
cagcaaaaaaagtcacagcacgg

SEQ ID NO: 12890 - DNA, 23 bp, Homo sapiens
cctatcccagattaatccttagg

SEQ ID NO: 12891 - DNA, 23 bp, Homo sapiens
aggggtgtgctcctctgatgggg

SEQ ID NO: 12892 - DNA, 23 bp, Homo sapiens
ctggagcagctgggaagctctgg

SEQ ID NO: 12893 - DNA, 23 bp, Homo sapiens
gctcaggatttacatccagatgg

SEQ ID NO: 12894 - DNA, 23 bp, Homo sapiens
tttggggtgcggggcggctgagg

SEQ ID NO: 12895 - DNA, 23 bp, Homo sapiens
gcacagcatgaagcaggaaatgg

SEQ ID NO: 12896 - DNA, 23 bp, Homo sapiens
caagatgccactggtgaagaagg

SEQ ID NO: 12897 - DNA, 23 bp, Homo sapiens
cactgaggggccaagtgtggtgg

SEQ ID NO: 12898 - DNA, 23 bp, Homo sapiens
gaactggatctatgaatgacagg

SEQ ID NO: 12899 - DNA, 23 bp, Homo sapiens
tgactgggtctatgaataagagg

SEQ ID NO: 12900 - DNA, 23 bp, Homo sapiens
ctcagggccggttgtggccatgg

SEQ ID NO: 12901 - DNA, 23 bp, Homo sapiens
cactggctgtatgagtagcccgg

SEQ ID NO: 12902 - DNA, 23 bp, Homo sapiens
gggcagcttgagcctcaggctgg

SEQ ID NO: 12903 - DNA, 23 bp, Homo sapiens
caggcttcatgtgcaccctgagg

SEQ ID NO: 12904 - DNA, 23 bp, Homo sapiens
acgtgatccagcgctttgagagg

SEQ ID NO: 12905 - DNA, 23 bp, Homo sapiens
aaggttcttctacaattggatgg

SEQ ID NO: 12906 - DNA, 23 bp, Homo sapiens
ggaggtgtccactatgtagctgg

SEQ ID NO: 12907 - DNA, 23 bp, Homo sapiens
ttcatagacctgcatcaggctgg

SEQ ID NO: 12908 - DNA, 23 bp, Homo sapiens
gccagaggatggcctattagagg

SEQ ID NO: 12909 - DNA, 23 bp, Homo sapiens
tagactctttgaggatcctgagg

SEQ ID NO: 12910 - DNA, 23 bp, Homo sapiens
cctgaggatgtggattgagatgg

SEQ ID NO: 12911 - DNA, 23 bp, Homo sapiens
aggtcagtgatcttcaaccttgg

SEQ ID NO: 12912 - DNA, 23 bp, Homo sapiens
tcttcaaagtatgctatgtgagg

SEQ ID NO: 12913 - DNA, 23 bp, Homo sapiens
ggcctggaaggaagaggaagtgg

SEQ ID NO: 12914 - DNA, 23 bp, Homo sapiens
cactgcagaagctaagacatagg

SEQ ID NO: 12915 - DNA, 23 bp, Homo sapiens
gaggacgaggggctgctagccgg

SEQ ID NO: 12916 - DNA, 23 bp, Homo sapiens
gagggcaagacaagctagggagg

SEQ ID NO: 12917 - DNA, 23 bp, Homo sapiens
agcaagtagctctttccgtctgg

SEQ ID NO: 12918 - DNA, 23 bp, Homo sapiens
cgaggcgggcaggtcacagcagg

SEQ ID NO: 12919 - DNA, 23 bp, Homo sapiens
ggatggaacaaaatctgaagagg

SEQ ID NO: 12920 - DNA, 23 bp, Homo sapiens
acgctcacatgctgtcctgctgg

SEQ ID NO: 12921 - DNA, 23 bp, Homo sapiens
tggaagaaacattgaagatgagg

SEQ ID NO: 12922 - DNA, 23 bp, Homo sapiens
agcatgggggcagagaaggttgg

SEQ ID NO: 12923 - DNA, 23 bp, Homo sapiens
tggactagtactacaatagatgg

SEQ ID NO: 12924 - DNA, 23 bp, Homo sapiens
tcagcagggttcatttaaaatgg

SEQ ID NO: 12925 - DNA, 23 bp, Homo sapiens
agagaccgatccatcctgagtgg

SEQ ID NO: 12926 - DNA, 23 bp, Homo sapiens
ttgacatctgttcactagagagg

SEQ ID NO: 12927 - DNA, 23 bp, Homo sapiens
cacttggcaaggtcagtgagggg

SEQ ID NO: 12928 - DNA, 23 bp, Homo sapiens
ctgggagctggggcctcagttgg

SEQ ID NO: 12929 - DNA, 23 bp, Homo sapiens
tgcctatgcccagatctcagggg

SEQ ID NO: 12930 - DNA, 23 bp, Homo sapiens
attgaggtcacaggcatcacagg

SEQ ID NO: 12931 - DNA, 23 bp, Homo sapiens
aggattctctaactttcgcctgg

SEQ ID NO: 12932 - DNA, 23 bp, Homo sapiens
tacaacgtgaggaagaagaaagg

SEQ ID NO: 12933 - DNA, 23 bp, Homo sapiens
aaacttctttctggaagcgttgg

SEQ ID NO: 12934 - DNA, 23 bp, Homo sapiens
gctattcttgtcatcccctctgg

SEQ ID NO: 12935 - DNA, 23 bp, Homo sapiens
cagctctcagaggacgactgagg

SEQ ID NO: 12936 - DNA, 23 bp, Homo sapiens
agttgctactgaatcgcctctgg

SEQ ID NO: 12937 - DNA, 23 bp, Homo sapiens
gtcagctgagcgtgaagtgctgg

SEQ ID NO: 12938 - DNA, 23 bp, Homo sapiens
agctttactgaggaatctgatgg

SEQ ID NO: 12939 - DNA, 23 bp, Homo sapiens
gcggattatctgtttctgagagg

SEQ ID NO: 12940 - DNA, 23 bp, Homo sapiens
gagacttcaaagcaagagtctgg

SEQ ID NO: 12941 - DNA, 23 bp, Homo sapiens
tccctccaggatgtcatcagagg

SEQ ID NO: 12942 - DNA, 23 bp, Homo sapiens
ctagcacgagcacttgcactcgg

SEQ ID NO: 12943 - DNA, 23 bp, Homo sapiens
ggacggtcgtttcattgatttgg

SEQ ID NO: 12944 - DNA, 23 bp, Homo sapiens
taatgatgccagaagcaaagagg

SEQ ID NO: 12945 - DNA, 23 bp, Homo sapiens
aggcaaagcacggcacagcgggg

SEQ ID NO: 12946 - DNA, 23 bp, Homo sapiens
cgagcccgacttcgaggaaaggg

SEQ ID NO: 12947 - DNA, 23 bp, Homo sapiens
gtgccccgcccatgctggatagg

SEQ ID NO: 12948 - DNA, 23 bp, Homo sapiens
attgcgatctgcagatgaactgg

SEQ ID NO: 12949 - DNA, 23 bp, Homo sapiens
tctcttcatgctgagatcagtgg

SEQ ID NO: 12950 - DNA, 23 bp, Homo sapiens
ggtggggtcagttctgctgtagg

SEQ ID NO: 12951 - DNA, 23 bp, Homo sapiens
cccacggacctcagcatgaaagg

SEQ ID NO: 12952 - DNA, 23 bp, Homo sapiens
tggaggcccgaagtgagaggtgg

SEQ ID NO: 12953 - DNA, 23 bp, Homo sapiens
gaggtttaaaagacggtggatgg

SEQ ID NO: 12954 - DNA, 23 bp, Homo sapiens
cagaacaaccaacctgcgtatgg

SEQ ID NO: 12955 - DNA, 23 bp, Homo sapiens
ttcgacagaacttaggtcttcgg

SEQ ID NO: 12956 - DNA, 23 bp, Homo sapiens
gggaggctcaatctctgtccagg

SEQ ID NO: 12957 - DNA, 23 bp, Homo sapiens
gcttccctgagaatgtagtcagg

SEQ ID NO: 12958 - DNA, 23 bp, Homo sapiens
aagacaaggcggacttgaggagg

SEQ ID NO: 12959 - DNA, 23 bp, Homo sapiens
aagacaaggcggacgtgaggagg

SEQ ID NO: 12960 - DNA, 23 bp, Homo sapiens
aacctgtatccactattaggagg

SEQ ID NO: 12961 - DNA, 23 bp, Homo sapiens
tagtatcggcgacgtttgtttgg

SEQ ID NO: 12962 - DNA, 23 bp, Homo sapiens
tcagtttaagggaccctcagagg

SEQ ID NO: 12963 - DNA, 23 bp, Homo sapiens
acttttttggctgggtgctgtgg

SEQ ID NO: 12964 - DNA, 23 bp, Homo sapiens
gcgaatggaaggctctgaagagg

SEQ ID NO: 12965 - DNA, 23 bp, Homo sapiens
gaacctgctgttttcagggtggg

SEQ ID NO: 12966 - DNA, 23 bp, Homo sapiens
gaagatggaggtggagtgactgg

SEQ ID NO: 12967 - DNA, 23 bp, Homo sapiens
tcaaccgaaagcgtctgaaccgg

SEQ ID NO: 12968 - DNA, 23 bp, Homo sapiens
ccagctgctgctatcttagatgg

SEQ ID NO: 12969 - DNA, 23 bp, Homo sapiens
ggtgtcttgctttgtcgctcagg

SEQ ID NO: 12970 - DNA, 23 bp, Homo sapiens
ggtgaagctggtggagaagcggg

SEQ ID NO: 12971 - DNA, 23 bp, Homo sapiens
aaagttccataaagcatcccagg

SEQ ID NO: 12972 - DNA, 23 bp, Homo sapiens
gcaattgctgtgctggtacatgg

SEQ ID NO: 12973 - DNA, 23 bp, Homo sapiens
aactccatacttgaagactgagg

SEQ ID NO: 12974 - DNA, 23 bp, Homo sapiens
aagggtctcttatcagctcctgg

SEQ ID NO: 12975 - DNA, 23 bp, Homo sapiens
gctctcttcaatgaaggcaatgg

SEQ ID NO: 12976 - DNA, 23 bp, Homo sapiens
cctcgccctcggcacctacacgg

SEQ ID NO: 12977 - DNA, 23 bp, Homo sapiens
tggagatgtcagcgctctgaggg

SEQ ID NO: 12978 - DNA, 23 bp, Homo sapiens
gagcaggcgaaactattctgtgg

SEQ ID NO: 12979 - DNA, 23 bp, Homo sapiens
cttcaacctcccaagtagttggg

SEQ ID NO: 12980 - DNA, 23 bp, Homo sapiens
cgtctataatcgcagcactttgg

SEQ ID NO: 12981 - DNA, 23 bp, Homo sapiens
gaaagccaggcggctctcagggg

SEQ ID NO: 12982 - DNA, 23 bp, Homo sapiens
gaaatcacggccggtgatgcagg

SEQ ID NO: 12983 - DNA, 23 bp, Homo sapiens
tgctggcaacacagctacaaagg

SEQ ID NO: 12984 - DNA, 23 bp, Homo sapiens
tccggaggccttcaagtaaacgg

SEQ ID NO: 12985 - DNA, 23 bp, Homo sapiens
gccaccacacaacaacatgcagg

SEQ ID NO: 12986 - DNA, 23 bp, Homo sapiens
tataacttaagacaatgccctgg

SEQ ID NO: 12987 - DNA, 23 bp, Homo sapiens
agagacagggaagtctggaatgg

SEQ ID NO: 12988 - DNA, 23 bp, Homo sapiens
tacccccaagaggcaagtgttgg

SEQ ID NO: 12989 - DNA, 23 bp, Homo sapiens
cccataaaccaaggaggagaggg

SEQ ID NO: 12990 - DNA, 23 bp, Homo sapiens
gatgccgagtcaggagtggacgg

SEQ ID NO: 12991 - DNA, 23 bp, Homo sapiens
gatgctgagcaacggaagctagg

SEQ ID NO: 12992 - DNA, 23 bp, Homo sapiens
gacaggttacattttccctctgg

SEQ ID NO: 12993 - DNA, 23 bp, Homo sapiens
gctgccaatcctcagaaagtggg

SEQ ID NO: 12994 - DNA, 23 bp, Homo sapiens
tatcttgcttcatgatatccagg

SEQ ID NO: 12995 - DNA, 23 bp, Homo sapiens
aacccccagaaagtgggatgagg

SEQ ID NO: 12996 - DNA, 23 bp, Homo sapiens
ttccagtctggatcctagaaagg

SEQ ID NO: 12997 - DNA, 23 bp, Homo sapiens
aatagaaatgaacacctctgggg

SEQ ID NO: 12998 - DNA, 23 bp, Homo sapiens
agtaaccagaacaactcatatgg

SEQ ID NO: 12999 - DNA, 23 bp, Homo sapiens
ggtgaggctagaaattctcttgg

SEQ ID NO: 13000 - DNA, 23 bp, Homo sapiens
attagggctgatctccctgctgg

SEQ ID NO: 13001 - DNA, 23 bp, Homo sapiens
tcgcgctcactgctccgtcgtgg

SEQ ID NO: 13002 - DNA, 23 bp, Homo sapiens
tgattcctgagttctcttattgg

SEQ ID NO: 13003 - DNA, 23 bp, Homo sapiens
acaggtgctcttacggaagttgg

SEQ ID NO: 13004 - DNA, 23 bp, Homo sapiens
agccagcgtggcctgtgaggagg

SEQ ID NO: 13005 - DNA, 23 bp, Homo sapiens
ctgccgcggaagggggactgagg

SEQ ID NO: 13006 - DNA, 23 bp, Homo sapiens
cttcagtgccggggcattatcgg

SEQ ID NO: 13007 - DNA, 23 bp, Homo sapiens
ctggagcgcaaggaggactgagg

SEQ ID NO: 13008 - DNA, 23 bp, Homo sapiens
catggaagctgtcttgaacttgg

SEQ ID NO: 13009 - DNA, 23 bp, Homo sapiens
cagttcatttccagcaggaatgg

SEQ ID NO: 13010 - DNA, 23 bp, Homo sapiens
aggagaggtccgggctcaggcgg

SEQ ID NO: 13011 - DNA, 23 bp, Homo sapiens
ccagctgataacttgccgcgcgg

SEQ ID NO: 13012 - DNA, 23 bp, Homo sapiens
agaacttccgcagcatattgcgg

SEQ ID NO: 13013 - DNA, 23 bp, Homo sapiens
acaaaggaacagagcgcgaacgg

SEQ ID NO: 13014 - DNA, 23 bp, Homo sapiens
acttcttgcccaacaatgggcgg

SEQ ID NO: 13015 - DNA, 23 bp, Homo sapiens
catctttgttctcgagtaccagg

SEQ ID NO: 13016 - DNA, 23 bp, Homo sapiens
aaaccaaagtctcttctgctggg

SEQ ID NO: 13017 - DNA, 23 bp, Homo sapiens
ccgcctgcactgccatgacctgg

SEQ ID NO: 13018 - DNA, 23 bp, Homo sapiens
ggagggactccaagagacgcagg

SEQ ID NO: 13019 - DNA, 23 bp, Homo sapiens
gcacctcaggattcacactgtgg

SEQ ID NO: 13020 - DNA, 23 bp, Homo sapiens
tggctgcccctcaacgctttggg

SEQ ID NO: 13021 - DNA, 23 bp, Homo sapiens
gcccctcaccattccagcctggg

SEQ ID NO: 13022 - DNA, 23 bp, Homo sapiens
accccaacaggaattagtgatgg

SEQ ID NO: 13023 - DNA, 23 bp, Homo sapiens
gagcagacctatgacttcttggg

SEQ ID NO: 13024 - DNA, 23 bp, Homo sapiens
ttttccttcagcaaggacaaagg

SEQ ID NO: 13025 - DNA, 23 bp, Homo sapiens
cgtcaccctcaagccctcactgg

SEQ ID NO: 13026 - DNA, 23 bp, Homo sapiens
cttcgagctgaggggacatctgg

SEQ ID NO: 13027 - DNA, 23 bp, Homo sapiens
gactctcccatgttataggaagg

SEQ ID NO: 13028 - DNA, 23 bp, Homo sapiens
ggggagtgagcagacacacttgg

SEQ ID NO: 13029 - DNA, 23 bp, Homo sapiens
agcgttgcggcggcgggcagagg

SEQ ID NO: 13030 - DNA, 23 bp, Homo sapiens
gggagtgagcagacacactcagg

SEQ ID NO: 13031 - DNA, 23 bp, Homo sapiens
tcagctcaacctccgcctcttgg

SEQ ID NO: 13032 - DNA, 23 bp, Homo sapiens
gttagtttgtttttggagcgtgg

SEQ ID NO: 13033 - DNA, 23 bp, Homo sapiens
tacccgaacccaagaggcggagg

SEQ ID NO: 13034 - DNA, 23 bp, Homo sapiens
cggatttattcttattgcccagg

SEQ ID NO: 13035 - DNA, 23 bp, Homo sapiens
atgggagcaactggagcagtggg

SEQ ID NO: 13036 - DNA, 23 bp, Homo sapiens
aaggatggaaacttggaagctgg

SEQ ID NO: 13037 - DNA, 23 bp, Homo sapiens
gggagagacagtcttctcagtgg

SEQ ID NO: 13038 - DNA, 23 bp, Homo sapiens
tgcagcctccccaggacctaggg

SEQ ID NO: 13039 - DNA, 23 bp, Homo sapiens
aagaggctattcaagatctctgg

SEQ ID NO: 13040 - DNA, 23 bp, Homo sapiens
ctaggtccttttggtgttttagg

SEQ ID NO: 13041 - DNA, 23 bp, Homo sapiens
aagccaggattcaagaaatgagg

SEQ ID NO: 13042 - DNA, 23 bp, Homo sapiens
agggctcttgtctctaacgctgg

SEQ ID NO: 13043 - DNA, 23 bp, Homo sapiens
ctgccaaaaagcaggggggcagg

SEQ ID NO: 13044 - DNA, 23 bp, Homo sapiens
gttagcgttcttcagagcagtgg

SEQ ID NO: 13045 - DNA, 23 bp, Homo sapiens
gactgggctgtaacagcttccgg

SEQ ID NO: 13046 - DNA, 23 bp, Homo sapiens
agtgctgaggcggcattaagagg

SEQ ID NO: 13047 - DNA, 23 bp, Homo sapiens
agcggcctgggatgttagtgcgg

SEQ ID NO: 13048 - DNA, 23 bp, Homo sapiens
gagaggaggcaggtcagcctcgg

SEQ ID NO: 13049 - DNA, 23 bp, Homo sapiens
tggaaagaatgggggtttacagg

SEQ ID NO: 13050 - DNA, 23 bp, Homo sapiens
tactgaaaaatgggatctgatgg

SEQ ID NO: 13051 - DNA, 23 bp, Homo sapiens
atcatcatctgctggaagtgagg

SEQ ID NO: 13052 - DNA, 23 bp, Homo sapiens
cgccctccgcctgggctcagggg

SEQ ID NO: 13053 - DNA, 23 bp, Homo sapiens
ttcgcaatggagttggcacaggg

SEQ ID NO: 13054 - DNA, 23 bp, Homo sapiens
cagggtgagagctgtcaccttgg

SEQ ID NO: 13055 - DNA, 23 bp, Homo sapiens
cctagggtctagatgaattctgg

SEQ ID NO: 13056 - DNA, 23 bp, Homo sapiens
cgttccgggagagaactgagagg

SEQ ID NO: 13057 - DNA, 23 bp, Homo sapiens
tttgtgattgttggtagagttgg

SEQ ID NO: 13058 - DNA, 23 bp, Homo sapiens
cctgccgtgctcagttgatctgg

SEQ ID NO: 13059 - DNA, 23 bp, Homo sapiens
gagaaggcggctacaagtcaagg

SEQ ID NO: 13060 - DNA, 23 bp, Homo sapiens
ggggagggccaaggcatgagggg

SEQ ID NO: 13061 - DNA, 23 bp, Homo sapiens
atcccgatcaaaaacagtcaagg

SEQ ID NO: 13062 - DNA, 23 bp, Homo sapiens
ggcgggggacgctgtcagaacgg

SEQ ID NO: 13063 - DNA, 23 bp, Homo sapiens
agaccctgcaatgtggtgatggg

SEQ ID NO: 13064 - DNA, 23 bp, Homo sapiens
tgcttgcttcaaagaagttttgg

SEQ ID NO: 13065 - DNA, 23 bp, Homo sapiens
acagaggctaccaatgtctaagg

SEQ ID NO: 13066 - DNA, 23 bp, Homo sapiens
aggtccaatcccatttaaccagg

SEQ ID NO: 13067 - DNA, 23 bp, Homo sapiens
gccactacaccttttccatgtgg

SEQ ID NO: 13068 - DNA, 23 bp, Homo sapiens
gctttgatctggttgtcagttgg

SEQ ID NO: 13069 - DNA, 23 bp, Homo sapiens
gcacagcccactggcacttcggg

SEQ ID NO: 13070 - DNA, 23 bp, Homo sapiens
cagcatggatgatatgatgctgg

SEQ ID NO: 13071 - DNA, 23 bp, Homo sapiens
ttggggacatgcttttgctcagg

SEQ ID NO: 13072 - DNA, 23 bp, Homo sapiens
aggccggccgggcgggtcactgg

SEQ ID NO: 13073 - DNA, 23 bp, Homo sapiens
gcctttaaagttcacccttaagg

SEQ ID NO: 13074 - DNA, 23 bp, Homo sapiens
ctgggacgtccacgagtgagggg

SEQ ID NO: 13075 - DNA, 23 bp, Homo sapiens
accgctgctctctgagatctggg

SEQ ID NO: 13076 - DNA, 23 bp, Homo sapiens
atctgggacgtgcagtgatgggg

SEQ ID NO: 13077 - DNA, 23 bp, Homo sapiens
cggcatcacaggtagctgagcgg

SEQ ID NO: 13078 - DNA, 23 bp, Homo sapiens
ctccaggagatctgcagctgagg

SEQ ID NO: 13079 - DNA, 23 bp, Homo sapiens
tagtctttcattgcaaccactgg

SEQ ID NO: 13080 - DNA, 23 bp, Homo sapiens
cattcatcacttgccagcactgg

SEQ ID NO: 13081 - DNA, 23 bp, Homo sapiens
ctcgtcttgtgaaatgaatgagg

SEQ ID NO: 13082 - DNA, 23 bp, Homo sapiens
gcattcatcagtcttaaagctgg

SEQ ID NO: 13083 - DNA, 23 bp, Homo sapiens
gtgtggtttgcgctatagactgg

SEQ ID NO: 13084 - DNA, 23 bp, Homo sapiens
cctgcgggtgcttggggagaagg

SEQ ID NO: 13085 - DNA, 23 bp, Homo sapiens
tacaaacttaggggaagttgagg

SEQ ID NO: 13086 - DNA, 23 bp, Homo sapiens
cttgtgagcttagatatcactgg

SEQ ID NO: 13087 - DNA, 23 bp, Homo sapiens
cgcatgctcaggtcacctcacgg

SEQ ID NO: 13088 - DNA, 23 bp, Homo sapiens
tcacaaaggagcttctccattgg

SEQ ID NO: 13089 - DNA, 23 bp, Homo sapiens
cgcccaaggtctaggagcactgg

SEQ ID NO: 13090 - DNA, 23 bp, Homo sapiens
cagttttaactggccgtatatgg

SEQ ID NO: 13091 - DNA, 23 bp, Homo sapiens
cgtggccccgtcatggtcactgg

SEQ ID NO: 13092 - DNA, 23 bp, Homo sapiens
aatgtgtgagatgtgctttctgg

SEQ ID NO: 13093 - DNA, 23 bp, Homo sapiens
atgatttcagctaacatctcggg

SEQ ID NO: 13094 - DNA, 23 bp, Homo sapiens
tactgcttctctcttcaggttgg

SEQ ID NO: 13095 - DNA, 23 bp, Homo sapiens
gggcagcgggcagtcacttccgg

SEQ ID NO: 13096 - DNA, 23 bp, Homo sapiens
gttcccaggcaggggtcagaagg

SEQ ID NO: 13097 - DNA, 23 bp, Homo sapiens
cttgggaggaggtcttagaaagg

SEQ ID NO: 13098 - DNA, 23 bp, Homo sapiens
atgatcagggtctctatttatgg

SEQ ID NO: 13099 - DNA, 23 bp, Homo sapiens
gacaccctacctttctaatcagg

SEQ ID NO: 13100 - DNA, 23 bp, Homo sapiens
ggcccaggctcaagtctgcttgg

SEQ ID NO: 13101 - DNA, 23 bp, Homo sapiens
tatagggcacatccccgttcagg

SEQ ID NO: 13102 - DNA, 23 bp, Homo sapiens
ctgcaagaccagtgtgggcaagg

SEQ ID NO: 13103 - DNA, 23 bp, Homo sapiens
tggacatggctcacaacagcagg

SEQ ID NO: 13104 - DNA, 23 bp, Homo sapiens
ggggtcccggcgggcatcaccgg

SEQ ID NO: 13105 - DNA, 23 bp, Homo sapiens
ttgtatgggattgccatgtgtgg

SEQ ID NO: 13106 - DNA, 23 bp, Homo sapiens
ctctctgaggatattctgaaagg

SEQ ID NO: 13107 - DNA, 23 bp, Homo sapiens
tggcccgagtgagctctaagagg

SEQ ID NO: 13108 - DNA, 23 bp, Homo sapiens
cgtgggacccaggcctgacccgg

SEQ ID NO: 13109 - DNA, 23 bp, Homo sapiens
aaggaattcatggcgttgacagg

SEQ ID NO: 13110 - DNA, 23 bp, Homo sapiens
ctattttatggtaggggagaagg

SEQ ID NO: 13111 - DNA, 23 bp, Homo sapiens
ggagctggagctgctgctggagg

SEQ ID NO: 13112 - DNA, 23 bp, Homo sapiens
aagtggaggtaactgattcttgg

SEQ ID NO: 13113 - DNA, 23 bp, Homo sapiens
agctgtggaggtggtgacattgg

SEQ ID NO: 13114 - DNA, 23 bp, Homo sapiens
aactgagcatgctcctattcagg

SEQ ID NO: 13115 - DNA, 23 bp, Homo sapiens
cttagagaatgaagcccaaatgg

SEQ ID NO: 13116 - DNA, 23 bp, Homo sapiens
gagactctcctcatagtgaaagg

SEQ ID NO: 13117 - DNA, 23 bp, Homo sapiens
ttacttgcacaagtatctcgagg

SEQ ID NO: 13118 - DNA, 23 bp, Homo sapiens
tttatacagcaatagggtcttgg

SEQ ID NO: 13119 - DNA, 23 bp, Homo sapiens
cgcgcggcggggccctagagtgg

SEQ ID NO: 13120 - DNA, 23 bp, Homo sapiens
ttcctacatctcaagtcacttgg

SEQ ID NO: 13121 - DNA, 23 bp, Homo sapiens
tggtactgctcgtctctaccagg

SEQ ID NO: 13122 - DNA, 23 bp, Homo sapiens
cggcggccccagcggagactagg

SEQ ID NO: 13123 - DNA, 23 bp, Homo sapiens
ggagaagtttatggacttctggg

SEQ ID NO: 13124 - DNA, 23 bp, Homo sapiens
ctgactgagacagcagtcactgg

SEQ ID NO: 13125 - DNA, 23 bp, Homo sapiens
aaagagactgtctccacaaaagg

SEQ ID NO: 13126 - DNA, 23 bp, Homo sapiens
cgggtttacttcatgacacttgg

SEQ ID NO: 13127 - DNA, 23 bp, Homo sapiens
aggtgctctgaacggctcagagg

SEQ ID NO: 13128 - DNA, 23 bp, Homo sapiens
caggatggggaggcagagtgagg

SEQ ID NO: 13129 - DNA, 23 bp, Homo sapiens
gccctggccttgcaggtatgagg

SEQ ID NO: 13130 - DNA, 23 bp, Homo sapiens
tctacctgggcctggctcacggg

SEQ ID NO: 13131 - DNA, 23 bp, Homo sapiens
gagctggccccacgctcagaagg

SEQ ID NO: 13132 - DNA, 23 bp, Homo sapiens
aacccaacaagctaggccagagg

SEQ ID NO: 13133 - DNA, 23 bp, Homo sapiens
ttctgagagagcctgggggatgg

SEQ ID NO: 13134 - DNA, 23 bp, Homo sapiens
atagacagcaccatacaatcagg

SEQ ID NO: 13135 - DNA, 23 bp, Homo sapiens
gtacttattcggaggcatgaagg

SEQ ID NO: 13136 - DNA, 23 bp, Homo sapiens
agtgctgctccgaggcatgacgg

SEQ ID NO: 13137 - DNA, 23 bp, Homo sapiens
accgtggctcgcactgctgaggg

SEQ ID NO: 13138 - DNA, 23 bp, Homo sapiens
tgttgagggtaacgttacagagg

SEQ ID NO: 13139 - DNA, 23 bp, Homo sapiens
tggtcctccgtttactgacctgg

SEQ ID NO: 13140 - DNA, 23 bp, Homo sapiens
aggtttcaggttgccagtagagg

SEQ ID NO: 13141 - DNA, 23 bp, Homo sapiens
ggcagctcaggagtccctcttgg

SEQ ID NO: 13142 - DNA, 23 bp, Homo sapiens
agtgaggtagggtcacacgcagg

SEQ ID NO: 13143 - DNA, 23 bp, Homo sapiens
agaaaacactgaaagcagagtgg

SEQ ID NO: 13144 - DNA, 23 bp, Homo sapiens
cacctgatgatgggcgaccaagg

SEQ ID NO: 13145 - DNA, 23 bp, Homo sapiens
ctccataacaactcagggtttgg

SEQ ID NO: 13146 - DNA, 23 bp, Homo sapiens
gttggagcttttcgcactgctgg

SEQ ID NO: 13147 - DNA, 23 bp, Homo sapiens
ggccaagaagaacaaagacaagg

SEQ ID NO: 13148 - DNA, 23 bp, Homo sapiens
agaaacagaaaaacaaggacagg

SEQ ID NO: 13149 - DNA, 23 bp, Homo sapiens
accaacaatcctgaaaatgatgg

SEQ ID NO: 13150 - DNA, 23 bp, Homo sapiens
tgattctgcacacttgtgactgg

SEQ ID NO: 13151 - DNA, 23 bp, Homo sapiens
taagtgcagtacagagcagctgg

SEQ ID NO: 13152 - DNA, 23 bp, Homo sapiens
ggctggcggagagtcacagaggg

SEQ ID NO: 13153 - DNA, 23 bp, Homo sapiens
tgcatccttaactgagaatgagg

SEQ ID NO: 13154 - DNA, 23 bp, Homo sapiens
cgcagcgattgaggaaactgtgg

SEQ ID NO: 13155 - DNA, 23 bp, Homo sapiens
aaatgggaatcacaagatcatgg

SEQ ID NO: 13156 - DNA, 23 bp, Homo sapiens
acctgcggagggtcaagtgaggg

SEQ ID NO: 13157 - DNA, 23 bp, Homo sapiens
ttggccctcttaagagaagaagg

SEQ ID NO: 13158 - DNA, 23 bp, Homo sapiens
tcaatgctgtcatcgtgcagcgg

SEQ ID NO: 13159 - DNA, 23 bp, Homo sapiens
ggctgagaagtcagcttagcggg

SEQ ID NO: 13160 - DNA, 23 bp, Homo sapiens
tggctggggcaggcctctagtgg

SEQ ID NO: 13161 - DNA, 23 bp, Homo sapiens
actagctctaggggcagtttagg

SEQ ID NO: 13162 - DNA, 23 bp, Homo sapiens
cagaggggaaacagtagcaaagg

SEQ ID NO: 13163 - DNA, 23 bp, Homo sapiens
tctccttgttcaattaatgcagg

SEQ ID NO: 13164 - DNA, 23 bp, Homo sapiens
ttaattttctttggccgcaatgg

SEQ ID NO: 13165 - DNA, 23 bp, Homo sapiens
tagcagtatcatcacaggagggg

SEQ ID NO: 13166 - DNA, 23 bp, Homo sapiens
gcacgatggctaatgctgcctgg

SEQ ID NO: 13167 - DNA, 23 bp, Homo sapiens
ggcaggtggcttttcctactcgg

SEQ ID NO: 13168 - DNA, 23 bp, Homo sapiens
tggttcggctttttgaaattagg

SEQ ID NO: 13169 - DNA, 23 bp, Homo sapiens
cccagctccatcctcttgaaagg

SEQ ID NO: 13170 - DNA, 23 bp, Homo sapiens
ttcagctagcatcaagcacttgg

SEQ ID NO: 13171 - DNA, 23 bp, Homo sapiens
cggaggcctctgcccctcacagg

SEQ ID NO: 13172 - DNA, 23 bp, Homo sapiens
cttggccaggcagatggcgcggg

SEQ ID NO: 13173 - DNA, 23 bp, Homo sapiens
gtccatccaccccggtgagcagg

SEQ ID NO: 13174 - DNA, 23 bp, Homo sapiens
aatcatggagcacaggaaaatgg

SEQ ID NO: 13175 - DNA, 23 bp, Homo sapiens
tgtacttctgcaaaatgcgtagg

SEQ ID NO: 13176 - DNA, 23 bp, Homo sapiens
acgcccccactcactcaccttgg

SEQ ID NO: 13177 - DNA, 23 bp, Homo sapiens
ccaccaggaaggagtcagcccgg

SEQ ID NO: 13178 - DNA, 23 bp, Homo sapiens
cggagcctctgctatgtgcaagg

SEQ ID NO: 13179 - DNA, 23 bp, Homo sapiens
ctggctaataaggactctatagg

SEQ ID NO: 13180 - DNA, 23 bp, Homo sapiens
tactcaggcctcctcggcgatgg

SEQ ID NO: 13181 - DNA, 23 bp, Homo sapiens
ttcacagacactgtctcagaagg

SEQ ID NO: 13182 - DNA, 23 bp, Homo sapiens
gctgcgcagcgggaatgagcggg

SEQ ID NO: 13183 - DNA, 23 bp, Homo sapiens
gcggactgcacctgcaaagcagg

SEQ ID NO: 13184 - DNA, 23 bp, Homo sapiens
ttaggttccatcgcagcttatgg

SEQ ID NO: 13185 - DNA, 23 bp, Homo sapiens
ttgatcaagacatccagcctagg

SEQ ID NO: 13186 - DNA, 23 bp, Homo sapiens
gaggaggaggaagaataaggagg

SEQ ID NO: 13187 - DNA, 23 bp, Homo sapiens
tttcagaatgtgctcaacattgg

SEQ ID NO: 13188 - DNA, 23 bp, Homo sapiens
gctggagcctgcgccttcagggg

SEQ ID NO: 13189 - DNA, 23 bp, Homo sapiens
tcatcacttgataagaccagtgg

SEQ ID NO: 13190 - DNA, 23 bp, Homo sapiens
gacaataaaggtgccctcagcgg

SEQ ID NO: 13191 - DNA, 23 bp, Homo sapiens
agtttttgcccttggctacttgg

SEQ ID NO: 13192 - DNA, 23 bp, Homo sapiens
cacttccttggaatcctagatgg

SEQ ID NO: 13193 - DNA, 23 bp, Homo sapiens
tccacaggaagtcactgccatgg

SEQ ID NO: 13194 - DNA, 23 bp, Homo sapiens
agcaagcggccctgctgagctgg

SEQ ID NO: 13195 - DNA, 23 bp, Homo sapiens
tgggaaaagatctcttctccagg

SEQ ID NO: 13196 - DNA, 23 bp, Homo sapiens
tgtgccttgtcgagaaaaatcgg

SEQ ID NO: 13197 - DNA, 23 bp, Homo sapiens
ctgggcatgggtctcaggcccgg

SEQ ID NO: 13198 - DNA, 23 bp, Homo sapiens
cggccgcccagggtctctgatgg

SEQ ID NO: 13199 - DNA, 23 bp, Homo sapiens
agcaggtgcaagaccagaagagg

SEQ ID NO: 13200 - DNA, 23 bp, Homo sapiens
ggtgagactgtgctctgagctgg

SEQ ID NO: 13201 - DNA, 23 bp, Homo sapiens
agctttgccctgagatgagccgg

SEQ ID NO: 13202 - DNA, 23 bp, Homo sapiens
cgtccagaatcacgccctcctgg

SEQ ID NO: 13203 - DNA, 23 bp, Homo sapiens
gaagaagggcaagtgcaagaagg

SEQ ID NO: 13204 - DNA, 23 bp, Homo sapiens
gcccagccggcgggctcaggcgg

SEQ ID NO: 13205 - DNA, 23 bp, Homo sapiens
ttctcttggaagaaaagtcatgg

SEQ ID NO: 13206 - DNA, 23 bp, Homo sapiens
ccatctcacgtctagtgctccgg

SEQ ID NO: 13207 - DNA, 23 bp, Homo sapiens
cgccagccccctggtgttctagg

SEQ ID NO: 13208 - DNA, 23 bp, Homo sapiens
gtcctccgggcggggctcagcgg

SEQ ID NO: 13209 - DNA, 23 bp, Homo sapiens
gtacagacaatccagcattaagg

SEQ ID NO: 13210 - DNA, 23 bp, Homo sapiens
tgacgtgcgtgcagagcagcagg

SEQ ID NO: 13211 - DNA, 23 bp, Homo sapiens
cctggatgtcctgggctaggggg

SEQ ID NO: 13212 - DNA, 23 bp, Homo sapiens
aaattattatcaggcggtcttgg

SEQ ID NO: 13213 - DNA, 23 bp, Homo sapiens
tacctggacattctaggctaggg

SEQ ID NO: 13214 - DNA, 23 bp, Homo sapiens
ttcataagatcccactggatggg

SEQ ID NO: 13215 - DNA, 23 bp, Homo sapiens
ctacagcacggattattacaggg

SEQ ID NO: 13216 - DNA, 23 bp, Homo sapiens
acctggacattcttggctagtgg

SEQ ID NO: 13217 - DNA, 23 bp, Homo sapiens
tatttcagcaaaggacgtcatgg

SEQ ID NO: 13218 - DNA, 23 bp, Homo sapiens
tttgagtatgtagggtcttctgg

SEQ ID NO: 13219 - DNA, 23 bp, Homo sapiens
cacccgcgagacgctgtactagg

SEQ ID NO: 13220 - DNA, 23 bp, Homo sapiens
tcttgcattacattcaggtccgg

SEQ ID NO: 13221 - DNA, 23 bp, Homo sapiens
tcaggtctacaagcaagcgctgg

SEQ ID NO: 13222 - DNA, 23 bp, Homo sapiens
ctgctcaaagctcacctgagtgg

SEQ ID NO: 13223 - DNA, 23 bp, Homo sapiens
agactatcttgactcaactctgg

SEQ ID NO: 13224 - DNA, 23 bp, Homo sapiens
tatacttctgtaggctaacgtgg

SEQ ID NO: 13225 - DNA, 23 bp, Homo sapiens
tctcgtttcaggaactgatgagg

SEQ ID NO: 13226 - DNA, 23 bp, Homo sapiens
ccgcgtgtccacacagttagcgg

SEQ ID NO: 13227 - DNA, 23 bp, Homo sapiens
tgcaaggtggccttagtcagggg

SEQ ID NO: 13228 - DNA, 23 bp, Homo sapiens
cacttggggaatcattctgaagg

SEQ ID NO: 13229 - DNA, 23 bp, Homo sapiens
tcccggaggatcacagatgctgg

SEQ ID NO: 13230 - DNA, 23 bp, Homo sapiens
tcaaacttcaattctccagctgg

SEQ ID NO: 13231 - DNA, 23 bp, Homo sapiens
agatgaagccccttctggggagg

SEQ ID NO: 13232 - DNA, 23 bp, Homo sapiens
gggctagttgaatttagccttgg

SEQ ID NO: 13233 - DNA, 23 bp, Homo sapiens
ggaaggcaggcaagtaggacagg

SEQ ID NO: 13234 - DNA, 23 bp, Homo sapiens
ttctcaaggtttgagaaatctgg

SEQ ID NO: 13235 - DNA, 23 bp, Homo sapiens
cattaaaactgcacagcccccgg

SEQ ID NO: 13236 - DNA, 23 bp, Homo sapiens
cgaggtggacacggtctagcggg

SEQ ID NO: 13237 - DNA, 23 bp, Homo sapiens
ctagggatcgctatctggcgagg

SEQ ID NO: 13238 - DNA, 23 bp, Homo sapiens
ggatcgctatctggcgaggatgg

SEQ ID NO: 13239 - DNA, 23 bp, Homo sapiens
tgatgtgcaatagctcggcttgg

SEQ ID NO: 13240 - DNA, 23 bp, Homo sapiens
gcaatcatgagtgagccactagg

SEQ ID NO: 13241 - DNA, 23 bp, Homo sapiens
tcttccctgcctgcttagcccgg

SEQ ID NO: 13242 - DNA, 23 bp, Homo sapiens
ctagaaccctggagtctcactgg

SEQ ID NO: 13243 - DNA, 23 bp, Homo sapiens
tgcgccgggtcgccacatactgg

SEQ ID NO: 13244 - DNA, 23 bp, Homo sapiens
caaaggaaatcatctctaggtgg

SEQ ID NO: 13245 - DNA, 23 bp, Homo sapiens
caggagagcaagtggtctggagg

SEQ ID NO: 13246 - DNA, 23 bp, Homo sapiens
tagggaacagcagagagacatgg

SEQ ID NO: 13247 - DNA, 23 bp, Homo sapiens
acgtgggaatgttttcttattgg

SEQ ID NO: 13248 - DNA, 23 bp, Homo sapiens
agattccagctcatcactagagg

SEQ ID NO: 13249 - DNA, 23 bp, Homo sapiens
cagctcaggcagccctcaagagg

SEQ ID NO: 13250 - DNA, 23 bp, Homo sapiens
gagcaacgccttcgtgagcacgg

SEQ ID NO: 13251 - DNA, 23 bp, Homo sapiens
cttcccccaaaccaggggtctgg

SEQ ID NO: 13252 - DNA, 23 bp, Homo sapiens
gtcccagtgaacagatagagagg

SEQ ID NO: 13253 - DNA, 23 bp, Homo sapiens
aagcttaagcaccctacaaatgg

SEQ ID NO: 13254 - DNA, 23 bp, Homo sapiens
ccagtcagctcaggcctctatgg

SEQ ID NO: 13255 - DNA, 23 bp, Homo sapiens
gtctccctcagctgttgagcagg

SEQ ID NO: 13256 - DNA, 23 bp, Homo sapiens
tttattattttcagagcggcggg

SEQ ID NO: 13257 - DNA, 23 bp, Homo sapiens
tctgctcagagctcgatgtcagg

SEQ ID NO: 13258 - DNA, 23 bp, Homo sapiens
tctctctatcttacactagatgg

SEQ ID NO: 13259 - DNA, 23 bp, Homo sapiens
ttcaagaagggcacttcaaatgg

SEQ ID NO: 13260 - DNA, 23 bp, Homo sapiens
gaacttccagcagtttacacagg

SEQ ID NO: 13261 - DNA, 23 bp, Homo sapiens
ctctgaagagttattcctgaagg

SEQ ID NO: 13262 - DNA, 23 bp, Homo sapiens
gtgagctgggggatatgaggggg

SEQ ID NO: 13263 - DNA, 23 bp, Homo sapiens
tccactccaggactgaataaagg

SEQ ID NO: 13264 - DNA, 23 bp, Homo sapiens
agaccatcagctacaacgcatgg

SEQ ID NO: 13265 - DNA, 23 bp, Homo sapiens
agaagacagctgaactgaagagg

SEQ ID NO: 13266 - DNA, 23 bp, Homo sapiens
atgtgattttgcagtgtgttcgg

SEQ ID NO: 13267 - DNA, 23 bp, Homo sapiens
tggatagtccagatcaatgaagg

SEQ ID NO: 13268 - DNA, 23 bp, Homo sapiens
caggagttacagtgatgtcccgg

SEQ ID NO: 13269 - DNA, 23 bp, Homo sapiens
cacccctcgagccaagggcaagg

SEQ ID NO: 13270 - DNA, 23 bp, Homo sapiens
aaacgtcttctgtaagtcactgg

SEQ ID NO: 13271 - DNA, 23 bp, Homo sapiens
caatctcgaatgtcttttgcagg

SEQ ID NO: 13272 - DNA, 23 bp, Homo sapiens
accagggacttgacccattaggg

SEQ ID NO: 13273 - DNA, 23 bp, Homo sapiens
aacaaactcgaagtaaggattgg

SEQ ID NO: 13274 - DNA, 23 bp, Homo sapiens
ctgttagacgcaggaaataaagg

SEQ ID NO: 13275 - DNA, 23 bp, Homo sapiens
tagcagtacaagccatcactggg

SEQ ID NO: 13276 - DNA, 23 bp, Homo sapiens
agctaccgcttaaaatgatcagg

SEQ ID NO: 13277 - DNA, 23 bp, Homo sapiens
tatcgtcggaccttgtgatttgg

SEQ ID NO: 13278 - DNA, 23 bp, Homo sapiens
gtccggcatatgcaaagataggg

SEQ ID NO: 13279 - DNA, 23 bp, Homo sapiens
gtggcctcttgaggatatcaagg

SEQ ID NO: 13280 - DNA, 23 bp, Homo sapiens
ggaaccttcacgcggcctagtgg

SEQ ID NO: 13281 - DNA, 23 bp, Homo sapiens
gtcggctgcaacattggttatgg

SEQ ID NO: 13282 - DNA, 23 bp, Homo sapiens
ttggtggctggcgaagctgaggg

SEQ ID NO: 13283 - DNA, 23 bp, Homo sapiens
caatggagtacatgtttggctgg

SEQ ID NO: 13284 - DNA, 23 bp, Homo sapiens
agaccacaagctgttgttttggg

SEQ ID NO: 13285 - DNA, 23 bp, Homo sapiens
ttaggtccttgtcttgtttgtgg

SEQ ID NO: 13286 - DNA, 23 bp, Homo sapiens
caactcgtctgcatcctcgctgg

SEQ ID NO: 13287 - DNA, 23 bp, Homo sapiens
gaaaccatccacatcagaggtgg

SEQ ID NO: 13288 - DNA, 23 bp, Homo sapiens
cctccagctggaaacaaaagagg

SEQ ID NO: 13289 - DNA, 23 bp, Homo sapiens
ggctgctgtcgctcagtcaaagg

SEQ ID NO: 13290 - DNA, 23 bp, Homo sapiens
cattcagaattctgcagatctgg

SEQ ID NO: 13291 - DNA, 23 bp, Homo sapiens
ataagagaaggctcactggaagg

SEQ ID NO: 13292 - DNA, 23 bp, Homo sapiens
gggtgaacatataagggaaatgg

SEQ ID NO: 13293 - DNA, 23 bp, Homo sapiens
agcatggcacttaattcatgagg

SEQ ID NO: 13294 - DNA, 23 bp, Homo sapiens
gcaaagtgcctggggctcacagg

SEQ ID NO: 13295 - DNA, 23 bp, Homo sapiens
ccacctcaggtagagaaaaaagg

SEQ ID NO: 13296 - DNA, 23 bp, Homo sapiens
acatttagaagttccagaggtgg

SEQ ID NO: 13297 - DNA, 23 bp, Homo sapiens
agaggaagaagcgaggggcacgg

SEQ ID NO: 13298 - DNA, 23 bp, Homo sapiens
ggtgaggcgagtgcgcatcttgg

SEQ ID NO: 13299 - DNA, 23 bp, Homo sapiens
aacagcgtctgggaaagtagtgg

SEQ ID NO: 13300 - DNA, 23 bp, Homo sapiens
aatgcgaaggggcctcattttgg

SEQ ID NO: 13301 - DNA, 23 bp, Homo sapiens
aggctcgccctgcacaactttgg

SEQ ID NO: 13302 - DNA, 23 bp, Homo sapiens
atggtcccgctgctccctactgg

SEQ ID NO: 13303 - DNA, 23 bp, Homo sapiens
gcctgctcagaagcccctactgg

SEQ ID NO: 13304 - DNA, 23 bp, Homo sapiens
ccagggactgacagatgctgagg

SEQ ID NO: 13305 - DNA, 23 bp, Homo sapiens
ctggggactgacagatgctgagg

SEQ ID NO: 13306 - DNA, 23 bp, Homo sapiens
tgccccatggcggcccctactgg

SEQ ID NO: 13307 - DNA, 23 bp, Homo sapiens
ccggctgctggagacatcaccgg

SEQ ID NO: 13308 - DNA, 23 bp, Homo sapiens
ggacaaactggactgtcagcagg

SEQ ID NO: 13309 - DNA, 23 bp, Homo sapiens
ttgatttggtttcatttccctgg

SEQ ID NO: 13310 - DNA, 23 bp, Homo sapiens
agttatcaggggcatagctgtgg

SEQ ID NO: 13311 - DNA, 23 bp, Homo sapiens
atgcattagctcagcctcccagg

SEQ ID NO: 13312 - DNA, 23 bp, Homo sapiens
cacttcatgaatgccacttctgg

SEQ ID NO: 13313 - DNA, 23 bp, Homo sapiens
gatttgcttgaaggcctccgcgg

SEQ ID NO: 13314 - DNA, 23 bp, Homo sapiens
agtcacactggttgttacgaagg

SEQ ID NO: 13315 - DNA, 23 bp, Homo sapiens
tccaaccccagtccttagagtgg

SEQ ID NO: 13316 - DNA, 23 bp, Homo sapiens
aaaccggagcccatctagcgtgg

SEQ ID NO: 13317 - DNA, 23 bp, Homo sapiens
agcgggtcagaacagccccccgg

SEQ ID NO: 13318 - DNA, 23 bp, Homo sapiens
cccagatgctcaggaggctaagg

SEQ ID NO: 13319 - DNA, 23 bp, Homo sapiens
cttccaggactgggtggaggcgg

SEQ ID NO: 13320 - DNA, 23 bp, Homo sapiens
cacccacctgatcatgtgattgg

SEQ ID NO: 13321 - DNA, 23 bp, Homo sapiens
ttttgaatcacataatccggtgg

SEQ ID NO: 13322 - DNA, 23 bp, Homo sapiens
caagacaggctaggtttccaagg

SEQ ID NO: 13323 - DNA, 23 bp, Homo sapiens
cacccacctcaacatgtagtcgg

SEQ ID NO: 13324 - DNA, 23 bp, Homo sapiens
cttactttccctcgggatgaagg

SEQ ID NO: 13325 - DNA, 23 bp, Homo sapiens
gagaccccatacttatcttctgg

SEQ ID NO: 13326 - DNA, 23 bp, Homo sapiens
tactacccatctgggtgacccgg

SEQ ID NO: 13327 - DNA, 23 bp, Homo sapiens
ggaggggcgctatccgaagtagg

SEQ ID NO: 13328 - DNA, 23 bp, Homo sapiens
caggactgggccagctagtgggg

SEQ ID NO: 13329 - DNA, 23 bp, Homo sapiens
attgcttccgttttcaagattgg

SEQ ID NO: 13330 - DNA, 23 bp, Homo sapiens
tgggacaccgccatctgaggcgg

SEQ ID NO: 13331 - DNA, 23 bp, Homo sapiens
cacaggaagtcaatcacgattgg

SEQ ID NO: 13332 - DNA, 23 bp, Homo sapiens
aaggtcttggagcagtgagcggg

SEQ ID NO: 13333 - DNA, 23 bp, Homo sapiens
ggcctgcagatggactgacctgg

SEQ ID NO: 13334 - DNA, 23 bp, Homo sapiens
gatccctacccaggctagggtgg

SEQ ID NO: 13335 - DNA, 23 bp, Homo sapiens
gatgatcgaggaggtatttgagg

SEQ ID NO: 13336 - DNA, 23 bp, Homo sapiens
tggctgttctgaagagagatggg

SEQ ID NO: 13337 - DNA, 23 bp, Homo sapiens
tggtcttgatcgtctgcaatggg

SEQ ID NO: 13338 - DNA, 23 bp, Homo sapiens
accgcatgttcactaattattgg

SEQ ID NO: 13339 - DNA, 23 bp, Homo sapiens
aggccaggagtcaggagacctgg

SEQ ID NO: 13340 - DNA, 23 bp, Homo sapiens
caagatgcactggcattcagagg

SEQ ID NO: 13341 - DNA, 23 bp, Homo sapiens
gctatatgtctcaagcttcatgg

SEQ ID NO: 13342 - DNA, 23 bp, Homo sapiens
attcaggattctatggcttctgg

SEQ ID NO: 13343 - DNA, 23 bp, Homo sapiens
ctatcccactcatggcctagagg

SEQ ID NO: 13344 - DNA, 23 bp, Homo sapiens
tgccggtaaaagtcatctaaagg

SEQ ID NO: 13345 - DNA, 23 bp, Homo sapiens
catccagccatggccagtgaagg

SEQ ID NO: 13346 - DNA, 23 bp, Homo sapiens
catagcaacagtcctgtttcagg

SEQ ID NO: 13347 - DNA, 23 bp, Homo sapiens
gtctcccagagaaaactaactgg

SEQ ID NO: 13348 - DNA, 23 bp, Homo sapiens
agaccatcttgtctttctgaggg

SEQ ID NO: 13349 - DNA, 23 bp, Homo sapiens
gggcatcaggagcaccaccgagg

SEQ ID NO: 13350 - DNA, 23 bp, Homo sapiens
agggttgcctattgtgttctcgg

SEQ ID NO: 13351 - DNA, 23 bp, Homo sapiens
attccaacgctttgaggggctgg

SEQ ID NO: 13352 - DNA, 23 bp, Homo sapiens
aagctgcgttctcgaacactagg

SEQ ID NO: 13353 - DNA, 23 bp, Homo sapiens
gctctttatttggagtcaggtgg

SEQ ID NO: 13354 - DNA, 23 bp, Homo sapiens
aagctgcgttcccgaacactagg

SEQ ID NO: 13355 - DNA, 23 bp, Homo sapiens
acctggcccaggtgcgctgaggg

SEQ ID NO: 13356 - DNA, 23 bp, Homo sapiens
agacagggatggggatgaggcgg

SEQ ID NO: 13357 - DNA, 23 bp, Homo sapiens
cacacacggctgctggtagaggg

SEQ ID NO: 13358 - DNA, 23 bp, Homo sapiens
cccccatggcgacgaacagctgg

SEQ ID NO: 13359 - DNA, 23 bp, Homo sapiens
ggtgggtaatgcattaagagagg

SEQ ID NO: 13360 - DNA, 23 bp, Homo sapiens
ggcatctatcttccatgaagagg

SEQ ID NO: 13361 - DNA, 23 bp, Homo sapiens
tggctcatgtggtggtgggatgg

SEQ ID NO: 13362 - DNA, 23 bp, Homo sapiens
caggggcacttagaagtacacgg

SEQ ID NO: 13363 - DNA, 23 bp, Homo sapiens
atgaatgaatctgctcccactgg

SEQ ID NO: 13364 - DNA, 23 bp, Homo sapiens
ttcaagagaagtttctaccttgg

SEQ ID NO: 13365 - DNA, 23 bp, Homo sapiens
tttggcactctttcatgcatagg

SEQ ID NO: 13366 - DNA, 23 bp, Homo sapiens
cacagaatttaggaagctgaagg

SEQ ID NO: 13367 - DNA, 23 bp, Homo sapiens
gcactgcctccttacctgtgagg

SEQ ID NO: 13368 - DNA, 23 bp, Homo sapiens
gtggtattatatggctatcctgg

SEQ ID NO: 13369 - DNA, 23 bp, Homo sapiens
tcacacatcaagaagatggttgg

SEQ ID NO: 13370 - DNA, 23 bp, Homo sapiens
tttaagaatgcaccatttcctgg

SEQ ID NO: 13371 - DNA, 23 bp, Homo sapiens
cttgggagcgaagaagactaagg

SEQ ID NO: 13372 - DNA, 23 bp, Homo sapiens
gcatgataggcctggataaccgg

SEQ ID NO: 13373 - DNA, 23 bp, Homo sapiens
caacttcttatggttcccttagg

SEQ ID NO: 13374 - DNA, 23 bp, Homo sapiens
tcatctgaggaaagctgagaggg

SEQ ID NO: 13375 - DNA, 23 bp, Homo sapiens
ccacagagcagcctgtgcttcgg

SEQ ID NO: 13376 - DNA, 23 bp, Homo sapiens
gtggaagccgattttcctgtagg

SEQ ID NO: 13377 - DNA, 23 bp, Homo sapiens
cctgataagtggcctcaggcagg

SEQ ID NO: 13378 - DNA, 23 bp, Homo sapiens
ggggggcgtgcagctcatcttgg

SEQ ID NO: 13379 - DNA, 23 bp, Homo sapiens
aatagatttcatggagtctctgg

SEQ ID NO: 13380 - DNA, 23 bp, Homo sapiens
ctggaagctgctttagaagaagg

SEQ ID NO: 13381 - DNA, 23 bp, Homo sapiens
gactcccctgctggttgatgtgg

SEQ ID NO: 13382 - DNA, 23 bp, Homo sapiens
ggcgggtcagttgtccgcgtcgg

SEQ ID NO: 13383 - DNA, 23 bp, Homo sapiens
gtcatcgacattcgtgactgagg

SEQ ID NO: 13384 - DNA, 23 bp, Homo sapiens
gctgcccggccgctgctgctagg

SEQ ID NO: 13385 - DNA, 23 bp, Homo sapiens
agtcctggatcctgagcagaagg

SEQ ID NO: 13386 - DNA, 23 bp, Homo sapiens
atgaagaactagacgactcttgg

SEQ ID NO: 13387 - DNA, 23 bp, Homo sapiens
cccagggctctgggttatgttgg

SEQ ID NO: 13388 - DNA, 23 bp, Homo sapiens
agaagttcttgaagacgtccagg

SEQ ID NO: 13389 - DNA, 23 bp, Homo sapiens
ctaaaatgtcttgccctcaaagg

SEQ ID NO: 13390 - DNA, 23 bp, Homo sapiens
cccaaacagaacaggtttctggg

SEQ ID NO: 13391 - DNA, 23 bp, Homo sapiens
gagcgcacatacatccaccgtgg

SEQ ID NO: 13392 - DNA, 23 bp, Homo sapiens
gggagagacacatgcgattctgg

SEQ ID NO: 13393 - DNA, 23 bp, Homo sapiens
ttggcccggctgctggctacggg

SEQ ID NO: 13394 - DNA, 23 bp, Homo sapiens
gccaagtctgggaagccttaagg

SEQ ID NO: 13395 - DNA, 23 bp, Homo sapiens
actgtactagtacaacatcatgg

SEQ ID NO: 13396 - DNA, 23 bp, Homo sapiens
aaagggccggaaggctagatggg

SEQ ID NO: 13397 - DNA, 23 bp, Homo sapiens
ctccttggcaatgcatttgatgg

SEQ ID NO: 13398 - DNA, 23 bp, Homo sapiens
gaagtctgtaattcttcaggagg

SEQ ID NO: 13399 - DNA, 23 bp, Homo sapiens
gatggggtgggggatattgaggg

SEQ ID NO: 13400 - DNA, 23 bp, Homo sapiens
ggaggagaggaaacctagggagg

SEQ ID NO: 13401 - DNA, 23 bp, Homo sapiens
ttctcaaagtgctagtaagctgg

SEQ ID NO: 13402 - DNA, 23 bp, Homo sapiens
aactgtttggatgctttcccagg

SEQ ID NO: 13403 - DNA, 23 bp, Homo sapiens
gctgactcagtgacttcaacagg

SEQ ID NO: 13404 - DNA, 23 bp, Homo sapiens
ttggtacaggatcagttttctgg

SEQ ID NO: 13405 - DNA, 23 bp, Homo sapiens
cccgatccgcatcgactgggagg

SEQ ID NO: 13406 - DNA, 23 bp, Homo sapiens
tatttcttcttcggttgttgagg

SEQ ID NO: 13407 - DNA, 23 bp, Homo sapiens
ttgattaatttctcgttcgcagg

SEQ ID NO: 13408 - DNA, 23 bp, Homo sapiens
aggagggagctacaactcgtcgg

SEQ ID NO: 13409 - DNA, 23 bp, Homo sapiens
acacctggccaggcagtttaagg

SEQ ID NO: 13410 - DNA, 23 bp, Homo sapiens
gagccacagcattggctcagggg

SEQ ID NO: 13411 - DNA, 23 bp, Homo sapiens
caagacagaggatgacacatagg

SEQ ID NO: 13412 - DNA, 23 bp, Homo sapiens
ctaactcctaaacagcttactgg

SEQ ID NO: 13413 - DNA, 23 bp, Homo sapiens
gctgtaatgcattacttcagagg

SEQ ID NO: 13414 - DNA, 23 bp, Homo sapiens
cctccacttcgtggtctgagtgg

SEQ ID NO: 13415 - DNA, 23 bp, Homo sapiens
gtggggacaagggtgtcagtagg

SEQ ID NO: 13416 - DNA, 23 bp, Homo sapiens
aagaaagaggaggaggtttgagg

SEQ ID NO: 13417 - DNA, 23 bp, Homo sapiens
ggcccaggcccgccctcacttgg

SEQ ID NO: 13418 - DNA, 23 bp, Homo sapiens
ccggcgccagtcggctcacttgg

SEQ ID NO: 13419 - DNA, 23 bp, Homo sapiens
tgctcacttgagcaagtccttgg

SEQ ID NO: 13420 - DNA, 23 bp, Homo sapiens
ccaagagaagtgcttgtctttgg

SEQ ID NO: 13421 - DNA, 23 bp, Homo sapiens
tacccatggctctgggaggacgg

SEQ ID NO: 13422 - DNA, 23 bp, Homo sapiens
ttcaaattcactgtgctcttagg

SEQ ID NO: 13423 - DNA, 23 bp, Homo sapiens
ttgaatagtaatcgagggtctgg

SEQ ID NO: 13424 - DNA, 23 bp, Homo sapiens
cagaacaagaaggagcagaaggg

SEQ ID NO: 13425 - DNA, 23 bp, Homo sapiens
tggtcatgctggctgtctgaggg

SEQ ID NO: 13426 - DNA, 23 bp, Homo sapiens
gagctggttaaaaaccacggagg

SEQ ID NO: 13427 - DNA, 23 bp, Homo sapiens
gcacttgtaccaaagcatgaagg

SEQ ID NO: 13428 - DNA, 23 bp, Homo sapiens
gcacgtgtaccaaagcatgatgg

SEQ ID NO: 13429 - DNA, 23 bp, Homo sapiens
cgccacggccactttctccaagg

SEQ ID NO: 13430 - DNA, 23 bp, Homo sapiens
actatgttgtcttaagcaacagg

SEQ ID NO: 13431 - DNA, 23 bp, Homo sapiens
cctttagctcagagcaagtttgg

SEQ ID NO: 13432 - DNA, 23 bp, Homo sapiens
tttcattgaagctcttcatcagg

SEQ ID NO: 13433 - DNA, 23 bp, Homo sapiens
gccggcgtccgagaaataggagg

SEQ ID NO: 13434 - DNA, 23 bp, Homo sapiens
agtgcctgcgtccaagaaatagg

SEQ ID NO: 13435 - DNA, 23 bp, Homo sapiens
tcactttcactcccatgaggagg

SEQ ID NO: 13436 - DNA, 23 bp, Homo sapiens
tgactgagctgcatcattccagg

SEQ ID NO: 13437 - DNA, 23 bp, Homo sapiens
tgatgaagaagtgggctaagagg

SEQ ID NO: 13438 - DNA, 23 bp, Homo sapiens
cttcctggagatgaaagttgagg

SEQ ID NO: 13439 - DNA, 23 bp, Homo sapiens
tttattgcgggatcctcacacgg

SEQ ID NO: 13440 - DNA, 23 bp, Homo sapiens
gtaggaggcagacctcatgcagg

SEQ ID NO: 13441 - DNA, 23 bp, Homo sapiens
gccaatattgggtcctcagttgg

SEQ ID NO: 13442 - DNA, 23 bp, Homo sapiens
gccattcttcattcctacaaagg

SEQ ID NO: 13443 - DNA, 23 bp, Homo sapiens
cagccaggaccccaggatgtagg

SEQ ID NO: 13444 - DNA, 23 bp, Homo sapiens
caggaagtcttctgctgtgctgg

SEQ ID NO: 13445 - DNA, 23 bp, Homo sapiens
ggtggcgctgccgcctgaccagg

SEQ ID NO: 13446 - DNA, 23 bp, Homo sapiens
atctccacgactagtcatactgg

SEQ ID NO: 13447 - DNA, 23 bp, Homo sapiens
gtaccgcggcccgcatgactagg

SEQ ID NO: 13448 - DNA, 23 bp, Homo sapiens
cccctccacggccaatacagtgg

SEQ ID NO: 13449 - DNA, 23 bp, Homo sapiens
aaagaagacagaaatctgactgg

SEQ ID NO: 13450 - DNA, 23 bp, Homo sapiens
actgctccgttgccctaacaggg

SEQ ID NO: 13451 - DNA, 23 bp, Homo sapiens
actggcttttgagaaataagagg

SEQ ID NO: 13452 - DNA, 23 bp, Homo sapiens
aggagaaatgctccaccagacgg

SEQ ID NO: 13453 - DNA, 23 bp, Homo sapiens
agtggatagaactaatcatcagg

SEQ ID NO: 13454 - DNA, 23 bp, Homo sapiens
cctgcaatgattacatgaagagg

SEQ ID NO: 13455 - DNA, 23 bp, Homo sapiens
ctcaactgtgagcataccaaggg

SEQ ID NO: 13456 - DNA, 23 bp, Homo sapiens
cttgccgggtcgtcttgaaaagg

SEQ ID NO: 13457 - DNA, 23 bp, Homo sapiens
tgacaatcacatacatgaccagg

SEQ ID NO: 13458 - DNA, 23 bp, Homo sapiens
ttaatgctctagactcttcctgg

SEQ ID NO: 13459 - DNA, 23 bp, Homo sapiens
cctacatagtaaggtcttagtgg

SEQ ID NO: 13460 - DNA, 23 bp, Homo sapiens
gcccagcctttaaaagtttttgg

SEQ ID NO: 13461 - DNA, 23 bp, Homo sapiens
atcggccgcttcacgtagctcgg

SEQ ID NO: 13462 - DNA, 23 bp, Homo sapiens
cacgttacagattcacgtgatgg

SEQ ID NO: 13463 - DNA, 23 bp, Homo sapiens
ggatacagtttctgagggctagg

SEQ ID NO: 13464 - DNA, 23 bp, Homo sapiens
tacgaaacagtgagatgaagagg

SEQ ID NO: 13465 - DNA, 23 bp, Homo sapiens
cggcttatccacaggaccctggg

SEQ ID NO: 13466 - DNA, 23 bp, Homo sapiens
gaaattatggcgaaggcgagtgg

SEQ ID NO: 13467 - DNA, 23 bp, Homo sapiens
aagtgaaaggggctgtcaagagg

SEQ ID NO: 13468 - DNA, 23 bp, Homo sapiens
gggatctgcgcgagctctgatgg

SEQ ID NO: 13469 - DNA, 23 bp, Homo sapiens
agactgtggctgggccagcctgg

SEQ ID NO: 13470 - DNA, 23 bp, Homo sapiens
gaggaacaaagatatcatggtgg

SEQ ID NO: 13471 - DNA, 23 bp, Homo sapiens
gtgcctatggagatttgaaaagg

SEQ ID NO: 13472 - DNA, 23 bp, Homo sapiens
agaggataacagcaggttgaagg

SEQ ID NO: 13473 - DNA, 23 bp, Homo sapiens
aagcccaagaactccgagtgagg

SEQ ID NO: 13474 - DNA, 23 bp, Homo sapiens
acaaagtagcacatcctcagagg

SEQ ID NO: 13475 - DNA, 23 bp, Homo sapiens
aatgggtcagtatttgctcaggg

SEQ ID NO: 13476 - DNA, 23 bp, Homo sapiens
gtacaccctgaggaacaaggagg

SEQ ID NO: 13477 - DNA, 23 bp, Homo sapiens
gacaaagtagcacattctcaggg

SEQ ID NO: 13478 - DNA, 23 bp, Homo sapiens
tgggtagagtttactgaagaagg

SEQ ID NO: 13479 - DNA, 23 bp, Homo sapiens
accagctactcaggtgcctgagg

SEQ ID NO: 13480 - DNA, 23 bp, Homo sapiens
gcccaatcattttcagtctaagg

SEQ ID NO: 13481 - DNA, 23 bp, Homo sapiens
cattttcagcctaaggaacaagg

SEQ ID NO: 13482 - DNA, 23 bp, Homo sapiens
gcagttctgtggaaagagtttgg

SEQ ID NO: 13483 - DNA, 23 bp, Homo sapiens
ctctgtgcagggctgttggtggg

SEQ ID NO: 13484 - DNA, 23 bp, Homo sapiens
ttaatgaagagaggttgtgaagg

SEQ ID NO: 13485 - DNA, 23 bp, Homo sapiens
gggcagaaagcctctctcttagg

SEQ ID NO: 13486 - DNA, 23 bp, Homo sapiens
gatgccctatgcagagttgtggg

SEQ ID NO: 13487 - DNA, 23 bp, Homo sapiens
tcagccctacgaagaacaatcgg

SEQ ID NO: 13488 - DNA, 23 bp, Homo sapiens
atactgatattagagcatcctgg

SEQ ID NO: 13489 - DNA, 23 bp, Homo sapiens
ccctgcgacacttggtgaagagg

SEQ ID NO: 13490 - DNA, 23 bp, Homo sapiens
agtgcccctaagccttcagttgg

SEQ ID NO: 13491 - DNA, 23 bp, Homo sapiens
agaaaagtgttgggcaagaaagg

SEQ ID NO: 13492 - DNA, 23 bp, Homo sapiens
agcttccgagagtctacagcagg

SEQ ID NO: 13493 - DNA, 23 bp, Homo sapiens
tagctcatcttggttgccacagg

SEQ ID NO: 13494 - DNA, 23 bp, Homo sapiens
aggaactgaaagatgccctaagg

SEQ ID NO: 13495 - DNA, 23 bp, Homo sapiens
ctgcctttcccagaacagctagg

SEQ ID NO: 13496 - DNA, 23 bp, Homo sapiens
catattcagcctgaggaataagg

SEQ ID NO: 13497 - DNA, 23 bp, Homo sapiens
agagggagattgctgggtaaagg

SEQ ID NO: 13498 - DNA, 23 bp, Homo sapiens
aggaggtgcatcaggcacttcgg

SEQ ID NO: 13499 - DNA, 23 bp, Homo sapiens
accctgtgatatatagtcttagg

SEQ ID NO: 13500 - DNA, 23 bp, Homo sapiens
cagccctgaggaaagttctgggg

SEQ ID NO: 13501 - DNA, 23 bp, Homo sapiens
gcagccctgaggaaagttctggg

SEQ ID NO: 13502 - DNA, 23 bp, Homo sapiens
gggagttccaacataatctaagg

SEQ ID NO: 13503 - DNA, 23 bp, Homo sapiens
gacgaattctcattccaaacagg

SEQ ID NO: 13504 - DNA, 23 bp, Homo sapiens
tttggctaactgttaaccccagg

SEQ ID NO: 13505 - DNA, 23 bp, Homo sapiens
aaaaccctattcatgatctctgg

SEQ ID NO: 13506 - DNA, 23 bp, Homo sapiens
aaggtcatgagaaggaaatgtgg

SEQ ID NO: 13507 - DNA, 23 bp, Homo sapiens
gagcaatgaaaaggtggctttgg

SEQ ID NO: 13508 - DNA, 23 bp, Homo sapiens
ccttgggtagagtgatcagaagg

SEQ ID NO: 13509 - DNA, 23 bp, Homo sapiens
atatccctcattagtcctagtgg

SEQ ID NO: 13510 - DNA, 23 bp, Homo sapiens
agaaagggaaaagcttcctgagg

SEQ ID NO: 13511 - DNA, 23 bp, Homo sapiens
taaaacacctactgaacagaagg

SEQ ID NO: 13512 - DNA, 23 bp, Homo sapiens
atagagtataggattcagcatgg

SEQ ID NO: 13513 - DNA, 23 bp, Homo sapiens
agattatggggtttaacatgggg

SEQ ID NO: 13514 - DNA, 23 bp, Homo sapiens
tagaaacaaggatgtgaaggagg

SEQ ID NO: 13515 - DNA, 23 bp, Homo sapiens
tctgcgaaacaaggatgtaaagg

SEQ ID NO: 13516 - DNA, 23 bp, Homo sapiens
taaaacacctaccgaacagaagg

SEQ ID NO: 13517 - DNA, 23 bp, Homo sapiens
ataaatgcagatgtctgctcagg

SEQ ID NO: 13518 - DNA, 23 bp, Homo sapiens
acggaacaaagaggtgaaagtgg

SEQ ID NO: 13519 - DNA, 23 bp, Homo sapiens
gatgcaggcaggaattaggaagg

SEQ ID NO: 13520 - DNA, 23 bp, Homo sapiens
aagatgttaaacgggcaataagg

SEQ ID NO: 13521 - DNA, 23 bp, Homo sapiens
ggggcaggagtcgggcctccagg

SEQ ID NO: 13522 - DNA, 23 bp, Homo sapiens
gctctggggatgttgataaaggg

SEQ ID NO: 13523 - DNA, 23 bp, Homo sapiens
ataatagggttaaagaggggagg

SEQ ID NO: 13524 - DNA, 23 bp, Homo sapiens
cttcacaaagagtctccacatgg

SEQ ID NO: 13525 - DNA, 23 bp, Homo sapiens
actgaggaagatgctgtcaaagg

SEQ ID NO: 13526 - DNA, 23 bp, Homo sapiens
tcttgttgaagagtttccgcagg

SEQ ID NO: 13527 - DNA, 23 bp, Homo sapiens
tcttgctgaagagtttctgtagg

SEQ ID NO: 13528 - DNA, 23 bp, Homo sapiens
caggctgcttgaatgggtgaagg

SEQ ID NO: 13529 - DNA, 23 bp, Homo sapiens
aggaacagggatatgaagagggg

SEQ ID NO: 13530 - DNA, 23 bp, Homo sapiens
aaggacatgcatggggctctggg

SEQ ID NO: 13531 - DNA, 23 bp, Homo sapiens
tcctatggagaccctttcagagg

SEQ ID NO: 13532 - DNA, 23 bp, Homo sapiens
tctgatgaatgactctgctcagg

SEQ ID NO: 13533 - DNA, 23 bp, Homo sapiens
tggaaagggtcatttgtaaaagg

SEQ ID NO: 13534 - DNA, 23 bp, Homo sapiens
ttgtgctgaagactctgcccagg

SEQ ID NO: 13535 - DNA, 23 bp, Homo sapiens
gaaaaaagtagttggcagggtgg

SEQ ID NO: 13536 - DNA, 23 bp, Homo sapiens
tgagaaagttaatctgggttcgg

SEQ ID NO: 13537 - DNA, 23 bp, Homo sapiens
tctagctgggaacagagacatgg

SEQ ID NO: 13538 - DNA, 23 bp, Homo sapiens
cttgagtaggtcaggcgcagtgg

SEQ ID NO: 13539 - DNA, 23 bp, Homo sapiens
ctctactgaagagtttcccaagg

SEQ ID NO: 13540 - DNA, 23 bp, Homo sapiens
cctggagagactcttcaacaggg

SEQ ID NO: 13541 - DNA, 23 bp, Homo sapiens
gagcccttctcattgggcgaagg

SEQ ID NO: 13542 - DNA, 23 bp, Homo sapiens
gtttggcaaagttgatgcacagg

SEQ ID NO: 13543 - DNA, 23 bp, Homo sapiens
agaaacaaagacatgaaacgggg

SEQ ID NO: 13544 - DNA, 23 bp, Homo sapiens
accctttcatctacagcctgagg

SEQ ID NO: 13545 - DNA, 23 bp, Homo sapiens
gaggggtttgaagaaattacagg

SEQ ID NO: 13546 - DNA, 23 bp, Homo sapiens
tcttgctcataagcttcctcagg

SEQ ID NO: 13547 - DNA, 23 bp, Homo sapiens
gaaaggggctctcaggaagctgg

SEQ ID NO: 13548 - DNA, 23 bp, Homo sapiens
taaagaggctcttcagtcacagg

SEQ ID NO: 13549 - DNA, 23 bp, Homo sapiens
ttgggtaaactttttgtcagtgg

SEQ ID NO: 13550 - DNA, 23 bp, Homo sapiens
tcaagggaggcttcatgaaatgg

SEQ ID NO: 13551 - DNA, 23 bp, Homo sapiens
ttctattgatgagctttctcagg

SEQ ID NO: 13552 - DNA, 23 bp, Homo sapiens
acattgatctctgtttccaaagg

SEQ ID NO: 13553 - DNA, 23 bp, Homo sapiens
ggagggcactgaggaaggagagg

SEQ ID NO: 13554 - DNA, 23 bp, Homo sapiens
ggtccatgagaacggtgtatggg

SEQ ID NO: 13555 - DNA, 23 bp, Homo sapiens
aagtccaaggtactctaaagagg

SEQ ID NO: 13556 - DNA, 23 bp, Homo sapiens
cctgaggagagcactgggcaagg

SEQ ID NO: 13557 - DNA, 23 bp, Homo sapiens
gtgccctgaaaagagtgttgtgg

SEQ ID NO: 13558 - DNA, 23 bp, Homo sapiens
gagagtgctgggagtagaaaggg

SEQ ID NO: 13559 - DNA, 23 bp, Homo sapiens
gcattcaacgactgcaattgtgg

SEQ ID NO: 13560 - DNA, 23 bp, Homo sapiens
ccagcacactccacgctctaggg

SEQ ID NO: 13561 - DNA, 23 bp, Homo sapiens
cctgggaaaatacatactgctgg

SEQ ID NO: 13562 - DNA, 23 bp, Homo sapiens
tgaggagactgttgggatattgg

SEQ ID NO: 13563 - DNA, 23 bp, Homo sapiens
aaaacaacccttcaaggatatgg

SEQ ID NO: 13564 - DNA, 23 bp, Homo sapiens
ctcaagacccaggctgtgacagg

SEQ ID NO: 13565 - DNA, 23 bp, Homo sapiens
gccaggatctggaggctctgtgg

SEQ ID NO: 13566 - DNA, 23 bp, Homo sapiens
aacttgcggagaagttagtaagg

SEQ ID NO: 13567 - DNA, 23 bp, Homo sapiens
tcttggcatcagcctcttgaagg

SEQ ID NO: 13568 - DNA, 23 bp, Homo sapiens
aaaggaaggctttaaaaggttgg

SEQ ID NO: 13569 - DNA, 23 bp, Homo sapiens
ctggggaaaggaagagaagttgg

SEQ ID NO: 13570 - DNA, 23 bp, Homo sapiens
ctgtggctctgcaggcaagctgg

SEQ ID NO: 13571 - DNA, 23 bp, Homo sapiens
ctctgaggaaagtagccacaagg

SEQ ID NO: 13572 - DNA, 23 bp, Homo sapiens
ggagaaagtgcttctctcatagg

SEQ ID NO: 13573 - DNA, 23 bp, Homo sapiens
ctctgggttaacatcaaagctgg

SEQ ID NO: 13574 - DNA, 23 bp, Homo sapiens
tctgggttaacatccaagctggg

SEQ ID NO: 13575 - DNA, 23 bp, Homo sapiens
aaagttctagcaaaggctctggg

SEQ ID NO: 13576 - DNA, 23 bp, Homo sapiens
gctctgaggaaacttctctcggg

SEQ ID NO: 13577 - DNA, 23 bp, Homo sapiens
tgctgctggacaaagccacaagg

SEQ ID NO: 13578 - DNA, 23 bp, Homo sapiens
aaagagactccagggaaagctgg

SEQ ID NO: 13579 - DNA, 23 bp, Homo sapiens
tggggctcacacaaagctgaggg

SEQ ID NO: 13580 - DNA, 23 bp, Homo sapiens
tgggaatgggggatgtgacaggg

SEQ ID NO: 13581 - DNA, 23 bp, Homo sapiens
gactattggggtgggagtggggg

SEQ ID NO: 13582 - DNA, 23 bp, Homo sapiens
agtgaagagactaatggggtggg

SEQ ID NO: 13583 - DNA, 23 bp, Homo sapiens
agatgctatgaagaaattgctgg

SEQ ID NO: 13584 - DNA, 23 bp, Homo sapiens
atggccatgattattctttcagg

SEQ ID NO: 13585 - DNA, 23 bp, Homo sapiens
ttttctgaatcacttgtgtcagg

SEQ ID NO: 13586 - DNA, 23 bp, Homo sapiens
tgagtcagagaatctgctctggg

SEQ ID NO: 13587 - DNA, 23 bp, Homo sapiens
tattctgaatcactcgtgtcagg

SEQ ID NO: 13588 - DNA, 23 bp, Homo sapiens
ttctctgactcactcgtgtcagg

SEQ ID NO: 13589 - DNA, 23 bp, Homo sapiens
agagcattcatgaagatcttagg

SEQ ID NO: 13590 - DNA, 23 bp, Homo sapiens
atcttaggaaagggcaagtctgg

SEQ ID NO: 13591 - DNA, 23 bp, Homo sapiens
agtgttcagggcactacagaagg

SEQ ID NO: 13592 - DNA, 23 bp, Homo sapiens
gtgttaggaaagggcaagtgtgg

SEQ ID NO: 13593 - DNA, 23 bp, Homo sapiens
caaaaggcttcactcagtgatgg

SEQ ID NO: 13594 - DNA, 23 bp, Homo sapiens
ggtcctcaaagggtgtcaggagg

SEQ ID NO: 13595 - DNA, 23 bp, Homo sapiens
caggaataaggatgtcacaaggg

SEQ ID NO: 13596 - DNA, 23 bp, Homo sapiens
cgtcataggggcatttaaaaagg

SEQ ID NO: 13597 - DNA, 23 bp, Homo sapiens
accagcaaaatgaggcccacagg

SEQ ID NO: 13598 - DNA, 23 bp, Homo sapiens
gtggcgactgtgatcaggaaggg

SEQ ID NO: 13599 - DNA, 23 bp, Homo sapiens
gaggtgtgtgtcctcaggaaagg

SEQ ID NO: 13600 - DNA, 23 bp, Homo sapiens
taggaataaggatgtcatggggg

SEQ ID NO: 13601 - DNA, 23 bp, Homo sapiens
aagatgtcaccagggctctgagg

SEQ ID NO: 13602 - DNA, 23 bp, Homo sapiens
acctgcctttcaaaaagctatgg

SEQ ID NO: 13603 - DNA, 23 bp, Homo sapiens
gggtgccttgaagagagttgtgg

SEQ ID NO: 13604 - DNA, 23 bp, Homo sapiens
aaggtgtatgggtcggtgtgtgg

SEQ ID NO: 13605 - DNA, 23 bp, Homo sapiens
gggctggaccgctgcaggatcgg

SEQ ID NO: 13606 - DNA, 23 bp, Homo sapiens
ttcttaaggtgtaaatgagcggg

SEQ ID NO: 13607 - DNA, 23 bp, Homo sapiens
ggggaagagagagctaggaaagg

SEQ ID NO: 13608 - DNA, 23 bp, Homo sapiens
ggctggggagcctcaacgagggg

SEQ ID NO: 13609 - DNA, 23 bp, Homo sapiens
tatggaggggcagggactcaggg

SEQ ID NO: 13610 - DNA, 23 bp, Homo sapiens
tgcttagcagagctggactcagg

SEQ ID NO: 13611 - DNA, 23 bp, Homo sapiens
gctcacagggaggcggtcactgg

SEQ ID NO: 13612 - DNA, 23 bp, Homo sapiens
gaggagatcactgacctgagagg

SEQ ID NO: 13613 - DNA, 23 bp, Homo sapiens
ctctgtgtcagctacttgtgggg

SEQ ID NO: 13614 - DNA, 23 bp, Homo sapiens
aagtaagcttagctgggaaatgg

SEQ ID NO: 13615 - DNA, 23 bp, Homo sapiens
gttctaaggcaacaaataggcgg

SEQ ID NO: 13616 - DNA, 23 bp, Homo sapiens
caagtgctatgaagaagctctgg

SEQ ID NO: 13617 - DNA, 23 bp, Homo sapiens
catacctccttacctacatgagg

SEQ ID NO: 13618 - DNA, 23 bp, Homo sapiens
caaaaaggagaatccagggaggg

SEQ ID NO: 13619 - DNA, 23 bp, Homo sapiens
gccatgagaaagttatggcatgg

SEQ ID NO: 13620 - DNA, 23 bp, Homo sapiens
aaagtgcaataaggaagctttgg

SEQ ID NO: 13621 - DNA, 23 bp, Homo sapiens
tttcatttgagcattcctcaagg

SEQ ID NO: 13622 - DNA, 23 bp, Homo sapiens
aatatggaacagactgatggtgg

SEQ ID NO: 13623 - DNA, 23 bp, Homo sapiens
aaagtgccatgaggaagctttgg

SEQ ID NO: 13624 - DNA, 23 bp, Homo sapiens
ccatgagaaagctctttacatgg

SEQ ID NO: 13625 - DNA, 23 bp, Homo sapiens
cacagtcacagctttgtcagtgg

SEQ ID NO: 13626 - DNA, 23 bp, Homo sapiens
tgtagtagaaaggacatttcagg

SEQ ID NO: 13627 - DNA, 23 bp, Homo sapiens
ctctggagccaaataatctgggg

SEQ ID NO: 13628 - DNA, 23 bp, Homo sapiens
tgaaatgggaggctttggctggg

SEQ ID NO: 13629 - DNA, 23 bp, Homo sapiens
caagtgcctagtaatttgcaggg

SEQ ID NO: 13630 - DNA, 23 bp, Homo sapiens
tcttctcttcagtctcctcatgg

SEQ ID NO: 13631 - DNA, 23 bp, Homo sapiens
aagactcgtgccttctgaaaggg

SEQ ID NO: 13632 - DNA, 23 bp, Homo sapiens
aagattagggagacaccggctgg

SEQ ID NO: 13633 - DNA, 23 bp, Homo sapiens
aatgtaagggtctgtgctccagg

SEQ ID NO: 13634 - DNA, 23 bp, Homo sapiens
cttccgagagcagaaaatggggg

SEQ ID NO: 13635 - DNA, 23 bp, Homo sapiens
gacggctaggacaatcagaaagg

SEQ ID NO: 13636 - DNA, 23 bp, Homo sapiens
gtgccttaaacaagttagtgggg

SEQ ID NO: 13637 - DNA, 23 bp, Homo sapiens
aaagtgccatgaagcagctcagg

SEQ ID NO: 13638 - DNA, 23 bp, Homo sapiens
aagacatgaaagtggcaatgagg

SEQ ID NO: 13639 - DNA, 23 bp, Homo sapiens
gaggaacaaagacatgaagacgg

SEQ ID NO: 13640 - DNA, 23 bp, Homo sapiens
tggccgtgtatacacaaacatgg

SEQ ID NO: 13641 - DNA, 23 bp, Homo sapiens
aacagctagtgatttacaagagg

SEQ ID NO: 13642 - DNA, 23 bp, Homo sapiens
aataagacggctgagaaaatggg

SEQ ID NO: 13643 - DNA, 23 bp, Homo sapiens
tagatgactggattcaaaacggg

SEQ ID NO: 13644 - DNA, 23 bp, Homo sapiens
gtgaactcctggaaaaactaggg

SEQ ID NO: 13645 - DNA, 23 bp, Homo sapiens
ctggcccttcagcagatactcgg

SEQ ID NO: 13646 - DNA, 23 bp, Homo sapiens
gaagaaactgcaaaaccgacggg

SEQ ID NO: 13647 - DNA, 23 bp, Homo sapiens
atgactacagaaacctgactagg

SEQ ID NO: 13648 - DNA, 23 bp, Homo sapiens
agctctccagagttttttcatgg

SEQ ID NO: 13649 - DNA, 23 bp, Homo sapiens
aagaagtaaagatagccatgagg

SEQ ID NO: 13650 - DNA, 23 bp, Homo sapiens
atggctgcttagtttcctcatgg

SEQ ID NO: 13651 - DNA, 23 bp, Homo sapiens
tgaaccattacctgaggccaagg

SEQ ID NO: 13652 - DNA, 23 bp, Homo sapiens
tctgtgcagaactaacatattgg

SEQ ID NO: 13653 - DNA, 23 bp, Homo sapiens
aaaggcagccatgaggaaggtgg

SEQ ID NO: 13654 - DNA, 23 bp, Homo sapiens
aaaggcagccatgaggaagttgg

SEQ ID NO: 13655 - DNA, 23 bp, Homo sapiens
agtgaaagcttccatgaaaaagg

SEQ ID NO: 13656 - DNA, 23 bp, Homo sapiens
tcgacatgtagtctgtcaagtgg

SEQ ID NO: 13657 - DNA, 23 bp, Homo sapiens
ttgacttaacaacttcctcatgg

SEQ ID NO: 13658 - DNA, 23 bp, Homo sapiens
agaacgccatgaggaaagtgtgg

SEQ ID NO: 13659 - DNA, 23 bp, Homo sapiens
tgggcttacttggaaaaagcagg

SEQ ID NO: 13660 - DNA, 23 bp, Homo sapiens
caaggcaatggaatgccacatgg

SEQ ID NO: 13661 - DNA, 23 bp, Homo sapiens
tagggtcaagaggagcttagggg

SEQ ID NO: 13662 - DNA, 23 bp, Homo sapiens
atgttttcttggaggctaaaggg

SEQ ID NO: 13663 - DNA, 23 bp, Homo sapiens
gccatgaggagatttattggggg

SEQ ID NO: 13664 - DNA, 23 bp, Homo sapiens
ccatgaagaggctgtggattagg

SEQ ID NO: 13665 - DNA, 23 bp, Homo sapiens
acaattggtttcatcagcggagg

SEQ ID NO: 13666 - DNA, 23 bp, Homo sapiens
taaacaattgggttcgtcagtgg

SEQ ID NO: 13667 - DNA, 23 bp, Homo sapiens
gggaagttgcttaatgtatgtgg

SEQ ID NO: 13668 - DNA, 23 bp, Homo sapiens
tccgccttttatctaaacatagg

SEQ ID NO: 13669 - DNA, 23 bp, Homo sapiens
cctattttctgggcagagtaggg

SEQ ID NO: 13670 - DNA, 23 bp, Homo sapiens
gagatcaggttccaattctatgg

SEQ ID NO: 13671 - DNA, 23 bp, Homo sapiens
aaaactaagcagattcagagtgg

SEQ ID NO: 13672 - DNA, 23 bp, Homo sapiens
ctctgtatgttctcacaaggtgg

SEQ ID NO: 13673 - DNA, 23 bp, Homo sapiens
cacacacgcttcagagccctagg

SEQ ID NO: 13674 - DNA, 23 bp, Homo sapiens
aaggacttgcaggctgtgggagg

SEQ ID NO: 13675 - DNA, 23 bp, Homo sapiens
gcagactgagcatagccttgcgg

SEQ ID NO: 13676 - DNA, 23 bp, Homo sapiens
taaataatagggttgagcacagg

SEQ ID NO: 13677 - DNA, 23 bp, Homo sapiens
gtcacttaggtgtttttggaagg

SEQ ID NO: 13678 - DNA, 23 bp, Homo sapiens
aggcatgcgtcactcgatcccgg

SEQ ID NO: 13679 - DNA, 23 bp, Homo sapiens
ggtcttcacactgtagacaatgg

SEQ ID NO: 13680 - DNA, 23 bp, Homo sapiens
ttccataaatcccaggcctgagg

SEQ ID NO: 13681 - DNA, 23 bp, Homo sapiens
ttttgatgtggtgaaacatgcgg

SEQ ID NO: 13682 - DNA, 23 bp, Homo sapiens
ctctaatagcattcggacaatgg

SEQ ID NO: 13683 - DNA, 23 bp, Homo sapiens
acaagtttgtcctaaggaggagg

SEQ ID NO: 13684 - DNA, 23 bp, Homo sapiens
tagccccaggactcatttactgg

SEQ ID NO: 13685 - DNA, 23 bp, Homo sapiens
aagaacaagcagatccaatgggg

SEQ ID NO: 13686 - DNA, 23 bp, Homo sapiens
ttgcagcccaggaaggtgggtgg

SEQ ID NO: 13687 - DNA, 23 bp, Homo sapiens
gaggggtcttaggggaagatggg

SEQ ID NO: 13688 - DNA, 23 bp, Homo sapiens
agaaaagagtctaagcattctgg

SEQ ID NO: 13689 - DNA, 23 bp, Homo sapiens
cacacagattcgcattcatgtgg

SEQ ID NO: 13690 - DNA, 23 bp, Homo sapiens
aatatggtcacgaatttgcttgg

SEQ ID NO: 13691 - DNA, 23 bp, Homo sapiens
tggtgctgtacctcccctctggg

SEQ ID NO: 13692 - DNA, 23 bp, Homo sapiens
caagcaaatccaggaacaggtgg

SEQ ID NO: 13693 - DNA, 23 bp, Homo sapiens
gactaagccaatactggaagggg

SEQ ID NO: 13694 - DNA, 23 bp, Homo sapiens
ttcatattgaagtcttccccagg

SEQ ID NO: 13695 - DNA, 23 bp, Homo sapiens
cacttgtgctctaatctgtttgg

SEQ ID NO: 13696 - DNA, 23 bp, Homo sapiens
aagagtacctaatacatacgagg

SEQ ID NO: 13697 - DNA, 23 bp, Homo sapiens
aatttgctctcggatctgcttgg

SEQ ID NO: 13698 - DNA, 23 bp, Homo sapiens
atattagggagacagtgctgagg

SEQ ID NO: 13699 - DNA, 23 bp, Homo sapiens
agattcgagagagagtgctgagg

SEQ ID NO: 13700 - DNA, 23 bp, Homo sapiens
gaccaagcagatcagagataagg

SEQ ID NO: 13701 - DNA, 23 bp, Homo sapiens
ctctttgaccactccaacctggg

SEQ ID NO: 13702 - DNA, 23 bp, Homo sapiens
gatattgtgttcatgaacccagg

SEQ ID NO: 13703 - DNA, 23 bp, Homo sapiens
cactcgttctcgaatctgtttgg

SEQ ID NO: 13704 - DNA, 23 bp, Homo sapiens
ccagagaaagaacatgtagatgg

SEQ ID NO: 13705 - DNA, 23 bp, Homo sapiens
cccaagaaaggatatgtagaggg

SEQ ID NO: 13706 - DNA, 23 bp, Homo sapiens
gctcagagtgtttacacaaaagg

SEQ ID NO: 13707 - DNA, 23 bp, Homo sapiens
agagccttctccaaataccaagg

SEQ ID NO: 13708 - DNA, 23 bp, Homo sapiens
taggttctttcttaagggaaagg

SEQ ID NO: 13709 - DNA, 23 bp, Homo sapiens
aagaccaagcagattcaggaagg

SEQ ID NO: 13710 - DNA, 23 bp, Homo sapiens
agtgttcattcacatgctgtagg

SEQ ID NO: 13711 - DNA, 23 bp, Homo sapiens
ttccagggtgataagggtgcagg

SEQ ID NO: 13712 - DNA, 23 bp, Homo sapiens
agggttatccaaggatgttgtgg

SEQ ID NO: 13713 - DNA, 23 bp, Homo sapiens
cgggctttttctgaatgtgaagg

SEQ ID NO: 13714 - DNA, 23 bp, Homo sapiens
tcttaacagcatacactgatagg

SEQ ID NO: 13715 - DNA, 23 bp, Homo sapiens
agaagttactgcagagagggagg

SEQ ID NO: 13716 - DNA, 23 bp, Homo sapiens
tgcagaggttgttgaagaaaggg

SEQ ID NO: 13717 - DNA, 23 bp, Homo sapiens
gaatccaaaacctgctgaagagg

SEQ ID NO: 13718 - DNA, 23 bp, Homo sapiens
gaatccagaacctgctgaggagg

SEQ ID NO: 13719 - DNA, 23 bp, Homo sapiens
taagggcaaacagcaccttttgg

SEQ ID NO: 13720 - DNA, 23 bp, Homo sapiens
ttcctaaagctggagttacttgg

SEQ ID NO: 13721 - DNA, 23 bp, Homo sapiens
ccctgtggaaggtgttggaaagg

SEQ ID NO: 13722 - DNA, 23 bp, Homo sapiens
gaccccgggatttctcacggtgg

SEQ ID NO: 13723 - DNA, 23 bp, Homo sapiens
acagagaatacactttgtcttgg

SEQ ID NO: 13724 - DNA, 23 bp, Homo sapiens
ttcccaggaaaatatgaaagtgg

SEQ ID NO: 13725 - DNA, 23 bp, Homo sapiens
tagatcagtgggtttaatgtagg

SEQ ID NO: 13726 - DNA, 23 bp, Homo sapiens
tctcttttgcaacctctttaagg

SEQ ID NO: 13727 - DNA, 23 bp, Homo sapiens
aggccctaaagaagatcttatgg

SEQ ID NO: 13728 - DNA, 23 bp, Homo sapiens
gatctacagtttgcggaacaagg

SEQ ID NO: 13729 - DNA, 23 bp, Homo sapiens
cctagacactgataaggtggtgg

SEQ ID NO: 13730 - DNA, 23 bp, Homo sapiens
ggtttggggtaggaaaacaatgg

SEQ ID NO: 13731 - DNA, 23 bp, Homo sapiens
gggaaggcaaaggcctctatagg

SEQ ID NO: 13732 - DNA, 23 bp, Homo sapiens
attcatgaaggttgttgagaagg

SEQ ID NO: 13733 - DNA, 23 bp, Homo sapiens
acactttcttgaatgcattctgg

SEQ ID NO: 13734 - DNA, 23 bp, Homo sapiens
aagaagtgaaaagtgctctctgg

SEQ ID NO: 13735 - DNA, 23 bp, Homo sapiens
aggcaaaattgtctgtaggatgg

SEQ ID NO: 13736 - DNA, 23 bp, Homo sapiens
gattccactgtccagggcagggg

SEQ ID NO: 13737 - DNA, 23 bp, Homo sapiens
acccattgatctacagccttagg

SEQ ID NO: 13738 - DNA, 23 bp, Homo sapiens
aagacgtgaaggatgctttctgg

SEQ ID NO: 13739 - DNA, 23 bp, Homo sapiens
tatttctcagactgtagatcagg

SEQ ID NO: 13740 - DNA, 23 bp, Homo sapiens
ggatacagtcaccgagatactgg

SEQ ID NO: 13741 - DNA, 23 bp, Homo sapiens
caggagtaaggaagtaaagaagg

SEQ ID NO: 13742 - DNA, 23 bp, Homo sapiens
tttctcagactgtagatgatagg

SEQ ID NO: 13743 - DNA, 23 bp, Homo sapiens
agacagagtctatcatatcttgg

SEQ ID NO: 13744 - DNA, 23 bp, Homo sapiens
gtttctcaggctgtagatcatgg

SEQ ID NO: 13745 - DNA, 23 bp, Homo sapiens
taaatcaacggattcagcactgg

SEQ ID NO: 13746 - DNA, 23 bp, Homo sapiens
cgtaaaggaggcagtgaaaaggg

SEQ ID NO: 13747 - DNA, 23 bp, Homo sapiens
accaaatttgcttgaagaagggg

SEQ ID NO: 13748 - DNA, 23 bp, Homo sapiens
ccaaatttgcttgaagaaggagg

SEQ ID NO: 13749 - DNA, 23 bp, Homo sapiens
gaaacaaatgtcatcccctctgg

SEQ ID NO: 13750 - DNA, 23 bp, Homo sapiens
aggagataaagatacaccagtgg

SEQ ID NO: 13751 - DNA, 23 bp, Homo sapiens
ggctccaaaattcactcctaggg

SEQ ID NO: 13752 - DNA, 23 bp, Homo sapiens
aaagctctcagaaaagtgatggg

SEQ ID NO: 13753 - DNA, 23 bp, Homo sapiens
gccatgcaacaaatgattagggg

SEQ ID NO: 13754 - DNA, 23 bp, Homo sapiens
tcccctaatcatttgttgtatgg

SEQ ID NO: 13755 - DNA, 23 bp, Homo sapiens
gaggaataaagatgtgaagcagg

SEQ ID NO: 13756 - DNA, 23 bp, Homo sapiens
tctgctgatcactttcatcatgg

SEQ ID NO: 13757 - DNA, 23 bp, Homo sapiens
gttcagcatagggattactgtgg

SEQ ID NO: 13758 - DNA, 23 bp, Homo sapiens
caatcaccaagacatatgtgagg

SEQ ID NO: 13759 - DNA, 23 bp, Homo sapiens
caggaacaaggagattaaggggg

SEQ ID NO: 13760 - DNA, 23 bp, Homo sapiens
tcaaagaaagccttggataaagg

SEQ ID NO: 13761 - DNA, 23 bp, Homo sapiens
gcggaacaaagatgtaaaggagg

SEQ ID NO: 13762 - DNA, 23 bp, Homo sapiens
atcccgtcatctacagtttgagg

SEQ ID NO: 13763 - DNA, 23 bp, Homo sapiens
atcccatcatctatagtttgagg

SEQ ID NO: 13764 - DNA, 23 bp, Homo sapiens
agtgagtttactatccaaagagg

SEQ ID NO: 13765 - DNA, 23 bp, Homo sapiens
gaggaacaaggatgtgaaagagg

SEQ ID NO: 13766 - DNA, 23 bp, Homo sapiens
agctagcagaaatgtatagaagg

SEQ ID NO: 13767 - DNA, 23 bp, Homo sapiens
gaagaaactggcatattgccagg

SEQ ID NO: 13768 - DNA, 23 bp, Homo sapiens
ttgaaaaaggccttgggcttggg

SEQ ID NO: 13769 - DNA, 23 bp, Homo sapiens
agagaggctggctgtgtatttgg

SEQ ID NO: 13770 - DNA, 23 bp, Homo sapiens
aagctttcattaacatggcaagg

SEQ ID NO: 13771 - DNA, 23 bp, Homo sapiens
tttcacttgcttgttcctcaagg

SEQ ID NO: 13772 - DNA, 23 bp, Homo sapiens
tttgtggaccacatttttgaagg

SEQ ID NO: 13773 - DNA, 23 bp, Homo sapiens
gcaagtgaaacaagctttcaagg

SEQ ID NO: 13774 - DNA, 23 bp, Homo sapiens
gcaggtgaaagaagtcttctggg

SEQ ID NO: 13775 - DNA, 23 bp, Homo sapiens
gcaggtgaaacaggcccttaggg

SEQ ID NO: 13776 - DNA, 23 bp, Homo sapiens
caagccatctgcaaaagaagagg

SEQ ID NO: 13777 - DNA, 23 bp, Homo sapiens
gcaactctttcattcgctgatgg

SEQ ID NO: 13778 - DNA, 23 bp, Homo sapiens
aataaagggattcaacatggggg

SEQ ID NO: 13779 - DNA, 23 bp, Homo sapiens
gaagcaagccttcaagagcatgg

SEQ ID NO: 13780 - DNA, 23 bp, Homo sapiens
gcaggtgaaacaagcatttaagg

SEQ ID NO: 13781 - DNA, 23 bp, Homo sapiens
actctgctgaagaaatggaaggg

SEQ ID NO: 13782 - DNA, 23 bp, Homo sapiens
agctcctctctttctaacactgg

SEQ ID NO: 13783 - DNA, 23 bp, Homo sapiens
aatatcttacttgaggtccctgg

SEQ ID NO: 13784 - DNA, 23 bp, Homo sapiens
aaagtgttgaacaagcctggagg

SEQ ID NO: 13785 - DNA, 23 bp, Homo sapiens
agaagagggctggttgggctggg

SEQ ID NO: 13786 - DNA, 23 bp, Homo sapiens
cttgaggaatgagaaggtacagg

SEQ ID NO: 13787 - DNA, 23 bp, Homo sapiens
ggaggcagctaaagagaattggg

SEQ ID NO: 13788 - DNA, 23 bp, Homo sapiens
gactagctttatctcccttctgg

SEQ ID NO: 13789 - DNA, 23 bp, Homo sapiens
tcactatcctagggatgttcagg

SEQ ID NO: 13790 - DNA, 23 bp, Homo sapiens
aaggaagtgaagggagctctggg

SEQ ID NO: 13791 - DNA, 23 bp, Homo sapiens
aggtagtggcaggcgttttaggg

SEQ ID NO: 13792 - DNA, 23 bp, Homo sapiens
aactgagggtcacaagtcaaagg

SEQ ID NO: 13793 - DNA, 23 bp, Homo sapiens
gaggctgaaaggcctttgcaagg

SEQ ID NO: 13794 - DNA, 23 bp, Homo sapiens
tactttgcatgaccagtctttgg

SEQ ID NO: 13795 - DNA, 23 bp, Homo sapiens
aagtgggccccagggaaatgggg

SEQ ID NO: 13796 - DNA, 23 bp, Homo sapiens
accccttcatctacagtctgagg

SEQ ID NO: 13797 - DNA, 23 bp, Homo sapiens
gctctgaaaatgtccttcagagg

SEQ ID NO: 13798 - DNA, 23 bp, Homo sapiens
gcttagagccctgcaatcatggg

SEQ ID NO: 13799 - DNA, 23 bp, Homo sapiens
tttaatggtgacatcactgcagg

SEQ ID NO: 13800 - DNA, 23 bp, Homo sapiens
gggcaacgtctctcaaagagggg

SEQ ID NO: 13801 - DNA, 23 bp, Homo sapiens
gggcagcctcttgtttgtgatgg

SEQ ID NO: 13802 - DNA, 23 bp, Homo sapiens
gatttgtcatggacaagagtcgg

SEQ ID NO: 13803 - DNA, 23 bp, Homo sapiens
agtgccctgtgcaggctgcatgg

SEQ ID NO: 13804 - DNA, 23 bp, Homo sapiens
aggagatgaagaaagctttgagg

SEQ ID NO: 13805 - DNA, 23 bp, Homo sapiens
gtgccatttgctttggattcagg

SEQ ID NO: 13806 - DNA, 23 bp, Homo sapiens
aggacatgttgaaggctttgagg

SEQ ID NO: 13807 - DNA, 23 bp, Homo sapiens
gccgtgcagaaaacgctgagggg

SEQ ID NO: 13808 - DNA, 23 bp, Homo sapiens
gttgccctgaggagaactttggg

SEQ ID NO: 13809 - DNA, 23 bp, Homo sapiens
aggatgtcaaagttgcactgagg

SEQ ID NO: 13810 - DNA, 23 bp, Homo sapiens
ctctcttcagggttttgcccagg

SEQ ID NO: 13811 - DNA, 23 bp, Homo sapiens
ctttgacgtccttattcctcagg

SEQ ID NO: 13812 - DNA, 23 bp, Homo sapiens
gcattaaggaaggtcttagtagg

SEQ ID NO: 13813 - DNA, 23 bp, Homo sapiens
tgaagaagatgactaggggaagg

SEQ ID NO: 13814 - DNA, 23 bp, Homo sapiens
atcccttgatatatagtctgagg

SEQ ID NO: 13815 - DNA, 23 bp, Homo sapiens
ttctctgtagcattttcttcagg

SEQ ID NO: 13816 - DNA, 23 bp, Homo sapiens
tttcttaggctatagattggggg

SEQ ID NO: 13817 - DNA, 23 bp, Homo sapiens
ttgccctgaagaaaacgctaggg

SEQ ID NO: 13818 - DNA, 23 bp, Homo sapiens
tgcagagaagacaggactccagg

SEQ ID NO: 13819 - DNA, 23 bp, Homo sapiens
atccactcatctacagtctgagg

SEQ ID NO: 13820 - DNA, 23 bp, Homo sapiens
gatctacagcctgaggaataagg

SEQ ID NO: 13821 - DNA, 23 bp, Homo sapiens
atcccttgatctacagcctgagg

SEQ ID NO: 13822 - DNA, 23 bp, Homo sapiens
atccgttgatctacagcctaagg

SEQ ID NO: 13823 - DNA, 23 bp, Homo sapiens
aatatgccctacgaaggacatgg

SEQ ID NO: 13824 - DNA, 23 bp, Homo sapiens
ttacagcttaagaaacgaagagg

SEQ ID NO: 13825 - DNA, 23 bp, Homo sapiens
cgcgctgcgcgcggcgcccacgg

SEQ ID NO: 13826 - DNA, 23 bp, Homo sapiens
ctggcagtcaccatattctatgg

SEQ ID NO: 13827 - DNA, 23 bp, Homo sapiens
ctatagcctccagaataaggagg

SEQ ID NO: 13828 - DNA, 23 bp, Homo sapiens
agcagcgtttcatcccatctcgg

SEQ ID NO: 13829 - DNA, 23 bp, Homo sapiens
aacgctgctgtcaactattcagg

SEQ ID NO: 13830 - DNA, 23 bp, Homo sapiens
agtctgtgttgctttcctgaagg

SEQ ID NO: 13831 - DNA, 23 bp, Homo sapiens
aaggaataaggatgtgaaagagg

SEQ ID NO: 13832 - DNA, 23 bp, Homo sapiens
aaaggtcgctaggagactccagg

SEQ ID NO: 13833 - DNA, 23 bp, Homo sapiens
gaggaacaaagatgtccaagagg

SEQ ID NO: 13834 - DNA, 23 bp, Homo sapiens
tggagatggttaggacaacttgg

SEQ ID NO: 13835 - DNA, 23 bp, Homo sapiens
gcctgctagaagaccctaaatgg

SEQ ID NO: 13836 - DNA, 23 bp, Homo sapiens
gcccggcagccactatgcctagg

SEQ ID NO: 13837 - DNA, 23 bp, Homo sapiens
cagcctgcaggtcttgtgagggg

SEQ ID NO: 13838 - DNA, 23 bp, Homo sapiens
tatcagatgcccccttgaggagg

SEQ ID NO: 13839 - DNA, 23 bp, Homo sapiens
tcgcctgcagggggagctgcagg

SEQ ID NO: 13840 - DNA, 23 bp, Homo sapiens
tccggactttcattttgaggagg

SEQ ID NO: 13841 - DNA, 23 bp, Homo sapiens
gcgctgaaagacgagtaaagggg

SEQ ID NO: 13842 - DNA, 23 bp, Homo sapiens
cttggaaaaggaagaagaggagg

SEQ ID NO: 13843 - DNA, 23 bp, Homo sapiens
gtggcaagactaacatggggagg

SEQ ID NO: 13844 - DNA, 23 bp, Homo sapiens
gggcaacatcctcactaagctgg

SEQ ID NO: 13845 - DNA, 23 bp, Homo sapiens
acttcatcagagctattgcaagg

SEQ ID NO: 13846 - DNA, 23 bp, Homo sapiens
atactaaagagcattcagtcagg

SEQ ID NO: 13847 - DNA, 23 bp, Homo sapiens
aaatgctgccagtgctcaaaagg

SEQ ID NO: 13848 - DNA, 23 bp, Homo sapiens
ggaggagggggaatcctagcagg

SEQ ID NO: 13849 - DNA, 23 bp, Homo sapiens
ctacatggtgttcggatctttgg

SEQ ID NO: 13850 - DNA, 23 bp, Homo sapiens
ttggcatcaacaaatactgaggg

SEQ ID NO: 13851 - DNA, 23 bp, Homo sapiens
ctccacggagtccggatttttgg

SEQ ID NO: 13852 - DNA, 23 bp, Homo sapiens
ctcagaagtcaaattcgtccagg

SEQ ID NO: 13853 - DNA, 23 bp, Homo sapiens
tgcccggacattttctgaaacgg

SEQ ID NO: 13854 - DNA, 23 bp, Homo sapiens
gggtggcgctcagaagatgttgg

SEQ ID NO: 13855 - DNA, 23 bp, Homo sapiens
ctctggaaagcacactgatgggg

SEQ ID NO: 13856 - DNA, 23 bp, Homo sapiens
gatagtatgtgtcactctgctgg

SEQ ID NO: 13857 - DNA, 23 bp, Homo sapiens
gatttactctggcagctactggg

SEQ ID NO: 13858 - DNA, 23 bp, Homo sapiens
actgcccagatatctactgaggg

SEQ ID NO: 13859 - DNA, 23 bp, Homo sapiens
tgctgtgacgaggctcacagtgg

SEQ ID NO: 13860 - DNA, 23 bp, Homo sapiens
aactggaccatcctgtcttatgg

SEQ ID NO: 13861 - DNA, 23 bp, Homo sapiens
gccctcagggctcctatttgagg

SEQ ID NO: 13862 - DNA, 23 bp, Homo sapiens
agccctgttctttggtagactgg

SEQ ID NO: 13863 - DNA, 23 bp, Homo sapiens
gggccagggctaccagagcacgg

SEQ ID NO: 13864 - DNA, 23 bp, Homo sapiens
tgacttgaagcaaaatcaggagg

SEQ ID NO: 13865 - DNA, 23 bp, Homo sapiens
ggtgctgccaagcattaggttgg

SEQ ID NO: 13866 - DNA, 23 bp, Homo sapiens
gcagtgctcctggggctcagggg

SEQ ID NO: 13867 - DNA, 23 bp, Homo sapiens
gagctggaggactagactcctgg

SEQ ID NO: 13868 - DNA, 23 bp, Homo sapiens
agaactttgagttttgtacctgg

SEQ ID NO: 13869 - DNA, 23 bp, Homo sapiens
cagctataactcatccatcatgg

SEQ ID NO: 13870 - DNA, 23 bp, Homo sapiens
tgtacatcatttctgccatgtgg

SEQ ID NO: 13871 - DNA, 23 bp, Homo sapiens
ttgatcttattagtccctccagg

SEQ ID NO: 13872 - DNA, 23 bp, Homo sapiens
tttgatatgtctactccaagagg

SEQ ID NO: 13873 - DNA, 23 bp, Homo sapiens
ggtctggccgagtgttagggtgg

SEQ ID NO: 13874 - DNA, 23 bp, Homo sapiens
ttgaaagaggaggaggagatggg

SEQ ID NO: 13875 - DNA, 23 bp, Homo sapiens
aggggtgctctcgaggctaccgg

SEQ ID NO: 13876 - DNA, 23 bp, Homo sapiens
ggttagcagtagtgttcacctgg

SEQ ID NO: 13877 - DNA, 23 bp, Homo sapiens
atagtaactccaactctcagtgg

SEQ ID NO: 13878 - DNA, 23 bp, Homo sapiens
gtgaaacaaagacacgttagtgg

SEQ ID NO: 13879 - DNA, 23 bp, Homo sapiens
gacgctacactcacaggtgaagg

SEQ ID NO: 13880 - DNA, 23 bp, Homo sapiens
cttctctagaagtcctgccgcgg

SEQ ID NO: 13881 - DNA, 23 bp, Homo sapiens
ggcgaaactgtgatctgcggcgg

SEQ ID NO: 13882 - DNA, 23 bp, Homo sapiens
taggattaaggaagactctgagg

SEQ ID NO: 13883 - DNA, 23 bp, Homo sapiens
aaactgccgggctatctgatggg

SEQ ID NO: 13884 - DNA, 23 bp, Homo sapiens
agattccttcttctgttcattgg

SEQ ID NO: 13885 - DNA, 23 bp, Homo sapiens
cagtagctttcttggcctacagg

SEQ ID NO: 13886 - DNA, 23 bp, Homo sapiens
ttcatcatcgagatagtcctcgg

SEQ ID NO: 13887 - DNA, 23 bp, Homo sapiens
ggtactggacttgagacgtttgg

SEQ ID NO: 13888 - DNA, 23 bp, Homo sapiens
aattggaatcaattagcctctgg

SEQ ID NO: 13889 - DNA, 23 bp, Homo sapiens
aatttaggcttctggagctgagg

SEQ ID NO: 13890 - DNA, 23 bp, Homo sapiens
ggccaagctcctgtggtgagtgg

SEQ ID NO: 13891 - DNA, 23 bp, Homo sapiens
aaaagctccttggggcatgaagg

SEQ ID NO: 13892 - DNA, 23 bp, Homo sapiens
gccactgggctcaggccccgagg

SEQ ID NO: 13893 - DNA, 23 bp, Homo sapiens
ccaccgactgtgcctgccagtgg

SEQ ID NO: 13894 - DNA, 23 bp, Homo sapiens
acccaagggtttaattccactgg

SEQ ID NO: 13895 - DNA, 23 bp, Homo sapiens
ttgtacccagaggaaacttctgg

SEQ ID NO: 13896 - DNA, 23 bp, Homo sapiens
tcttacaatagacctcaaagagg

SEQ ID NO: 13897 - DNA, 23 bp, Homo sapiens
gaggtctacgtgctgtcctgagg

SEQ ID NO: 13898 - DNA, 23 bp, Homo sapiens
gaggtctacctgggggcctgagg

SEQ ID NO: 13899 - DNA, 23 bp, Homo sapiens
taccaaggaagttcccaccacgg

SEQ ID NO: 13900 - DNA, 23 bp, Homo sapiens
tccctatcaggaggactgaatgg

SEQ ID NO: 13901 - DNA, 23 bp, Homo sapiens
ctgtgtgctctagcgccttgcgg

SEQ ID NO: 13902 - DNA, 23 bp, Homo sapiens
ggagccagccctatttgtagagg

SEQ ID NO: 13903 - DNA, 23 bp, Homo sapiens
aatgtttatcggctgcataaagg

SEQ ID NO: 13904 - DNA, 23 bp, Homo sapiens
cgaagaacttgccaaatctatgg

SEQ ID NO: 13905 - DNA, 23 bp, Homo sapiens
aaagagtcagatgttgagagcgg

SEQ ID NO: 13906 - DNA, 23 bp, Homo sapiens
ataggggacagcacacttgatgg

SEQ ID NO: 13907 - DNA, 23 bp, Homo sapiens
tgtgatggaactagacacgttgg

SEQ ID NO: 13908 - DNA, 23 bp, Homo sapiens
cgcccccagacaagagttgatgg

SEQ ID NO: 13909 - DNA, 23 bp, Homo sapiens
ctcagcgccttggggcctacagg

SEQ ID NO: 13910 - DNA, 23 bp, Homo sapiens
ttataattcggttacacggttgg

SEQ ID NO: 13911 - DNA, 23 bp, Homo sapiens
gcgcggggcccggccctgagcgg

SEQ ID NO: 13912 - DNA, 23 bp, Homo sapiens
gtgcacaggtgtgcttctaaggg

SEQ ID NO: 13913 - DNA, 23 bp, Homo sapiens
ctggtgcacaggttctgaacggg

SEQ ID NO: 13914 - DNA, 23 bp, Homo sapiens
agcatgcgtctctcatagactgg

SEQ ID NO: 13915 - DNA, 23 bp, Homo sapiens
attcctgggctcacaagacctgg

SEQ ID NO: 13916 - DNA, 23 bp, Homo sapiens
ctacaggtcttcacaaaacctgg

SEQ ID NO: 13917 - DNA, 23 bp, Homo sapiens
tgatctttcactctgcaaactgg

SEQ ID NO: 13918 - DNA, 23 bp, Homo sapiens
gtttacgaaggatttggaccagg

SEQ ID NO: 13919 - DNA, 23 bp, Homo sapiens
agaggatgaatcaatgtttctgg

SEQ ID NO: 13920 - DNA, 23 bp, Homo sapiens
aatcccagaaaactctgctgtgg

SEQ ID NO: 13921 - DNA, 23 bp, Homo sapiens
ccagggctcgagccactcacagg

SEQ ID NO: 13922 - DNA, 23 bp, Homo sapiens
gaggaggaggagaggaagtgagg

SEQ ID NO: 13923 - DNA, 23 bp, Homo sapiens
ctgcaccgcgcagcctgatacgg

SEQ ID NO: 13924 - DNA, 23 bp, Homo sapiens
tatccctggcacgacacacttgg

SEQ ID NO: 13925 - DNA, 23 bp, Homo sapiens
caatttgcgatctgctgcattgg

SEQ ID NO: 13926 - DNA, 23 bp, Homo sapiens
gcagcaggtggcaccctgacggg

SEQ ID NO: 13927 - DNA, 23 bp, Homo sapiens
aaggctcctcccagggctgaggg

SEQ ID NO: 13928 - DNA, 23 bp, Homo sapiens
cagtgagatgcaaagtaagcggg

SEQ ID NO: 13929 - DNA, 23 bp, Homo sapiens
cggctgcacaccaggtgcggagg

SEQ ID NO: 13930 - DNA, 23 bp, Homo sapiens
cttcctctcccaaggctaagcgg

SEQ ID NO: 13931 - DNA, 23 bp, Homo sapiens
ctttgagaagtggtggtaggagg

SEQ ID NO: 13932 - DNA, 23 bp, Homo sapiens
aagcccagatttcaatatcttgg

SEQ ID NO: 13933 - DNA, 23 bp, Homo sapiens
aatgcaacactttgtattgctgg

SEQ ID NO: 13934 - DNA, 23 bp, Homo sapiens
tggtttagctgatgctgagctgg

SEQ ID NO: 13935 - DNA, 23 bp, Homo sapiens
gagccatcaagtttcagcgctgg

SEQ ID NO: 13936 - DNA, 23 bp, Homo sapiens
ctggctggtgggtcacgccgtgg

SEQ ID NO: 13937 - DNA, 23 bp, Homo sapiens
tgggcctgcaggagaacatgagg

SEQ ID NO: 13938 - DNA, 23 bp, Homo sapiens
acccacagaccccaaaggtttgg

SEQ ID NO: 13939 - DNA, 23 bp, Homo sapiens
agctgtggccagattaataatgg

SEQ ID NO: 13940 - DNA, 23 bp, Homo sapiens
gccctggaaagaggccctagtgg

SEQ ID NO: 13941 - DNA, 23 bp, Homo sapiens
aggtgtggggtaggcctcactgg

SEQ ID NO: 13942 - DNA, 23 bp, Homo sapiens
catcaccccagagaaatttctgg

SEQ ID NO: 13943 - DNA, 23 bp, Homo sapiens
cacagctcctggagccccacagg

SEQ ID NO: 13944 - DNA, 23 bp, Homo sapiens
aaccagcagggaacggctacagg

SEQ ID NO: 13945 - DNA, 23 bp, Homo sapiens
gactgtctgctggggttcaaggg

SEQ ID NO: 13946 - DNA, 23 bp, Homo sapiens
cacggtgcctggcttcagtaagg

SEQ ID NO: 13947 - DNA, 23 bp, Homo sapiens
ggagattcttgtgccttcacagg

SEQ ID NO: 13948 - DNA, 23 bp, Homo sapiens
gagagtggttcatcaatgattgg

SEQ ID NO: 13949 - DNA, 23 bp, Homo sapiens
cgtgagctgagccaatgatgtgg

SEQ ID NO: 13950 - DNA, 23 bp, Homo sapiens
tacattggagtctcttcatttgg

SEQ ID NO: 13951 - DNA, 23 bp, Homo sapiens
tatgtacagttgtcagcctaagg

SEQ ID NO: 13952 - DNA, 23 bp, Homo sapiens
aggtcattctgagcttttaatgg

SEQ ID NO: 13953 - DNA, 23 bp, Homo sapiens
cactaaggacattcggctgtagg

SEQ ID NO: 13954 - DNA, 23 bp, Homo sapiens
agggcagatagattgtaacacgg

SEQ ID NO: 13955 - DNA, 23 bp, Homo sapiens
acagccaaatggcagaggcaggg

SEQ ID NO: 13956 - DNA, 23 bp, Homo sapiens
agaacacactctcctgcctctgg

SEQ ID NO: 13957 - DNA, 23 bp, Homo sapiens
acgctgtcatagctcatccttgg

SEQ ID NO: 13958 - DNA, 23 bp, Homo sapiens
cagggtgcaggcagatgacctgg

SEQ ID NO: 13959 - DNA, 23 bp, Homo sapiens
tctctcagctgctacttcccagg

SEQ ID NO: 13960 - DNA, 23 bp, Homo sapiens
ttctggatcaagaacagcaaggg

SEQ ID NO: 13961 - DNA, 23 bp, Homo sapiens
ggttcgggaggagctgtgagtgg

SEQ ID NO: 13962 - DNA, 23 bp, Homo sapiens
gagcctgaactcgcatgagaagg

SEQ ID NO: 13963 - DNA, 23 bp, Homo sapiens
accttgtacgttgtcagaattgg

SEQ ID NO: 13964 - DNA, 23 bp, Homo sapiens
tcaacttctgttgatccacaagg

SEQ ID NO: 13965 - DNA, 23 bp, Homo sapiens
ctgccaacagttcagtcttcagg

SEQ ID NO: 13966 - DNA, 23 bp, Homo sapiens
tgtacattctcagtgtcccctgg

SEQ ID NO: 13967 - DNA, 23 bp, Homo sapiens
agcagaggagccagacatggagg

SEQ ID NO: 13968 - DNA, 23 bp, Homo sapiens
atgcgcgcgtggaactctgaggg

SEQ ID NO: 13969 - DNA, 23 bp, Homo sapiens
aatgaagctggggactgaggtgg

SEQ ID NO: 13970 - DNA, 23 bp, Homo sapiens
tgctctttccaagaagtcagagg

SEQ ID NO: 13971 - DNA, 23 bp, Homo sapiens
ttaaacagttggaacaccggtgg

SEQ ID NO: 13972 - DNA, 23 bp, Homo sapiens
tttcagtgcatgtacgccttcgg

SEQ ID NO: 13973 - DNA, 23 bp, Homo sapiens
cctgggatgtcttcatcgcaagg

SEQ ID NO: 13974 - DNA, 23 bp, Homo sapiens
aaagcagttaacagtgctaccgg

SEQ ID NO: 13975 - DNA, 23 bp, Homo sapiens
tcggtttttccttgtctaagagg

SEQ ID NO: 13976 - DNA, 23 bp, Homo sapiens
tgccttggcccagagacactagg

SEQ ID NO: 13977 - DNA, 23 bp, Homo sapiens
ttattctcagcacctgcgcctgg

SEQ ID NO: 13978 - DNA, 23 bp, Homo sapiens
gccgggctagagcgacatcatgg

SEQ ID NO: 13979 - DNA, 23 bp, Homo sapiens
atcgggtcttccctttaatacgg

SEQ ID NO: 13980 - DNA, 23 bp, Homo sapiens
cccagcccctctctcaaaatcgg

SEQ ID NO: 13981 - DNA, 23 bp, Homo sapiens
gtttagcaagcaagactcgtagg

SEQ ID NO: 13982 - DNA, 23 bp, Homo sapiens
aaagctgttactggctgttatgg

SEQ ID NO: 13983 - DNA, 23 bp, Homo sapiens
ctcccttcttcaacagcatatgg

SEQ ID NO: 13984 - DNA, 23 bp, Homo sapiens
ctgggagacagggcctcaggtgg

SEQ ID NO: 13985 - DNA, 23 bp, Homo sapiens
ccctggtgggtggggctagaagg

SEQ ID NO: 13986 - DNA, 23 bp, Homo sapiens
actacgtggaggctatctagagg

SEQ ID NO: 13987 - DNA, 23 bp, Homo sapiens
gcctgtccccgactcatcactgg

SEQ ID NO: 13988 - DNA, 23 bp, Homo sapiens
gccaactacgtggagtgtgtggg

SEQ ID NO: 13989 - DNA, 23 bp, Homo sapiens
tcccttcaaatggtggaacatgg

SEQ ID NO: 13990 - DNA, 23 bp, Homo sapiens
agcccttcaccttcaagtggtgg

SEQ ID NO: 13991 - DNA, 23 bp, Homo sapiens
ctctttcaagtggtggaacatgg

SEQ ID NO: 13992 - DNA, 23 bp, Homo sapiens
ctccttcaagtggtggaacatgg

SEQ ID NO: 13993 - DNA, 23 bp, Homo sapiens
tgccttcaaatggtggaagatgg

SEQ ID NO: 13994 - DNA, 23 bp, Homo sapiens
cttgctggacttgaaacagatgg

SEQ ID NO: 13995 - DNA, 23 bp, Homo sapiens
ggcaggagctcacctagaaacgg

SEQ ID NO: 13996 - DNA, 23 bp, Homo sapiens
actgtcactatcagcttcactgg

SEQ ID NO: 13997 - DNA, 23 bp, Homo sapiens
gcagcaaagcacttttctagtgg

SEQ ID NO: 13998 - DNA, 23 bp, Homo sapiens
gccgaaggagacacaatcaacgg

SEQ ID NO: 13999 - DNA, 23 bp, Homo sapiens
acaaaccaccattgcctgactgg

SEQ ID NO: 14000 - DNA, 23 bp, Homo sapiens
agaaaagtccagatggactgagg

SEQ ID NO: 14001 - DNA, 23 bp, Homo sapiens
caagtttggagaatcagtgtagg

SEQ ID NO: 14002 - DNA, 23 bp, Homo sapiens
tatcaacacaaggcagccacagg

SEQ ID NO: 14003 - DNA, 23 bp, Homo sapiens
gcagcaggatgcttagggtgcgg

SEQ ID NO: 14004 - DNA, 23 bp, Homo sapiens
aaatggccagttgtgcctacagg

SEQ ID NO: 14005 - DNA, 23 bp, Homo sapiens
tcttctgggttgctagagcctgg

SEQ ID NO: 14006 - DNA, 23 bp, Homo sapiens
agaggaggtgaaaacacctgagg

SEQ ID NO: 14007 - DNA, 23 bp, Homo sapiens
ctcactaaagtgctggaagcagg

SEQ ID NO: 14008 - DNA, 23 bp, Homo sapiens
cctgttaaaataccagaagcagg

SEQ ID NO: 14009 - DNA, 23 bp, Homo sapiens
catgctaagactaaagaagcagg

SEQ ID NO: 14010 - DNA, 23 bp, Homo sapiens
cccactaaagtgctggaagcagg

SEQ ID NO: 14011 - DNA, 23 bp, Homo sapiens
gtagtctcttccctcggcagcgg

SEQ ID NO: 14012 - DNA, 23 bp, Homo sapiens
ttttctggagggcactgcaaagg

SEQ ID NO: 14013 - DNA, 23 bp, Homo sapiens
cacatggatttccttgaagcagg

SEQ ID NO: 14014 - DNA, 23 bp, Homo sapiens
tcataagcttcttctatctctgg

SEQ ID NO: 14015 - DNA, 23 bp, Homo sapiens
tttgttcctggggtgaagtacgg

SEQ ID NO: 14016 - DNA, 23 bp, Homo sapiens
tcggctcagtacttctctcctgg

SEQ ID NO: 14017 - DNA, 23 bp, Homo sapiens
actgattgctgcagctaaggagg

SEQ ID NO: 14018 - DNA, 23 bp, Homo sapiens
atcaaccaagaagaggaaaatgg

SEQ ID NO: 14019 - DNA, 23 bp, Homo sapiens
ggccacagcagtgatgttaacgg

SEQ ID NO: 14020 - DNA, 23 bp, Homo sapiens
tgtaaggcttgcagtcttagcgg

SEQ ID NO: 14021 - DNA, 23 bp, Homo sapiens
gaagggcgctgggcctcatctgg

SEQ ID NO: 14022 - DNA, 23 bp, Homo sapiens
tccccctcatgagacaatacagg

SEQ ID NO: 14023 - DNA, 23 bp, Homo sapiens
atacttggggtgggctcagcagg

SEQ ID NO: 14024 - DNA, 23 bp, Homo sapiens
ggggtgggctcagcaggtggagg

SEQ ID NO: 14025 - DNA, 23 bp, Homo sapiens
ttgctggctggacaaaaagatgg

SEQ ID NO: 14026 - DNA, 23 bp, Homo sapiens
ccccgaggacttgctgtaggggg

SEQ ID NO: 14027 - DNA, 23 bp, Homo sapiens
taacaagaatgctggattacagg

SEQ ID NO: 14028 - DNA, 23 bp, Homo sapiens
tgtgtcctgtactgccaggctgg

SEQ ID NO: 14029 - DNA, 23 bp, Homo sapiens
tgctgctccatcatgtgagccgg

SEQ ID NO: 14030 - DNA, 23 bp, Homo sapiens
attgacagcgctttttcttttgg

SEQ ID NO: 14031 - DNA, 23 bp, Homo sapiens
attcgttgtcttcttcctcctgg

SEQ ID NO: 14032 - DNA, 23 bp, Homo sapiens
aaagacgtgccagtgttgtgcgg

SEQ ID NO: 14033 - DNA, 23 bp, Homo sapiens
aatggcaaagctgggaaaaaagg

SEQ ID NO: 14034 - DNA, 23 bp, Homo sapiens
atcaaagcttggttttcaggagg

SEQ ID NO: 14035 - DNA, 23 bp, Homo sapiens
gggagccgagcagtcacgtatgg

SEQ ID NO: 14036 - DNA, 23 bp, Homo sapiens
aggtgctgccttttaaagactgg

SEQ ID NO: 14037 - DNA, 23 bp, Homo sapiens
agctgtcttctcctcagtgctgg

SEQ ID NO: 14038 - DNA, 23 bp, Homo sapiens
gaactgattgcagctgcaaatgg

SEQ ID NO: 14039 - DNA, 23 bp, Homo sapiens
tggagccgttggggcactgttgg

SEQ ID NO: 14040 - DNA, 23 bp, Homo sapiens
cctccccaggtaatgatcacggg

SEQ ID NO: 14041 - DNA, 23 bp, Homo sapiens
tggagcgtacaaatttgagcagg

SEQ ID NO: 14042 - DNA, 23 bp, Homo sapiens
gagcagttggtgcacttcttggg

SEQ ID NO: 14043 - DNA, 23 bp, Homo sapiens
ggcagctgcagcgcctcactcgg

SEQ ID NO: 14044 - DNA, 23 bp, Homo sapiens
cgctcggccagcacctaggcggg

SEQ ID NO: 14045 - DNA, 23 bp, Homo sapiens
gaatgcccgacagagacttctgg

SEQ ID NO: 14046 - DNA, 23 bp, Homo sapiens
acagtactcacgaccgttctcgg

SEQ ID NO: 14047 - DNA, 23 bp, Homo sapiens
tgagtactgtggagttttgaggg

SEQ ID NO: 14048 - DNA, 23 bp, Homo sapiens
gtgttcatcacatgccgagttgg

SEQ ID NO: 14049 - DNA, 23 bp, Homo sapiens
tgtgtctcacccaagtgctccgg

SEQ ID NO: 14050 - DNA, 23 bp, Homo sapiens
cccaggcccaggctctagctggg

SEQ ID NO: 14051 - DNA, 23 bp, Homo sapiens
tcttctgacagatttcagtctgg

SEQ ID NO: 14052 - DNA, 23 bp, Homo sapiens
tgctgtcctgaaaagataactgg

SEQ ID NO: 14053 - DNA, 23 bp, Homo sapiens
gcagcgctgactatctacagagg

SEQ ID NO: 14054 - DNA, 23 bp, Homo sapiens
ccgtgagcctcagcagataatgg

SEQ ID NO: 14055 - DNA, 23 bp, Homo sapiens
gctcagcccatctggcagtaggg

SEQ ID NO: 14056 - DNA, 23 bp, Homo sapiens
tgaagtacacaaaaggaagtagg

SEQ ID NO: 14057 - DNA, 23 bp, Homo sapiens
agagttgatgctattgcatttgg

SEQ ID NO: 14058 - DNA, 23 bp, Homo sapiens
ataacaggaataggatttgcagg

SEQ ID NO: 14059 - DNA, 23 bp, Homo sapiens
atcctctagactccaactatagg

SEQ ID NO: 14060 - DNA, 23 bp, Homo sapiens
ggcactgcttttaccgattaagg

SEQ ID NO: 14061 - DNA, 23 bp, Homo sapiens
cggggatacagccatggctaagg

SEQ ID NO: 14062 - DNA, 23 bp, Homo sapiens
tccaccctcccagctctcaaagg

SEQ ID NO: 14063 - DNA, 23 bp, Homo sapiens
ttactgattttcttctgccttgg

SEQ ID NO: 14064 - DNA, 23 bp, Homo sapiens
caaatccttggagaaagcttagg

SEQ ID NO: 14065 - DNA, 23 bp, Homo sapiens
caaaggcttagttcttctccagg

SEQ ID NO: 14066 - DNA, 23 bp, Homo sapiens
tgtgaaacatagtcaggacaagg

SEQ ID NO: 14067 - DNA, 23 bp, Homo sapiens
ctggcatggcagctcagtcccgg

SEQ ID NO: 14068 - DNA, 23 bp, Homo sapiens
atttctcagctgctctgtatcgg

SEQ ID NO: 14069 - DNA, 23 bp, Homo sapiens
acccaggccaaacaacagtgagg

SEQ ID NO: 14070 - DNA, 23 bp, Homo sapiens
atataggggcatcttcagcctgg

SEQ ID NO: 14071 - DNA, 23 bp, Homo sapiens
gatcagaagaccaagtgaagggg

SEQ ID NO: 14072 - DNA, 23 bp, Homo sapiens
ctgaccaagaaagattcctgagg

SEQ ID NO: 14073 - DNA, 23 bp, Homo sapiens
tgcagaattcggagctgtttagg

SEQ ID NO: 14074 - DNA, 23 bp, Homo sapiens
tttgcgtgctcaggaatagaagg

SEQ ID NO: 14075 - DNA, 23 bp, Homo sapiens
tttgttgttcatctcttctcggg

SEQ ID NO: 14076 - DNA, 23 bp, Homo sapiens
ctcggtggcactcagctatacgg

SEQ ID NO: 14077 - DNA, 23 bp, Homo sapiens
ggcttcatcctgactgtcagagg

SEQ ID NO: 14078 - DNA, 23 bp, Homo sapiens
catagcaagcagctcaaacacgg

SEQ ID NO: 14079 - DNA, 23 bp, Homo sapiens
gggagtctagagcgtgaccgcgg

SEQ ID NO: 14080 - DNA, 23 bp, Homo sapiens
gggcaaaggacagggacctgagg

SEQ ID NO: 14081 - DNA, 23 bp, Homo sapiens
ggaggtggcggctcaagtgaagg

SEQ ID NO: 14082 - DNA, 23 bp, Homo sapiens
aatggccccaaaaaaggaggtgg

SEQ ID NO: 14083 - DNA, 23 bp, Homo sapiens
ggaagatatggaccatcacttgg

SEQ ID NO: 14084 - DNA, 23 bp, Homo sapiens
tgttaggagtcatcgtacagagg

SEQ ID NO: 14085 - DNA, 23 bp, Homo sapiens
tctttgaagttcctgacacatgg

SEQ ID NO: 14086 - DNA, 23 bp, Homo sapiens
aagacctccctgtggtaattggg

SEQ ID NO: 14087 - DNA, 23 bp, Homo sapiens
ggccccttcggttaagtgtctgg

SEQ ID NO: 14088 - DNA, 23 bp, Homo sapiens
tgaaagtctatcaagtactcagg

SEQ ID NO: 14089 - DNA, 23 bp, Homo sapiens
cactcctgtgcgctcactgtcgg

SEQ ID NO: 14090 - DNA, 23 bp, Homo sapiens
taaggtactctgggtatgcttgg

SEQ ID NO: 14091 - DNA, 23 bp, Homo sapiens
acgatctccaaagctatttgtgg

SEQ ID NO: 14092 - DNA, 23 bp, Homo sapiens
cctctgctttccaacacttttgg

SEQ ID NO: 14093 - DNA, 23 bp, Homo sapiens
agtttaatttccttcagctgtgg

SEQ ID NO: 14094 - DNA, 23 bp, Homo sapiens
gggacagggcgggcactcagagg

SEQ ID NO: 14095 - DNA, 23 bp, Homo sapiens
agagtcctccattacagtcaagg

SEQ ID NO: 14096 - DNA, 23 bp, Homo sapiens
caggtttacacaaactgaggggg

SEQ ID NO: 14097 - DNA, 23 bp, Homo sapiens
atcaaactgctactggttaaagg

SEQ ID NO: 14098 - DNA, 23 bp, Homo sapiens
ccttggaggggattcgcaagtgg

SEQ ID NO: 14099 - DNA, 23 bp, Homo sapiens
tggggctactctgtggaatttgg

SEQ ID NO: 14100 - DNA, 23 bp, Homo sapiens
aaaactgagttaactttgcctgg

SEQ ID NO: 14101 - DNA, 23 bp, Homo sapiens
aattaagactccttgcacagtgg

SEQ ID NO: 14102 - DNA, 23 bp, Homo sapiens
ctgaccattatgaggacgttagg

SEQ ID NO: 14103 - DNA, 23 bp, Homo sapiens
ggcatttagacagtctgcactgg

SEQ ID NO: 14104 - DNA, 23 bp, Homo sapiens
gtaccgtaacgtggagtgagggg

SEQ ID NO: 14105 - DNA, 23 bp, Homo sapiens
tacaagaacgtggagtgacgggg

SEQ ID NO: 14106 - DNA, 23 bp, Homo sapiens
ggaggcagtgagggtcaattcgg

SEQ ID NO: 14107 - DNA, 23 bp, Homo sapiens
tcatgaaagtactgttagcacgg

SEQ ID NO: 14108 - DNA, 23 bp, Homo sapiens
actcggttctctctctgagctgg

SEQ ID NO: 14109 - DNA, 23 bp, Homo sapiens
ggaagaaattggtgtttagctgg

SEQ ID NO: 14110 - DNA, 23 bp, Homo sapiens
tctaaaggtcttcattgcacagg

SEQ ID NO: 14111 - DNA, 23 bp, Homo sapiens
acgtagaactaaactccctcagg

SEQ ID NO: 14112 - DNA, 23 bp, Homo sapiens
tgacatttgatctcaggaatcgg

SEQ ID NO: 14113 - DNA, 23 bp, Homo sapiens
agcacagtgtcactctcaacagg

SEQ ID NO: 14114 - DNA, 23 bp, Homo sapiens
ggctcatgacagcacagttaagg

SEQ ID NO: 14115 - DNA, 23 bp, Homo sapiens
tctgatcccctcgttttaatcgg

SEQ ID NO: 14116 - DNA, 23 bp, Homo sapiens
ccggcagaaactgaacttgctgg

SEQ ID NO: 14117 - DNA, 23 bp, Homo sapiens
acaaacagatcagtaaatccagg

SEQ ID NO: 14118 - DNA, 23 bp, Homo sapiens
atggggcctgaagggaaatgagg

SEQ ID NO: 14119 - DNA, 23 bp, Homo sapiens
taggagtcagagctctcaatcgg

SEQ ID NO: 14120 - DNA, 23 bp, Homo sapiens
cagtggcctgttggctagcctgg

SEQ ID NO: 14121 - DNA, 23 bp, Homo sapiens
tgagtcttgaatcctctacctgg

SEQ ID NO: 14122 - DNA, 23 bp, Homo sapiens
cggggagagctgcccctaggagg

SEQ ID NO: 14123 - DNA, 23 bp, Homo sapiens
ttttaggcttctctgaacttggg

SEQ ID NO: 14124 - DNA, 23 bp, Homo sapiens
acacggcctacaacgaggcttgg

SEQ ID NO: 14125 - DNA, 23 bp, Homo sapiens
ccctccggggtggggtcagacgg

SEQ ID NO: 14126 - DNA, 23 bp, Homo sapiens
gtggtccccgcggtaactagtgg

SEQ ID NO: 14127 - DNA, 23 bp, Homo sapiens
cagtggagaagaggaagacctgg

SEQ ID NO: 14128 - DNA, 23 bp, Homo sapiens
cagttcacttacgcgatatctgg

SEQ ID NO: 14129 - DNA, 23 bp, Homo sapiens
ccggagtttcctcgcattaaagg

SEQ ID NO: 14130 - DNA, 23 bp, Homo sapiens
ctgggtgacttggagggcatcgg

SEQ ID NO: 14131 - DNA, 23 bp, Homo sapiens
taagccttggactttttaggggg

SEQ ID NO: 14132 - DNA, 23 bp, Homo sapiens
ttttgtcgaacgtgttcaaaagg

SEQ ID NO: 14133 - DNA, 23 bp, Homo sapiens
ctactgtatggcttggaatgagg

SEQ ID NO: 14134 - DNA, 23 bp, Homo sapiens
aggcgggcaccaaacactgatgg

SEQ ID NO: 14135 - DNA, 23 bp, Homo sapiens
ctggctccaagggtcagtgacgg

SEQ ID NO: 14136 - DNA, 23 bp, Homo sapiens
aacctgatatgtctcaatactgg

SEQ ID NO: 14137 - DNA, 23 bp, Homo sapiens
attggcttgaccagtcaagtcgg

SEQ ID NO: 14138 - DNA, 23 bp, Homo sapiens
gtcgccccaggggccctagtagg

SEQ ID NO: 14139 - DNA, 23 bp, Homo sapiens
tttaggtgaactgttccatctgg

SEQ ID NO: 14140 - DNA, 23 bp, Homo sapiens
gctggagttggggaagcgccagg

SEQ ID NO: 14141 - DNA, 23 bp, Homo sapiens
gtccccatggcaactacagatgg

SEQ ID NO: 14142 - DNA, 23 bp, Homo sapiens
cacggcttccgcgctctgatggg

SEQ ID NO: 14143 - DNA, 23 bp, Homo sapiens
ccttgcaagtgttcgagctttgg

SEQ ID NO: 14144 - DNA, 23 bp, Homo sapiens
gctcaagagaagacaacacaagg

SEQ ID NO: 14145 - DNA, 23 bp, Homo sapiens
tggagtgctcactcaaacgctgg

SEQ ID NO: 14146 - DNA, 23 bp, Homo sapiens
gaggggagaggcagtctttgagg

SEQ ID NO: 14147 - DNA, 23 bp, Homo sapiens
tggacttcgatgagacctgaagg

SEQ ID NO: 14148 - DNA, 23 bp, Homo sapiens
gctacttgcacagacccctttgg

SEQ ID NO: 14149 - DNA, 23 bp, Homo sapiens
agtggtgaaaaagctatgtaagg

SEQ ID NO: 14150 - DNA, 23 bp, Homo sapiens
tgcacacattgttgaagctctgg

SEQ ID NO: 14151 - DNA, 23 bp, Homo sapiens
agggcacactgacagcctagagg

SEQ ID NO: 14152 - DNA, 23 bp, Homo sapiens
aggggatagtacatatgagaagg

SEQ ID NO: 14153 - DNA, 23 bp, Homo sapiens
gaagacagcattccagacctagg

SEQ ID NO: 14154 - DNA, 23 bp, Homo sapiens
tgtatgcttggcgaatgttgagg

SEQ ID NO: 14155 - DNA, 23 bp, Homo sapiens
agatctcacggatgccacgttgg

SEQ ID NO: 14156 - DNA, 23 bp, Homo sapiens
cagacaggaggatacagtgatgg

SEQ ID NO: 14157 - DNA, 23 bp, Homo sapiens
gcgattgctgggagatcagttgg

SEQ ID NO: 14158 - DNA, 23 bp, Homo sapiens
ccctgaggggcaagatcagttgg

SEQ ID NO: 14159 - DNA, 23 bp, Homo sapiens
cagacgggaggctacagtgatgg

SEQ ID NO: 14160 - DNA, 23 bp, Homo sapiens
tgtggccagagattagttagagg

SEQ ID NO: 14161 - DNA, 23 bp, Homo sapiens
gtactggagttgatgctgccagg

SEQ ID NO: 14162 - DNA, 23 bp, Homo sapiens
gtggggcagggtgtcagccccgg

SEQ ID NO: 14163 - DNA, 23 bp, Homo sapiens
ggcaagatcactcgatctccagg

SEQ ID NO: 14164 - DNA, 23 bp, Homo sapiens
gaagggcagggtctatgtcatgg

SEQ ID NO: 14165 - DNA, 23 bp, Homo sapiens
gcttgccaactacagatcttggg

SEQ ID NO: 14166 - DNA, 23 bp, Homo sapiens
gaccaaaaaagatgtgaagctgg

SEQ ID NO: 14167 - DNA, 23 bp, Homo sapiens
tttcctctgagaagggcatgggg

SEQ ID NO: 14168 - DNA, 23 bp, Homo sapiens
cctcggagacgggtggcatgggg

SEQ ID NO: 14169 - DNA, 23 bp, Homo sapiens
ggattacagcgtgcccatcccgg

SEQ ID NO: 14170 - DNA, 23 bp, Homo sapiens
gtacctcagctggcctcagtagg

SEQ ID NO: 14171 - DNA, 23 bp, Homo sapiens
tcaatccagaagctttctccagg

SEQ ID NO: 14172 - DNA, 23 bp, Homo sapiens
tgctcgtggagctggaatgaagg

SEQ ID NO: 14173 - DNA, 23 bp, Homo sapiens
gcaagaaggtacaacgtccttgg

SEQ ID NO: 14174 - DNA, 23 bp, Homo sapiens
ggaccgaggtgtgggagtgatgg

SEQ ID NO: 14175 - DNA, 23 bp, Homo sapiens
ccggccagtagggggctcacagg

SEQ ID NO: 14176 - DNA, 23 bp, Homo sapiens
ctggagaggaaggagctggatgg

SEQ ID NO: 14177 - DNA, 23 bp, Homo sapiens
tcagaaagcctcctctagcccgg

SEQ ID NO: 14178 - DNA, 23 bp, Homo sapiens
caagggatgttcttccataatgg

SEQ ID NO: 14179 - DNA, 23 bp, Homo sapiens
ggtcatggcagaaggggaagagg

SEQ ID NO: 14180 - DNA, 23 bp, Homo sapiens
caagggatgtgtttccataatgg

SEQ ID NO: 14181 - DNA, 23 bp, Homo sapiens
ggtctggtgtgtacggacacagg

SEQ ID NO: 14182 - DNA, 23 bp, Homo sapiens
ggcgtctgaggtatgttcacagg

SEQ ID NO: 14183 - DNA, 23 bp, Homo sapiens
aattagagagcctagtgaggagg

SEQ ID NO: 14184 - DNA, 23 bp, Homo sapiens
attggtcacagttttgtcattgg

SEQ ID NO: 14185 - DNA, 23 bp, Homo sapiens
tcacatctgaacaaaacaagggg

SEQ ID NO: 14186 - DNA, 23 bp, Homo sapiens
tcgccaggagcaaactctgaagg

SEQ ID NO: 14187 - DNA, 23 bp, Homo sapiens
tttcactttctcacagccacagg

SEQ ID NO: 14188 - DNA, 23 bp, Homo sapiens
tcgctaaaatctcctagctctgg

SEQ ID NO: 14189 - DNA, 23 bp, Homo sapiens
ccctggtgtgaagcgtctgaagg

SEQ ID NO: 14190 - DNA, 23 bp, Homo sapiens
tatgcgagagagaaagccaatgg

SEQ ID NO: 14191 - DNA, 23 bp, Homo sapiens
cagccaaacacagtaatgtatgg

SEQ ID NO: 14192 - DNA, 23 bp, Homo sapiens
gttgctcctttatagcctacagg

SEQ ID NO: 14193 - DNA, 23 bp, Homo sapiens
tcagagttattagccctccctgg

SEQ ID NO: 14194 - DNA, 23 bp, Homo sapiens
ttttcattggctcccttcttcgg

SEQ ID NO: 14195 - DNA, 23 bp, Homo sapiens
acatactggcacgttaatactgg

SEQ ID NO: 14196 - DNA, 23 bp, Homo sapiens
tcttagagttggtgctccttagg

SEQ ID NO: 14197 - DNA, 23 bp, Homo sapiens
taagtccaactttcgagttttgg

SEQ ID NO: 14198 - DNA, 23 bp, Homo sapiens
ggggaccactctaggaaggtggg

SEQ ID NO: 14199 - DNA, 23 bp, Homo sapiens
tttcacatacacttcctgatagg

SEQ ID NO: 14200 - DNA, 23 bp, Homo sapiens
taataacttacttcactgggagg

SEQ ID NO: 14201 - DNA, 23 bp, Homo sapiens
ggactcagaatgcttgaaagagg

SEQ ID NO: 14202 - DNA, 23 bp, Homo sapiens
aatagtttcaagaggcaagctgg

SEQ ID NO: 14203 - DNA, 23 bp, Homo sapiens
agaatcagaatacgtaggaaagg

SEQ ID NO: 14204 - DNA, 23 bp, Homo sapiens
cctcaatgtttccactcctctgg

SEQ ID NO: 14205 - DNA, 23 bp, Homo sapiens
aactgaggaatcctttgcaaagg

SEQ ID NO: 14206 - DNA, 23 bp, Homo sapiens
tgaaaattgggagggaaagatgg

SEQ ID NO: 14207 - DNA, 23 bp, Homo sapiens
gatgggtaaggcggagaatcagg

SEQ ID NO: 14208 - DNA, 23 bp, Homo sapiens
atgactcacattgtctgtagagg

SEQ ID NO: 14209 - DNA, 23 bp, Homo sapiens
gatctgggatcagttgatgtagg

SEQ ID NO: 14210 - DNA, 23 bp, Homo sapiens
aaaactatttgaacggcccctgg

SEQ ID NO: 14211 - DNA, 23 bp, Homo sapiens
tcacgctaatgtcaatgccatgg

SEQ ID NO: 14212 - DNA, 23 bp, Homo sapiens
tttccatttgaggacctcactgg

SEQ ID NO: 14213 - DNA, 23 bp, Homo sapiens
tcccccaatatcctgtgatttgg

SEQ ID NO: 14214 - DNA, 23 bp, Homo sapiens
acatatagtcatcagatacctgg

SEQ ID NO: 14215 - DNA, 23 bp, Homo sapiens
tccaccttccgaaatagctttgg

SEQ ID NO: 14216 - DNA, 23 bp, Homo sapiens
tccacctttcgaaatagctttgg

SEQ ID NO: 14217 - DNA, 23 bp, Homo sapiens
tcccccatttcagaataatttgg

SEQ ID NO: 14218 - DNA, 23 bp, Homo sapiens
ctaccttccccaataactttggg

SEQ ID NO: 14219 - DNA, 23 bp, Homo sapiens
tgacactggtaggaatatggggg

SEQ ID NO: 14220 - DNA, 23 bp, Homo sapiens
ttgtaagccaggactctaggagg

SEQ ID NO: 14221 - DNA, 23 bp, Homo sapiens
atccccaacttctctccttaggg

SEQ ID NO: 14222 - DNA, 23 bp, Homo sapiens
ttcaaagctcttcctgaaactgg

SEQ ID NO: 14223 - DNA, 23 bp, Homo sapiens
ccccaagttcagaaatagcttgg

SEQ ID NO: 14224 - DNA, 23 bp, Homo sapiens
gctgccttccggaatagctttgg

SEQ ID NO: 14225 - DNA, 23 bp, Homo sapiens
taatcccacacttaactgaacgg

SEQ ID NO: 14226 - DNA, 23 bp, Homo sapiens
tcgcccatttcagaataatttgg

SEQ ID NO: 14227 - DNA, 23 bp, Homo sapiens
tctaactttaggaatggctttgg

SEQ ID NO: 14228 - DNA, 23 bp, Homo sapiens
tctactctccccaatagctttgg

SEQ ID NO: 14229 - DNA, 23 bp, Homo sapiens
ttgtcttcaagtaaagactgggg

SEQ ID NO: 14230 - DNA, 23 bp, Homo sapiens
tgaagtttgcggcatgatggtgg

SEQ ID NO: 14231 - DNA, 23 bp, Homo sapiens
ccccaaacagttttcataacagg

SEQ ID NO: 14232 - DNA, 23 bp, Homo sapiens
agacagtcatgggttaattgagg

SEQ ID NO: 14233 - DNA, 23 bp, Homo sapiens
aagagaagaaacgttttctcagg

SEQ ID NO: 14234 - DNA, 23 bp, Homo sapiens
aagaaggagaagaagtaacatgg

SEQ ID NO: 14235 - DNA, 23 bp, Homo sapiens
aggagattccaacctacttcagg

SEQ ID NO: 14236 - DNA, 23 bp, Homo sapiens
aaaaggagaccctaatcttcagg

SEQ ID NO: 14237 - DNA, 23 bp, Homo sapiens
caaagaagaacggcgagttcagg

SEQ ID NO: 14238 - DNA, 23 bp, Homo sapiens
gagtttctttccgcctaagcggg

SEQ ID NO: 14239 - DNA, 23 bp, Homo sapiens
gcccttcctttatttccatgagg

SEQ ID NO: 14240 - DNA, 23 bp, Homo sapiens
gaatgaagctgatcatggtcagg

SEQ ID NO: 14241 - DNA, 23 bp, Homo sapiens
agaagacacccctttggttccgg

SEQ ID NO: 14242 - DNA, 23 bp, Homo sapiens
ctcacgtgcgaagacaaagaagg

SEQ ID NO: 14243 - DNA, 23 bp, Homo sapiens
tgcctcagatactattttgaagg

SEQ ID NO: 14244 - DNA, 23 bp, Homo sapiens
ccagaaatgccttctaattcagg

SEQ ID NO: 14245 - DNA, 23 bp, Homo sapiens
cagtgaattgacttcccatcagg

SEQ ID NO: 14246 - DNA, 23 bp, Homo sapiens
taaatgaaactcaccaactcagg

SEQ ID NO: 14247 - DNA, 23 bp, Homo sapiens
acatcctgagactctgacttcgg

SEQ ID NO: 14248 - DNA, 23 bp, Homo sapiens
cttcttatctgcttcaacgctgg

SEQ ID NO: 14249 - DNA, 23 bp, Homo sapiens
aagttagtgcctttgtgagatgg

SEQ ID NO: 14250 - DNA, 23 bp, Homo sapiens
cactatgggcacttactgagagg

SEQ ID NO: 14251 - DNA, 23 bp, Homo sapiens
ccgtttgcgcgaaaccagagtgg

SEQ ID NO: 14252 - DNA, 23 bp, Homo sapiens
gggacatggcctgggtagactgg

SEQ ID NO: 14253 - DNA, 23 bp, Homo sapiens
tgagccaaggcctcaatagacgg

SEQ ID NO: 14254 - DNA, 23 bp, Homo sapiens
tacaccaccagcttgtacagagg

SEQ ID NO: 14255 - DNA, 23 bp, Homo sapiens
tgaaagagaagaggaggtagggg

SEQ ID NO: 14256 - DNA, 23 bp, Homo sapiens
cccgtgccccccttaacttgagg

SEQ ID NO: 14257 - DNA, 23 bp, Homo sapiens
caagatggacttgctgtgaatgg

SEQ ID NO: 14258 - DNA, 23 bp, Homo sapiens
ggtcgatactgcagtaccatagg

SEQ ID NO: 14259 - DNA, 23 bp, Homo sapiens
tgtccttcattatggtcttgtgg

SEQ ID NO: 14260 - DNA, 23 bp, Homo sapiens
accggtccggtactgcaacaagg

SEQ ID NO: 14261 - DNA, 23 bp, Homo sapiens
agtacacggagccccgaggacgg

SEQ ID NO: 14262 - DNA, 23 bp, Homo sapiens
cgtgtactttcaacacaccgtgg

SEQ ID NO: 14263 - DNA, 23 bp, Homo sapiens
tccccgcaggatatgttaagtgg

SEQ ID NO: 14264 - DNA, 23 bp, Homo sapiens
agaataagccagatgtaatcagg

SEQ ID NO: 14265 - DNA, 23 bp, Homo sapiens
acaacctccaaccatcttctagg

SEQ ID NO: 14266 - DNA, 23 bp, Homo sapiens
ttttgtgcacacgtctctccagg

SEQ ID NO: 14267 - DNA, 23 bp, Homo sapiens
tttgtgtgatcaggttgcaaagg

SEQ ID NO: 14268 - DNA, 23 bp, Homo sapiens
ttgaatgcggagttgttgcacgg

SEQ ID NO: 14269 - DNA, 23 bp, Homo sapiens
tttcttcaatgcgtttgagtagg

SEQ ID NO: 14270 - DNA, 23 bp, Homo sapiens
gtagtagcaaggctctcactagg

SEQ ID NO: 14271 - DNA, 23 bp, Homo sapiens
ggagtttttcagatggattgagg

SEQ ID NO: 14272 - DNA, 23 bp, Homo sapiens
tgaagacatctcatatactctgg

SEQ ID NO: 14273 - DNA, 23 bp, Homo sapiens
ataaagaaaagcagtggtccagg

SEQ ID NO: 14274 - DNA, 23 bp, Homo sapiens
aagataaaatcacttccacctgg

SEQ ID NO: 14275 - DNA, 23 bp, Homo sapiens
aagcttttaaagattcagggagg

SEQ ID NO: 14276 - DNA, 23 bp, Homo sapiens
aagtagtatttcaggggatctgg

SEQ ID NO: 14277 - DNA, 23 bp, Homo sapiens
cgaggatgaagaaggatcttagg

SEQ ID NO: 14278 - DNA, 23 bp, Homo sapiens
ggaccaaactccttcaataaagg

SEQ ID NO: 14279 - DNA, 23 bp, Homo sapiens
ttctgataaccagaagctgtggg

SEQ ID NO: 14280 - DNA, 23 bp, Homo sapiens
ttcactgtttaatcatcgggtgg

SEQ ID NO: 14281 - DNA, 23 bp, Homo sapiens
aactggggtactagaacttgggg

SEQ ID NO: 14282 - DNA, 23 bp, Homo sapiens
tgtgtcagacgagcagtgacggg

SEQ ID NO: 14283 - DNA, 23 bp, Homo sapiens
caatgagtttgcatgactgatgg

SEQ ID NO: 14284 - DNA, 23 bp, Homo sapiens
ggcgccaggtagctcagtactgg

SEQ ID NO: 14285 - DNA, 23 bp, Homo sapiens
aagaataaatcggatatcccagg

SEQ ID NO: 14286 - DNA, 23 bp, Homo sapiens
gctggcctgcgtctcagtcctgg

SEQ ID NO: 14287 - DNA, 23 bp, Homo sapiens
gaccaagaatcagaagctcctgg

SEQ ID NO: 14288 - DNA, 23 bp, Homo sapiens
gaggagagactgggcctcagggg

SEQ ID NO: 14289 - DNA, 23 bp, Homo sapiens
aggatgcctcaggccctcagggg

SEQ ID NO: 14290 - DNA, 23 bp, Homo sapiens
ggctgggtctcagtcctagtggg

SEQ ID NO: 14291 - DNA, 23 bp, Homo sapiens
aaaggatcccagctcctgaatgg

SEQ ID NO: 14292 - DNA, 23 bp, Homo sapiens
tctggtggacattctgaatgagg

SEQ ID NO: 14293 - DNA, 23 bp, Homo sapiens
gatccgggcagtgctcagggtgg

SEQ ID NO: 14294 - DNA, 23 bp, Homo sapiens
tgcagcgctagttcttgttaagg

SEQ ID NO: 14295 - DNA, 23 bp, Homo sapiens
tgacaacttcaggttccagctgg

SEQ ID NO: 14296 - DNA, 23 bp, Homo sapiens
gttgttgaagaaccttccgttgg

SEQ ID NO: 14297 - DNA, 23 bp, Homo sapiens
tactcctactaccagtaaacagg

SEQ ID NO: 14298 - DNA, 23 bp, Homo sapiens
atggaacagaatcgagagtgtgg

SEQ ID NO: 14299 - DNA, 23 bp, Homo sapiens
cggaacacgtgttttagtccagg

SEQ ID NO: 14300 - DNA, 23 bp, Homo sapiens
ggcagattgaacaagagctttgg

SEQ ID NO: 14301 - DNA, 23 bp, Homo sapiens
ggcagctaggcacccttacccgg

SEQ ID NO: 14302 - DNA, 23 bp, Homo sapiens
tggccctggaatgtgtaggaagg

SEQ ID NO: 14303 - DNA, 23 bp, Homo sapiens
agacgtaccgcacgggaaggagg

SEQ ID NO: 14304 - DNA, 23 bp, Homo sapiens
tcctgggatggggctgtcactgg

SEQ ID NO: 14305 - DNA, 23 bp, Homo sapiens
gagagacctcatcaagtttttgg

SEQ ID NO: 14306 - DNA, 23 bp, Homo sapiens
gctcattaactgggccgccaagg

SEQ ID NO: 14307 - DNA, 23 bp, Homo sapiens
tttcttgaggtagttctgacagg

SEQ ID NO: 14308 - DNA, 23 bp, Homo sapiens
acagacatgattgatcaggatgg

SEQ ID NO: 14309 - DNA, 23 bp, Homo sapiens
aggtcaagactgaactgtgaggg

SEQ ID NO: 14310 - DNA, 23 bp, Homo sapiens
tgcagcctatgatatcagtgagg

SEQ ID NO: 14311 - DNA, 23 bp, Homo sapiens
gggatgaggatgaaaagtagagg

SEQ ID NO: 14312 - DNA, 23 bp, Homo sapiens
gaggtgcagagacttctagctgg

SEQ ID NO: 14313 - DNA, 23 bp, Homo sapiens
cgcgatggtgacttctaacctgg

SEQ ID NO: 14314 - DNA, 23 bp, Homo sapiens
cgggtcgcagttacttattcagg

SEQ ID NO: 14315 - DNA, 23 bp, Homo sapiens
tgggttactacctgaaagagagg

SEQ ID NO: 14316 - DNA, 23 bp, Homo sapiens
tggccaaggaagccggtcagagg

SEQ ID NO: 14317 - DNA, 23 bp, Homo sapiens
acttcagaccttcaaaactgtgg

SEQ ID NO: 14318 - DNA, 23 bp, Homo sapiens
gctcagtgctagaggactagtgg

SEQ ID NO: 14319 - DNA, 23 bp, Homo sapiens
acctgtcaccacaacaaagaggg

SEQ ID NO: 14320 - DNA, 23 bp, Homo sapiens
tcagagattatagggagcatggg

SEQ ID NO: 14321 - DNA, 23 bp, Homo sapiens
atgtaacagatacaccgtaaagg

SEQ ID NO: 14322 - DNA, 23 bp, Homo sapiens
tcaggacttcattcattaagtgg

SEQ ID NO: 14323 - DNA, 23 bp, Homo sapiens
cccaaatcatcagactcccatgg

SEQ ID NO: 14324 - DNA, 23 bp, Homo sapiens
tcttatattcagtagctctctgg

SEQ ID NO: 14325 - DNA, 23 bp, Homo sapiens
atatggacaactaagtgagaagg

SEQ ID NO: 14326 - DNA, 23 bp, Homo sapiens
cctttaatccagtgactgtcagg

SEQ ID NO: 14327 - DNA, 23 bp, Homo sapiens
tcatacgatactgaagaccatgg

SEQ ID NO: 14328 - DNA, 23 bp, Homo sapiens
atacaaagatactctccccaagg

SEQ ID NO: 14329 - DNA, 23 bp, Homo sapiens
gagcagacatattactgctgtgg

SEQ ID NO: 14330 - DNA, 23 bp, Homo sapiens
gctccccagcaacgacatctggg

SEQ ID NO: 14331 - DNA, 23 bp, Homo sapiens
tcacagtgaggatagcgacctgg

SEQ ID NO: 14332 - DNA, 23 bp, Homo sapiens
agaaaaccccagaaaagacatgg

SEQ ID NO: 14333 - DNA, 23 bp, Homo sapiens
agcgattccgagggtgactgagg

SEQ ID NO: 14334 - DNA, 23 bp, Homo sapiens
atccccatccgtggctcagaagg

SEQ ID NO: 14335 - DNA, 23 bp, Homo sapiens
ttatggtagccaaggaagacagg

SEQ ID NO: 14336 - DNA, 23 bp, Homo sapiens
gcagagatacagttgagtgtagg

SEQ ID NO: 14337 - DNA, 23 bp, Homo sapiens
tacaagtgctatgtgatcagagg

SEQ ID NO: 14338 - DNA, 23 bp, Homo sapiens
tttactggcatcctaaaggtagg

SEQ ID NO: 14339 - DNA, 23 bp, Homo sapiens
aaactcacacttctgtgaactgg

SEQ ID NO: 14340 - DNA, 23 bp, Homo sapiens
acatgatgagacacattcatagg

SEQ ID NO: 14341 - DNA, 23 bp, Homo sapiens
acacaaccagaatgggaatctgg

SEQ ID NO: 14342 - DNA, 23 bp, Homo sapiens
aagaaggatcactctaacatcgg

SEQ ID NO: 14343 - DNA, 23 bp, Homo sapiens
ttcagaacatctcacataactgg

SEQ ID NO: 14344 - DNA, 23 bp, Homo sapiens
gaggggatcactcagcatcaagg

SEQ ID NO: 14345 - DNA, 23 bp, Homo sapiens
cccattctatccattgtcactgg

SEQ ID NO: 14346 - DNA, 23 bp, Homo sapiens
aattgaagaggcagatgaagagg

SEQ ID NO: 14347 - DNA, 23 bp, Homo sapiens
cagaggtctggggatcaggtagg

SEQ ID NO: 14348 - DNA, 23 bp, Homo sapiens
agagggggattatgtatccacgg

SEQ ID NO: 14349 - DNA, 23 bp, Homo sapiens
ctcgacaaccagaggacttaggg

SEQ ID NO: 14350 - DNA, 23 bp, Homo sapiens
tttttgcactgttacgtgtcagg

SEQ ID NO: 14351 - DNA, 23 bp, Homo sapiens
cctggcccagagggacaagtagg

SEQ ID NO: 14352 - DNA, 23 bp, Homo sapiens
cctggaaggcaagggtcacaagg

SEQ ID NO: 14353 - DNA, 23 bp, Homo sapiens
cactgacagtattgaggaggagg

SEQ ID NO: 14354 - DNA, 23 bp, Homo sapiens
gtgcagctacctatctgctgagg

SEQ ID NO: 14355 - DNA, 23 bp, Homo sapiens
ccaggccaagcggaactgagtgg

SEQ ID NO: 14356 - DNA, 23 bp, Homo sapiens
cacatccccagtggtgttactgg

SEQ ID NO: 14357 - DNA, 23 bp, Homo sapiens
gctatttgctacaagaggttagg

SEQ ID NO: 14358 - DNA, 23 bp, Homo sapiens
cccatgggaccagtgctcacagg

SEQ ID NO: 14359 - DNA, 23 bp, Homo sapiens
gctgctgaagattcaggaggtgg

SEQ ID NO: 14360 - DNA, 23 bp, Homo sapiens
agacgcttgctggcatcatctgg

SEQ ID NO: 14361 - DNA, 23 bp, Homo sapiens
agtaaactttttgttccaggcgg

SEQ ID NO: 14362 - DNA, 23 bp, Homo sapiens
cgtgctagatgatgccatattgg

SEQ ID NO: 14363 - DNA, 23 bp, Homo sapiens
tgcatgagctcgctcagtttggg

SEQ ID NO: 14364 - DNA, 23 bp, Homo sapiens
tatgataaccgattttcctgagg

SEQ ID NO: 14365 - DNA, 23 bp, Homo sapiens
taagttgggccggcccctagggg

SEQ ID NO: 14366 - DNA, 23 bp, Homo sapiens
ccgaccacctcctgaatagtggg

SEQ ID NO: 14367 - DNA, 23 bp, Homo sapiens
gccaaatgttgcatcagggctgg

SEQ ID NO: 14368 - DNA, 23 bp, Homo sapiens
gcttggctttagctgtcagatgg

SEQ ID NO: 14369 - DNA, 23 bp, Homo sapiens
agagatgtgaaaaacagtgaagg

SEQ ID NO: 14370 - DNA, 23 bp, Homo sapiens
cacaaacgtctattggatgaagg

SEQ ID NO: 14371 - DNA, 23 bp, Homo sapiens
ggattatcgggaagaggacacgg

SEQ ID NO: 14372 - DNA, 23 bp, Homo sapiens
ctagggagtcaggtaaaaaacgg

SEQ ID NO: 14373 - DNA, 23 bp, Homo sapiens
aggagacccttggagcctagggg

SEQ ID NO: 14374 - DNA, 23 bp, Homo sapiens
gtgtgcagagggagcacaggagg

SEQ ID NO: 14375 - DNA, 23 bp, Homo sapiens
atgtgcacattctcttatcgagg

SEQ ID NO: 14376 - DNA, 23 bp, Homo sapiens
ccctcgaatccgccagttacagg

SEQ ID NO: 14377 - DNA, 23 bp, Homo sapiens
ttttttcagatagtcacggaagg

SEQ ID NO: 14378 - DNA, 23 bp, Homo sapiens
ggtaggggccagccccctacagg

SEQ ID NO: 14379 - DNA, 23 bp, Homo sapiens
actgttgagttttcctgacttgg

SEQ ID NO: 14380 - DNA, 23 bp, Homo sapiens
aagttcgtggtgccaatcagtgg

SEQ ID NO: 14381 - DNA, 23 bp, Homo sapiens
agtttaagtccgtcagttaaagg

SEQ ID NO: 14382 - DNA, 23 bp, Homo sapiens
aatatgatgtctttgacctgagg

SEQ ID NO: 14383 - DNA, 23 bp, Homo sapiens
tctttgaggactaggcaagtcgg

SEQ ID NO: 14384 - DNA, 23 bp, Homo sapiens
gggcagctacagttcctccttgg

SEQ ID NO: 14385 - DNA, 23 bp, Homo sapiens
gaagaagaagaaggcacaggagg

SEQ ID NO: 14386 - DNA, 23 bp, Homo sapiens
ggaccaaggaagagctttgaagg

SEQ ID NO: 14387 - DNA, 23 bp, Homo sapiens
tgaaagactagggaaaaagaagg

SEQ ID NO: 14388 - DNA, 23 bp, Homo sapiens
atgtggagcttgatgacttaggg

SEQ ID NO: 14389 - DNA, 23 bp, Homo sapiens
tgcatttaaagatagcagctggg

SEQ ID NO: 14390 - DNA, 23 bp, Homo sapiens
tttggtttcttcttttgcactgg

SEQ ID NO: 14391 - DNA, 23 bp, Homo sapiens
ccaagtgtgtctaggcactgcgg

SEQ ID NO: 14392 - DNA, 23 bp, Homo sapiens
ccacgtaccgcgtcagctaaggg

SEQ ID NO: 14393 - DNA, 23 bp, Homo sapiens
cccagggccgggctgctgagggg

SEQ ID NO: 14394 - DNA, 23 bp, Homo sapiens
tttgtattttgaagcatccctgg

SEQ ID NO: 14395 - DNA, 23 bp, Homo sapiens
aaagaagtggccatgtgaagagg

SEQ ID NO: 14396 - DNA, 23 bp, Homo sapiens
gtcagatctgctggctcacttgg

SEQ ID NO: 14397 - DNA, 23 bp, Homo sapiens
acctgccaccctcagctctcggg

SEQ ID NO: 14398 - DNA, 23 bp, Homo sapiens
cagaggttgtctcaccagcttgg

SEQ ID NO: 14399 - DNA, 23 bp, Homo sapiens
cttcaggttcagcccacagtcgg

SEQ ID NO: 14400 - DNA, 23 bp, Homo sapiens
gcctgcagagacttaagctttgg

SEQ ID NO: 14401 - DNA, 23 bp, Homo sapiens
aaggtggaactcgtctgagctgg

SEQ ID NO: 14402 - DNA, 23 bp, Homo sapiens
tgcttcatgtgcagtgactgcgg

SEQ ID NO: 14403 - DNA, 23 bp, Homo sapiens
aatgagcatgtttcttacacagg

SEQ ID NO: 14404 - DNA, 23 bp, Homo sapiens
agtataaaacagtgtgggccagg

SEQ ID NO: 14405 - DNA, 23 bp, Homo sapiens
gagcacgtgctgaaacttcatgg

SEQ ID NO: 14406 - DNA, 23 bp, Homo sapiens
tcagacctttttctccaagaagg

SEQ ID NO: 14407 - DNA, 23 bp, Homo sapiens
aggggctcacacatgagagaagg

SEQ ID NO: 14408 - DNA, 23 bp, Homo sapiens
ctcaacgtgcagtcgtagcccgg

SEQ ID NO: 14409 - DNA, 23 bp, Homo sapiens
aaagagccactcactattcttgg

SEQ ID NO: 14410 - DNA, 23 bp, Homo sapiens
atcggtgcatattacaagggggg

SEQ ID NO: 14411 - DNA, 23 bp, Homo sapiens
gacgccgctgtgcagtgacgtgg

SEQ ID NO: 14412 - DNA, 23 bp, Homo sapiens
taacaggacgtattatctgatgg

SEQ ID NO: 14413 - DNA, 23 bp, Homo sapiens
ttatgcgaaaaatgtcgggaagg

SEQ ID NO: 14414 - DNA, 23 bp, Homo sapiens
tggagctgagtgacttacatggg

SEQ ID NO: 14415 - DNA, 23 bp, Homo sapiens
gctctcaaggtcatcttgaaagg

SEQ ID NO: 14416 - DNA, 23 bp, Homo sapiens
aagtcaatttgtctttctgctgg

SEQ ID NO: 14417 - DNA, 23 bp, Homo sapiens
atctgcttgtttgcaagaacagg

SEQ ID NO: 14418 - DNA, 23 bp, Homo sapiens
ggcgaagtgctaaaagggaacgg

SEQ ID NO: 14419 - DNA, 23 bp, Homo sapiens
cgagctctgtctacatctccagg

SEQ ID NO: 14420 - DNA, 23 bp, Homo sapiens
tgaatgagggcatctctttctgg

SEQ ID NO: 14421 - DNA, 23 bp, Homo sapiens
taaagcagatctggcctccgagg

SEQ ID NO: 14422 - DNA, 23 bp, Homo sapiens
gccgcaggaaccacgatgagagg

SEQ ID NO: 14423 - DNA, 23 bp, Homo sapiens
tctgggtttatgcctcaaggtgg

SEQ ID NO: 14424 - DNA, 23 bp, Homo sapiens
accatccgacctgctggtgaggg

SEQ ID NO: 14425 - DNA, 23 bp, Homo sapiens
gagtctcatcttaagctctccgg

SEQ ID NO: 14426 - DNA, 23 bp, Homo sapiens
tccaggccacggtgctgtgaggg

SEQ ID NO: 14427 - DNA, 23 bp, Homo sapiens
agacttgacagaggggttggagg

SEQ ID NO: 14428 - DNA, 23 bp, Homo sapiens
gaagatccgaatgcttactctgg

SEQ ID NO: 14429 - DNA, 23 bp, Homo sapiens
attatcatcgccaaaaagagagg

SEQ ID NO: 14430 - DNA, 23 bp, Homo sapiens
aataactgcacaggtccttctgg

SEQ ID NO: 14431 - DNA, 23 bp, Homo sapiens
ggtgctctacagtagatccgagg

SEQ ID NO: 14432 - DNA, 23 bp, Homo sapiens
acccgcccgggcagctcacacgg

SEQ ID NO: 14433 - DNA, 23 bp, Homo sapiens
cgggtagatagcttcagtccagg

SEQ ID NO: 14434 - DNA, 23 bp, Homo sapiens
gaggttagggggagggtcatggg

SEQ ID NO: 14435 - DNA, 23 bp, Homo sapiens
ttgagactagcctgggcaacagg

SEQ ID NO: 14436 - DNA, 23 bp, Homo sapiens
acctgtctgctacacagactcgg

SEQ ID NO: 14437 - DNA, 23 bp, Homo sapiens
gcccaactggtatcaaaggttgg

SEQ ID NO: 14438 - DNA, 23 bp, Homo sapiens
agaattggaagaagaatgtgagg

SEQ ID NO: 14439 - DNA, 23 bp, Homo sapiens
agccacagagaaggttacatcgg

SEQ ID NO: 14440 - DNA, 23 bp, Homo sapiens
attatacagtagtcaccgatagg

SEQ ID NO: 14441 - DNA, 23 bp, Homo sapiens
ccattcattcggtcatacagtgg

SEQ ID NO: 14442 - DNA, 23 bp, Homo sapiens
ccccttgctcaggccttcttcgg

SEQ ID NO: 14443 - DNA, 23 bp, Homo sapiens
atcatccaggtacacattaacgg

SEQ ID NO: 14444 - DNA, 23 bp, Homo sapiens
ccaggccctggcgctgctgtggg

SEQ ID NO: 14445 - DNA, 23 bp, Homo sapiens
ataccatcctggctcctcaacgg

SEQ ID NO: 14446 - DNA, 23 bp, Homo sapiens
gcagctgtctgggaagtaggggg

SEQ ID NO: 14447 - DNA, 23 bp, Homo sapiens
ggcaaagccggctatctagcagg

SEQ ID NO: 14448 - DNA, 23 bp, Homo sapiens
ttgctgtctaagttccatcaagg

SEQ ID NO: 14449 - DNA, 23 bp, Homo sapiens
gagcttagctttctccttaaagg

SEQ ID NO: 14450 - DNA, 23 bp, Homo sapiens
tcgtcaccatgacagcttctcgg

SEQ ID NO: 14451 - DNA, 23 bp, Homo sapiens
ctccccggccccgctgtagaggg

SEQ ID NO: 14452 - DNA, 23 bp, Homo sapiens
aggacatgacaggtatttacagg

SEQ ID NO: 14453 - DNA, 23 bp, Homo sapiens
agaatacccacactggctgaggg

SEQ ID NO: 14454 - DNA, 23 bp, Homo sapiens
acaatggtctgttagtctagagg

SEQ ID NO: 14455 - DNA, 23 bp, Homo sapiens
tgtcaagggcgtcagtcaattgg

SEQ ID NO: 14456 - DNA, 23 bp, Homo sapiens
tttccagggcccgctggattagg

SEQ ID NO: 14457 - DNA, 23 bp, Homo sapiens
gggtgattccagttctgaagagg

SEQ ID NO: 14458 - DNA, 23 bp, Homo sapiens
gcagaagatggctaggagtcagg

SEQ ID NO: 14459 - DNA, 23 bp, Homo sapiens
agctcaatcagctcctcttgtgg

SEQ ID NO: 14460 - DNA, 23 bp, Homo sapiens
tttctgccggtagatctcagcgg

SEQ ID NO: 14461 - DNA, 23 bp, Homo sapiens
ctccaaagaagttcctgaaatgg

SEQ ID NO: 14462 - DNA, 23 bp, Homo sapiens
gatttctggctggctctacttgg

SEQ ID NO: 14463 - DNA, 23 bp, Homo sapiens
gtcccagaatggagtctagctgg

SEQ ID NO: 14464 - DNA, 23 bp, Homo sapiens
atggatcccccttgaatcacagg

SEQ ID NO: 14465 - DNA, 23 bp, Homo sapiens
cacatcctgtggtcaggttctgg

SEQ ID NO: 14466 - DNA, 23 bp, Homo sapiens
cagccccagccccagctcctagg

SEQ ID NO: 14467 - DNA, 23 bp, Homo sapiens
ttctacacatctgcctaacttgg

SEQ ID NO: 14468 - DNA, 23 bp, Homo sapiens
ggggccgcaggcactcactccgg

SEQ ID NO: 14469 - DNA, 23 bp, Homo sapiens
gacgcccagcagaactcctgagg

SEQ ID NO: 14470 - DNA, 23 bp, Homo sapiens
atttgtcaattcctgtgtgaagg

SEQ ID NO: 14471 - DNA, 23 bp, Homo sapiens
gctaaagttactttctgtccagg

SEQ ID NO: 14472 - DNA, 23 bp, Homo sapiens
cttcggcactaccgctgagccgg

SEQ ID NO: 14473 - DNA, 23 bp, Homo sapiens
caagcctaaaaacaccctaacgg

SEQ ID NO: 14474 - DNA, 23 bp, Homo sapiens
tcagggcttgagtcgtagccagg

SEQ ID NO: 14475 - DNA, 23 bp, Homo sapiens
tgctcttccggcagtgtcagggg

SEQ ID NO: 14476 - DNA, 23 bp, Homo sapiens
tactcccctgagaactgaaaggg

SEQ ID NO: 14477 - DNA, 23 bp, Homo sapiens
cctgattccattgggaaagatgg

SEQ ID NO: 14478 - DNA, 23 bp, Homo sapiens
aacgagagtgagcgggactaggg

SEQ ID NO: 14479 - DNA, 23 bp, Homo sapiens
gtagaagtagattttctgccagg

SEQ ID NO: 14480 - DNA, 23 bp, Homo sapiens
tcacaggagagcgcagtcaaggg

SEQ ID NO: 14481 - DNA, 23 bp, Homo sapiens
gatcagacactgttcaccactgg

SEQ ID NO: 14482 - DNA, 23 bp, Homo sapiens
agtctgcagccactgaaatcagg

SEQ ID NO: 14483 - DNA, 23 bp, Homo sapiens
agctccgcatccgtgactgaggg

SEQ ID NO: 14484 - DNA, 23 bp, Homo sapiens
ttttagtacccctcagcaactgg

SEQ ID NO: 14485 - DNA, 23 bp, Homo sapiens
gcagcccgtcccactgtcactgg

SEQ ID NO: 14486 - DNA, 23 bp, Homo sapiens
cctcttaagagctttcaacttgg

SEQ ID NO: 14487 - DNA, 23 bp, Homo sapiens
gaccctggggggctcctagcagg

SEQ ID NO: 14488 - DNA, 23 bp, Homo sapiens
caaagtagtgtatctcaagcagg

SEQ ID NO: 14489 - DNA, 23 bp, Homo sapiens
tcttgtacagcggggcttgcagg

SEQ ID NO: 14490 - DNA, 23 bp, Homo sapiens
gaatgggaggaaaatttgcttgg

SEQ ID NO: 14491 - DNA, 23 bp, Homo sapiens
cctggaagggagctgctgactgg

SEQ ID NO: 14492 - DNA, 23 bp, Homo sapiens
ggaagctgagcgttagtcaaagg

SEQ ID NO: 14493 - DNA, 23 bp, Homo sapiens
gctggagtgttggtctcctaggg

SEQ ID NO: 14494 - DNA, 23 bp, Homo sapiens
tcgctgaattgattccactctgg

SEQ ID NO: 14495 - DNA, 23 bp, Homo sapiens
ggcagctcaggctactgctaagg

SEQ ID NO: 14496 - DNA, 23 bp, Homo sapiens
ccatggggtcaggccttgccagg

SEQ ID NO: 14497 - DNA, 23 bp, Homo sapiens
tcttggaaagggctcagtagtgg

SEQ ID NO: 14498 - DNA, 23 bp, Homo sapiens
gaacatccacatcattagcaagg

SEQ ID NO: 14499 - DNA, 23 bp, Homo sapiens
gacttgggtcttcggctagtcgg

SEQ ID NO: 14500 - DNA, 23 bp, Homo sapiens
gactcctccaggaaacactgagg

SEQ ID NO: 14501 - DNA, 23 bp, Homo sapiens
agacaggcttgccctagcaaagg

SEQ ID NO: 14502 - DNA, 23 bp, Homo sapiens
cagtggatgaacatggtcactgg

SEQ ID NO: 14503 - DNA, 23 bp, Homo sapiens
agcatggacaagggcttctgagg

SEQ ID NO: 14504 - DNA, 23 bp, Homo sapiens
tcactccagagaggtttagacgg

SEQ ID NO: 14505 - DNA, 23 bp, Homo sapiens
gggactgggtcagacactccagg

SEQ ID NO: 14506 - DNA, 23 bp, Homo sapiens
gggacagacgaggtcagtactgg

SEQ ID NO: 14507 - DNA, 23 bp, Homo sapiens
cttacacatcagacctcctcagg

SEQ ID NO: 14508 - DNA, 23 bp, Homo sapiens
gcaaaatacttgagagactctgg

SEQ ID NO: 14509 - DNA, 23 bp, Homo sapiens
gcgcatgcagggcgcctagccgg

SEQ ID NO: 14510 - DNA, 23 bp, Homo sapiens
gtggaagccacagagagcctggg

SEQ ID NO: 14511 - DNA, 23 bp, Homo sapiens
agagacttaggcttaagccacgg

SEQ ID NO: 14512 - DNA, 23 bp, Homo sapiens
gagacttaggcttaagccacagg

SEQ ID NO: 14513 - DNA, 23 bp, Homo sapiens
agggcaaggccaagaagtgaagg

SEQ ID NO: 14514 - DNA, 23 bp, Homo sapiens
ccagggcaaggccaagtgagggg

SEQ ID NO: 14515 - DNA, 23 bp, Homo sapiens
acaagatcactcgatcctgaggg

SEQ ID NO: 14516 - DNA, 23 bp, Homo sapiens
ctggggattttgtgcttctgggg

SEQ ID NO: 14517 - DNA, 23 bp, Homo sapiens
agaggaatgaagacaaagcatgg

SEQ ID NO: 14518 - DNA, 23 bp, Homo sapiens
gttcagaatcgcttttcctcagg

SEQ ID NO: 14519 - DNA, 23 bp, Homo sapiens
tcggcacaacatgtattgtgagg

SEQ ID NO: 14520 - DNA, 23 bp, Homo sapiens
agggggtgggtgtgttagcgtgg

SEQ ID NO: 14521 - DNA, 23 bp, Homo sapiens
atcagaggacaagttcaagctgg

SEQ ID NO: 14522 - DNA, 23 bp, Homo sapiens
aatgctcatctgtcagattaggg

SEQ ID NO: 14523 - DNA, 23 bp, Homo sapiens
agcatgtctcatgatgtcaccgg

SEQ ID NO: 14524 - DNA, 23 bp, Homo sapiens
tgaatatcacactgaatagcagg

SEQ ID NO: 14525 - DNA, 23 bp, Homo sapiens
aagcacggaacaacacaaagcgg

SEQ ID NO: 14526 - DNA, 23 bp, Homo sapiens
tcctgcgcccccagcatcagtgg

SEQ ID NO: 14527 - DNA, 23 bp, Homo sapiens
cagcatcattcgggagcctgagg

SEQ ID NO: 14528 - DNA, 23 bp, Homo sapiens
gtcgaggcagcaagtctaggcgg

SEQ ID NO: 14529 - DNA, 23 bp, Homo sapiens
tgatcaggcattgtatgacgagg

SEQ ID NO: 14530 - DNA, 23 bp, Homo sapiens
tccaaggggtgggttacctccgg

SEQ ID NO: 14531 - DNA, 23 bp, Homo sapiens
gaccctgcctctgaataatcagg

SEQ ID NO: 14532 - DNA, 23 bp, Homo sapiens
tgagcattgtttagagtccttgg

SEQ ID NO: 14533 - DNA, 23 bp, Homo sapiens
ttgctgagagcatccaccccagg

SEQ ID NO: 14534 - DNA, 23 bp, Homo sapiens
taaaatccttcctggagtagagg

SEQ ID NO: 14535 - DNA, 23 bp, Homo sapiens
gaagcattccactttgtagctgg

SEQ ID NO: 14536 - DNA, 23 bp, Homo sapiens
gcggatcagcagggcctcagggg

SEQ ID NO: 14537 - DNA, 23 bp, Homo sapiens
tgtttccatgctgtctttattgg

SEQ ID NO: 14538 - DNA, 23 bp, Homo sapiens
ggcctcatttcaagcactgaagg

SEQ ID NO: 14539 - DNA, 23 bp, Homo sapiens
ttctctcagtgtttgaaatgagg

SEQ ID NO: 14540 - DNA, 23 bp, Homo sapiens
gtcttcttaggtgatgacagtgg

SEQ ID NO: 14541 - DNA, 23 bp, Homo sapiens
ggctgcagattgtacttctgtgg

SEQ ID NO: 14542 - DNA, 23 bp, Homo sapiens
tgatctggcgttctgtttagggg

SEQ ID NO: 14543 - DNA, 23 bp, Homo sapiens
atgaacatacagtgccgtgatgg

SEQ ID NO: 14544 - DNA, 23 bp, Homo sapiens
attatcttcagaaacctggttgg

SEQ ID NO: 14545 - DNA, 23 bp, Homo sapiens
ccaagctcacttcatgtgcaagg

SEQ ID NO: 14546 - DNA, 23 bp, Homo sapiens
ctctattcaggtgatgacagtgg

SEQ ID NO: 14547 - DNA, 23 bp, Homo sapiens
gaccttttgcctgcccttcaagg

SEQ ID NO: 14548 - DNA, 23 bp, Homo sapiens
actattgccacaaacactgaggg

SEQ ID NO: 14549 - DNA, 23 bp, Homo sapiens
caacgcggaccagctgggcaggg

SEQ ID NO: 14550 - DNA, 23 bp, Homo sapiens
tctgcctggggctgggctctagg

SEQ ID NO: 14551 - DNA, 23 bp, Homo sapiens
tctgcttttctgctcgttgctgg

SEQ ID NO: 14552 - DNA, 23 bp, Homo sapiens
ccagccaaagggaactgaccggg

SEQ ID NO: 14553 - DNA, 23 bp, Homo sapiens
acccaagatattggcagggatgg

SEQ ID NO: 14554 - DNA, 23 bp, Homo sapiens
aaccaaaagatgagagtgcccgg

SEQ ID NO: 14555 - DNA, 23 bp, Homo sapiens
agtgatggcggctggtgatgggg

SEQ ID NO: 14556 - DNA, 23 bp, Homo sapiens
ctgatcaagaacttcttctgagg

SEQ ID NO: 14557 - DNA, 23 bp, Homo sapiens
aggaattcgactgttaaggtcgg

SEQ ID NO: 14558 - DNA, 23 bp, Homo sapiens
aagagagtcgacagtttacaagg

SEQ ID NO: 14559 - DNA, 23 bp, Homo sapiens
aagaaaatctctatggcctgtgg

SEQ ID NO: 14560 - DNA, 23 bp, Homo sapiens
acctttggcatcatggacgatgg

SEQ ID NO: 14561 - DNA, 23 bp, Homo sapiens
agaagccaagttggaggcagagg

SEQ ID NO: 14562 - DNA, 23 bp, Homo sapiens
caggcagggtgggccctcactgg

SEQ ID NO: 14563 - DNA, 23 bp, Homo sapiens
ctcatttcttacccttgatgagg

SEQ ID NO: 14564 - DNA, 23 bp, Homo sapiens
gtcctcaaggagacctaaggtgg

SEQ ID NO: 14565 - DNA, 23 bp, Homo sapiens
agcatgctcaaggactcctaggg

SEQ ID NO: 14566 - DNA, 23 bp, Homo sapiens
ctctctgaaggaatcttaacagg

SEQ ID NO: 14567 - DNA, 23 bp, Homo sapiens
cataactcaggaagaagagctgg

SEQ ID NO: 14568 - DNA, 23 bp, Homo sapiens
tcctgccgactctggtagctggg

SEQ ID NO: 14569 - DNA, 23 bp, Homo sapiens
aagatgaggcagtcatcgagtgg

SEQ ID NO: 14570 - DNA, 23 bp, Homo sapiens
ctggttgagtggggaggaggggg

SEQ ID NO: 14571 - DNA, 23 bp, Homo sapiens
agggggaaaaacagcaaagaggg

SEQ ID NO: 14572 - DNA, 23 bp, Homo sapiens
acggtaatccctaataagacagg

SEQ ID NO: 14573 - DNA, 23 bp, Homo sapiens
caagtctgatcagaaagctgtgg

SEQ ID NO: 14574 - DNA, 23 bp, Homo sapiens
gcgctccaactctgttccttagg

SEQ ID NO: 14575 - DNA, 23 bp, Homo sapiens
tgctcagccttgggttgatttgg

SEQ ID NO: 14576 - DNA, 23 bp, Homo sapiens
cgccagccagcagtcagtccagg

SEQ ID NO: 14577 - DNA, 23 bp, Homo sapiens
ggcagagttgggtctcatgaagg

SEQ ID NO: 14578 - DNA, 23 bp, Homo sapiens
cccccgggggctagtcagtaagg

SEQ ID NO: 14579 - DNA, 23 bp, Homo sapiens
ctcagggagtctacaaatcctgg

SEQ ID NO: 14580 - DNA, 23 bp, Homo sapiens
ctggtcagcactgcccgctatgg

SEQ ID NO: 14581 - DNA, 23 bp, Homo sapiens
cctggctttccaaatcttaaagg

SEQ ID NO: 14582 - DNA, 23 bp, Homo sapiens
agtttcatgttgagcagcagagg

SEQ ID NO: 14583 - DNA, 23 bp, Homo sapiens
aaacagctcctaattgacatggg

SEQ ID NO: 14584 - DNA, 23 bp, Homo sapiens
atgctggagcaggtatgaaatgg

SEQ ID NO: 14585 - DNA, 23 bp, Homo sapiens
gttatttagtctcttccccctgg

SEQ ID NO: 14586 - DNA, 23 bp, Homo sapiens
tggtccctcggggtcagttgtgg

SEQ ID NO: 14587 - DNA, 23 bp, Homo sapiens
ccaaatctggagagccctgatgg

SEQ ID NO: 14588 - DNA, 23 bp, Homo sapiens
ctgaagcccccaggatagcatgg

SEQ ID NO: 14589 - DNA, 23 bp, Homo sapiens
cacacacacctgttgccatgtgg

SEQ ID NO: 14590 - DNA, 23 bp, Homo sapiens
tgcttttagttctgtcagtgtgg

SEQ ID NO: 14591 - DNA, 23 bp, Homo sapiens
cggcttcaagaagaggtgattgg

SEQ ID NO: 14592 - DNA, 23 bp, Homo sapiens
gcagcaacttaatggaaactagg

SEQ ID NO: 14593 - DNA, 23 bp, Homo sapiens
gtacttcaggagattaaacgagg

SEQ ID NO: 14594 - DNA, 23 bp, Homo sapiens
gctactcagaaggtgttacttgg

SEQ ID NO: 14595 - DNA, 23 bp, Homo sapiens
gaagagacgcccatccgtgaagg

SEQ ID NO: 14596 - DNA, 23 bp, Homo sapiens
aagctctcattaactgactcagg

SEQ ID NO: 14597 - DNA, 23 bp, Homo sapiens
atcctgaaaatccacagaaatgg

SEQ ID NO: 14598 - DNA, 23 bp, Homo sapiens
gtgagctccaaggttagaagtgg

SEQ ID NO: 14599 - DNA, 23 bp, Homo sapiens
tgcccagctgacctggaatgagg

SEQ ID NO: 14600 - DNA, 23 bp, Homo sapiens
acttttggaacttctagtagagg

SEQ ID NO: 14601 - DNA, 23 bp, Homo sapiens
gcatctgtgccatgcaatgaggg

SEQ ID NO: 14602 - DNA, 23 bp, Homo sapiens
tcgggctgccagatgcaataggg

SEQ ID NO: 14603 - DNA, 23 bp, Homo sapiens
ccgtgtctgattagctagtgggg

SEQ ID NO: 14604 - DNA, 23 bp, Homo sapiens
ggccgaggaggactactgagggg

SEQ ID NO: 14605 - DNA, 23 bp, Homo sapiens
gcagtggattggaaagctgatgg

SEQ ID NO: 14606 - DNA, 23 bp, Homo sapiens
ggccgtgcttgtgctgggctagg

SEQ ID NO: 14607 - DNA, 23 bp, Homo sapiens
acctccaactctgcctgaaaggg

SEQ ID NO: 14608 - DNA, 23 bp, Homo sapiens
ggatcctcgctccgttgcacggg

SEQ ID NO: 14609 - DNA, 23 bp, Homo sapiens
cactgcggtgttcggcctgaagg

SEQ ID NO: 14610 - DNA, 23 bp, Homo sapiens
gtcattgtcacaggggctgaggg

SEQ ID NO: 14611 - DNA, 23 bp, Homo sapiens
gttatagttacgggggcagaagg

SEQ ID NO: 14612 - DNA, 23 bp, Homo sapiens
aagagggcggggccactcagggg

SEQ ID NO: 14613 - DNA, 23 bp, Homo sapiens
acagctcggctgggtcatagtgg

SEQ ID NO: 14614 - DNA, 23 bp, Homo sapiens
agtgctgtgtcgaactcctccgg

SEQ ID NO: 14615 - DNA, 23 bp, Homo sapiens
acgacttcagcacctgttgcagg

SEQ ID NO: 14616 - DNA, 23 bp, Homo sapiens
tctgttgtagtttggtcctcagg

SEQ ID NO: 14617 - DNA, 23 bp, Homo sapiens
ggccggcagctagaagagattgg

SEQ ID NO: 14618 - DNA, 23 bp, Homo sapiens
aagagcagtatgttctgatctgg

SEQ ID NO: 14619 - DNA, 23 bp, Homo sapiens
gaggtcacctgggctaacgacgg

SEQ ID NO: 14620 - DNA, 23 bp, Homo sapiens
tctcagttgaaatggcgtgctgg

SEQ ID NO: 14621 - DNA, 23 bp, Homo sapiens
acgcagggggccgagggctgagg

SEQ ID NO: 14622 - DNA, 23 bp, Homo sapiens
agagaacaaaagcaactcaatgg

SEQ ID NO: 14623 - DNA, 23 bp, Homo sapiens
gttatcctttctgctgtctcagg

SEQ ID NO: 14624 - DNA, 23 bp, Homo sapiens
tgctttcatttgttgtgctcagg

SEQ ID NO: 14625 - DNA, 23 bp, Homo sapiens
ggacttctgaaggtgttcttcgg

SEQ ID NO: 14626 - DNA, 23 bp, Homo sapiens
ggtgttatcagtgacttgcttgg

SEQ ID NO: 14627 - DNA, 23 bp, Homo sapiens
tttcgagctcgacttgtgaaagg

SEQ ID NO: 14628 - DNA, 23 bp, Homo sapiens
ttacagcccacagcttcacccgg

SEQ ID NO: 14629 - DNA, 23 bp, Homo sapiens
ttccccaactgtacacctaaagg

SEQ ID NO: 14630 - DNA, 23 bp, Homo sapiens
agctccccaggagtccctagcgg

SEQ ID NO: 14631 - DNA, 23 bp, Homo sapiens
acgtccaacactgatattacagg

SEQ ID NO: 14632 - DNA, 23 bp, Homo sapiens
gagcagggctggcttagggctgg

SEQ ID NO: 14633 - DNA, 23 bp, Homo sapiens
ttacgtcaaactacctgtactgg

SEQ ID NO: 14634 - DNA, 23 bp, Homo sapiens
ttggctggaatcttctgaagggg

SEQ ID NO: 14635 - DNA, 23 bp, Homo sapiens
ctgtgaaggctcttgcgggatgg

SEQ ID NO: 14636 - DNA, 23 bp, Homo sapiens
ggaagcccttcttttcatggtgg

SEQ ID NO: 14637 - DNA, 23 bp, Homo sapiens
ttactctgacatttactaccagg

SEQ ID NO: 14638 - DNA, 23 bp, Homo sapiens
aatgacatcccctactgaggagg

SEQ ID NO: 14639 - DNA, 23 bp, Homo sapiens
agcgtgtcacatgatgccgttgg

SEQ ID NO: 14640 - DNA, 23 bp, Homo sapiens
cccattgcccctgccctcaccgg

SEQ ID NO: 14641 - DNA, 23 bp, Homo sapiens
gggggcatcacagattcaccagg

SEQ ID NO: 14642 - DNA, 23 bp, Homo sapiens
gtctggtatgatgccaaagatgg

SEQ ID NO: 14643 - DNA, 23 bp, Homo sapiens
aacatgagtactgctttcatggg

SEQ ID NO: 14644 - DNA, 23 bp, Homo sapiens
acatcatctcattggactaaagg

SEQ ID NO: 14645 - DNA, 23 bp, Homo sapiens
agcatgtcatcagatttgccagg

SEQ ID NO: 14646 - DNA, 23 bp, Homo sapiens
cacaaagcagcccaaccaaaggg

SEQ ID NO: 14647 - DNA, 23 bp, Homo sapiens
gcagcttttttgtcacacacagg

SEQ ID NO: 14648 - DNA, 23 bp, Homo sapiens
taatccagggaactcagtccagg

SEQ ID NO: 14649 - DNA, 23 bp, Homo sapiens
agtgtgcggccggggtcagcagg

SEQ ID NO: 14650 - DNA, 23 bp, Homo sapiens
ttttgtttcttagaccactcagg

SEQ ID NO: 14651 - DNA, 23 bp, Homo sapiens
aacccctttggccctgtatcagg

SEQ ID NO: 14652 - DNA, 23 bp, Homo sapiens
ccttggacaagggtggaagctgg

SEQ ID NO: 14653 - DNA, 23 bp, Homo sapiens
caagttcattcagccatcatcgg

SEQ ID NO: 14654 - DNA, 23 bp, Homo sapiens
aagtctgtggggcctaggcctgg

SEQ ID NO: 14655 - DNA, 23 bp, Homo sapiens
gtggactcgtgagaaggagtagg

SEQ ID NO: 14656 - DNA, 23 bp, Homo sapiens
caccagagacaatgatcaaatgg

SEQ ID NO: 14657 - DNA, 23 bp, Homo sapiens
agtgtttggggacattgaaatgg

SEQ ID NO: 14658 - DNA, 23 bp, Homo sapiens
tctttgtgggtgaggctcagagg

SEQ ID NO: 14659 - DNA, 23 bp, Homo sapiens
cagccgctcaattataatacagg

SEQ ID NO: 14660 - DNA, 23 bp, Homo sapiens
gatatctgaaaccaggtagaagg

SEQ ID NO: 14661 - DNA, 23 bp, Homo sapiens
cacttgccagagggtcgaattgg

SEQ ID NO: 14662 - DNA, 23 bp, Homo sapiens
acagtatgccaaagatcagaagg

SEQ ID NO: 14663 - DNA, 23 bp, Homo sapiens
tggatgtcctaatttaactgagg

SEQ ID NO: 14664 - DNA, 23 bp, Homo sapiens
catgtaccctgcagggggcttgg

SEQ ID NO: 14665 - DNA, 23 bp, Homo sapiens
tttcaccactctggatatactgg

SEQ ID NO: 14666 - DNA, 23 bp, Homo sapiens
actgcgcagaaaggctgagctgg

SEQ ID NO: 14667 - DNA, 23 bp, Homo sapiens
agtctaagactgtgtgagtctgg

SEQ ID NO: 14668 - DNA, 23 bp, Homo sapiens
ccagctctttacaatcaccttgg

SEQ ID NO: 14669 - DNA, 23 bp, Homo sapiens
ccaggtgttcaaccagagtctgg

SEQ ID NO: 14670 - DNA, 23 bp, Homo sapiens
taaaagagcagagaaaacccagg

SEQ ID NO: 14671 - DNA, 23 bp, Homo sapiens
ttctgaacgctggggctcatggg

SEQ ID NO: 14672 - DNA, 23 bp, Homo sapiens
gggctttattctgggattatggg

SEQ ID NO: 14673 - DNA, 23 bp, Homo sapiens
aaaacccttcaaggcttcagagg

SEQ ID NO: 14674 - DNA, 23 bp, Homo sapiens
tatttgattctctctgtcagggg

SEQ ID NO: 14675 - DNA, 23 bp, Homo sapiens
cccaaaagtcacttcatgtgagg

SEQ ID NO: 14676 - DNA, 23 bp, Homo sapiens
acagactaggctacctctgctgg

SEQ ID NO: 14677 - DNA, 23 bp, Homo sapiens
tggctgcaagaaagaacatttgg

SEQ ID NO: 14678 - DNA, 23 bp, Homo sapiens
cttcacaaagcgacctctccagg

SEQ ID NO: 14679 - DNA, 23 bp, Homo sapiens
gaggggacaagcaggactgaggg

SEQ ID NO: 14680 - DNA, 23 bp, Homo sapiens
cggcccccaggaagcctagacgg

SEQ ID NO: 14681 - DNA, 23 bp, Homo sapiens
cctgagaagacagactgagcagg

SEQ ID NO: 14682 - DNA, 23 bp, Homo sapiens
ggaaagggcaagaatcagagtgg

SEQ ID NO: 14683 - DNA, 23 bp, Homo sapiens
ggccatgctcgtgctcaagtagg

SEQ ID NO: 14684 - DNA, 23 bp, Homo sapiens
ttcctgccttggacatgacctgg

SEQ ID NO: 14685 - DNA, 23 bp, Homo sapiens
taccttgtgggccttatttgtgg

SEQ ID NO: 14686 - DNA, 23 bp, Homo sapiens
caaggatcaatgtagagcacagg

SEQ ID NO: 14687 - DNA, 23 bp, Homo sapiens
aagtaagaagcaagaagaagtgg

SEQ ID NO: 14688 - DNA, 23 bp, Homo sapiens
tcttcacattgtggagctggggg

SEQ ID NO: 14689 - DNA, 23 bp, Homo sapiens
ctgccggtgccttcttgatcagg

SEQ ID NO: 14690 - DNA, 23 bp, Homo sapiens
atgctcttctttcacaccaaagg

SEQ ID NO: 14691 - DNA, 23 bp, Homo sapiens
tcatctttcgctaatgcttgtgg

SEQ ID NO: 14692 - DNA, 23 bp, Homo sapiens
atttcaagagtttcagtctctgg

SEQ ID NO: 14693 - DNA, 23 bp, Homo sapiens
gaggtggaatcagcgtcctctgg

SEQ ID NO: 14694 - DNA, 23 bp, Homo sapiens
taaatggtatcagctgactgcgg

SEQ ID NO: 14695 - DNA, 23 bp, Homo sapiens
gtggctctgctgggctcacaagg

SEQ ID NO: 14696 - DNA, 23 bp, Homo sapiens
tcccactcgataaagaaaaatgg

SEQ ID NO: 14697 - DNA, 23 bp, Homo sapiens
tgctctttttgctgcagtggtgg

SEQ ID NO: 14698 - DNA, 23 bp, Homo sapiens
atgcatgctgtttaattgtgtgg

SEQ ID NO: 14699 - DNA, 23 bp, Homo sapiens
actggatggcccacacagttcgg

SEQ ID NO: 14700 - DNA, 23 bp, Homo sapiens
ccaaagacaacaggcagtagtgg

SEQ ID NO: 14701 - DNA, 23 bp, Homo sapiens
cttgttcttggcatcaaacaagg

SEQ ID NO: 14702 - DNA, 23 bp, Homo sapiens
aaaaaggacctgggaactctggg

SEQ ID NO: 14703 - DNA, 23 bp, Homo sapiens
actgggggggctcaggccccagg

SEQ ID NO: 14704 - DNA, 23 bp, Homo sapiens
acccagtatatgcacagcagagg

SEQ ID NO: 14705 - DNA, 23 bp, Homo sapiens
ggcgggtcctcggtgctcagcgg

SEQ ID NO: 14706 - DNA, 23 bp, Homo sapiens
ccctcgctttgcagataaagagg

SEQ ID NO: 14707 - DNA, 23 bp, Homo sapiens
gagatgggattgtgaaggtgtgg

SEQ ID NO: 14708 - DNA, 23 bp, Homo sapiens
agtggagctctgccctagtgtgg

SEQ ID NO: 14709 - DNA, 23 bp, Homo sapiens
tgctgtccctgcaggctcactgg

SEQ ID NO: 14710 - DNA, 23 bp, Homo sapiens
ccagaccactggacaggcttggg

SEQ ID NO: 14711 - DNA, 23 bp, Homo sapiens
ctgctgaccaaaaaggtaggagg

SEQ ID NO: 14712 - DNA, 23 bp, Homo sapiens
aggagccatatgagaatatcagg

SEQ ID NO: 14713 - DNA, 23 bp, Homo sapiens
gaccctgtactctgtcttaaagg

SEQ ID NO: 14714 - DNA, 23 bp, Homo sapiens
gttggtcagaagtcactgcttgg

SEQ ID NO: 14715 - DNA, 23 bp, Homo sapiens
ccagaaaggctgctatttgctgg

SEQ ID NO: 14716 - DNA, 23 bp, Homo sapiens
aggccaggcttagggtagcaagg

SEQ ID NO: 14717 - DNA, 23 bp, Homo sapiens
tccagcagcgagagcttgtgagg

SEQ ID NO: 14718 - DNA, 23 bp, Homo sapiens
gtctctctcattcatgactgagg

SEQ ID NO: 14719 - DNA, 23 bp, Homo sapiens
gttttttccaggaagctcacggg

SEQ ID NO: 14720 - DNA, 23 bp, Homo sapiens
tcatcctccgcactgagtgaggg

SEQ ID NO: 14721 - DNA, 23 bp, Homo sapiens
ccaccggttaagacaaaatttgg

SEQ ID NO: 14722 - DNA, 23 bp, Homo sapiens
ttacaaaccaccccttaaagtgg

SEQ ID NO: 14723 - DNA, 23 bp, Homo sapiens
gctccatgcagggacatcacagg

SEQ ID NO: 14724 - DNA, 23 bp, Homo sapiens
ctgttcagatagcttttcagggg

SEQ ID NO: 14725 - DNA, 23 bp, Homo sapiens
ccggctgggaaggattcatttgg

SEQ ID NO: 14726 - DNA, 23 bp, Homo sapiens
gtctcagaaatgtcagaccctgg

SEQ ID NO: 14727 - DNA, 23 bp, Homo sapiens
taatccccatcaaaaacaaccgg

SEQ ID NO: 14728 - DNA, 23 bp, Homo sapiens
caggaggttacgtcaagatgtgg

SEQ ID NO: 14729 - DNA, 23 bp, Homo sapiens
aggtagaagagaactacgtcagg

SEQ ID NO: 14730 - DNA, 23 bp, Homo sapiens
agtctcttaggcaaagatgttgg

SEQ ID NO: 14731 - DNA, 23 bp, Homo sapiens
atcaggctcaggagaagttctgg

SEQ ID NO: 14732 - DNA, 23 bp, Homo sapiens
gcttatgcaaaactgtgttctgg

SEQ ID NO: 14733 - DNA, 23 bp, Homo sapiens
ttctgaggctttgcgcttaatgg

SEQ ID NO: 14734 - DNA, 23 bp, Homo sapiens
atgagcactatccacacgacagg

SEQ ID NO: 14735 - DNA, 23 bp, Homo sapiens
gcccaacactctggaagtgcagg

SEQ ID NO: 14736 - DNA, 23 bp, Homo sapiens
cagccaggcctcggacgaggagg

SEQ ID NO: 14737 - DNA, 23 bp, Homo sapiens
tgtgtcgctctcgccgtcggagg

SEQ ID NO: 14738 - DNA, 23 bp, Homo sapiens
ttgttttccagaagggctttggg

SEQ ID NO: 14739 - DNA, 23 bp, Homo sapiens
ggaggcgcacacggagtgacggg

SEQ ID NO: 14740 - DNA, 23 bp, Homo sapiens
ggcttctggccagaggtcaaagg

SEQ ID NO: 14741 - DNA, 23 bp, Homo sapiens
aatcaaagattgggaactagtgg

SEQ ID NO: 14742 - DNA, 23 bp, Homo sapiens
ccttcttcctgactcgctgatgg

SEQ ID NO: 14743 - DNA, 23 bp, Homo sapiens
agagactctagagcgagcccagg

SEQ ID NO: 14744 - DNA, 23 bp, Homo sapiens
cacgaagctgaagtcattgtagg

SEQ ID NO: 14745 - DNA, 23 bp, Homo sapiens
taggaaataaagtgtgtctgtgg

SEQ ID NO: 14746 - DNA, 23 bp, Homo sapiens
tctgctgtcattcctttcactgg

SEQ ID NO: 14747 - DNA, 23 bp, Homo sapiens
gggttccgttcgaggcacgtcgg

SEQ ID NO: 14748 - DNA, 23 bp, Homo sapiens
gattcttcttcactcatcactgg

SEQ ID NO: 14749 - DNA, 23 bp, Homo sapiens
tactcagatttgggccgacatgg

SEQ ID NO: 14750 - DNA, 23 bp, Homo sapiens
tgactctctatgtcatccacagg

SEQ ID NO: 14751 - DNA, 23 bp, Homo sapiens
aagctggacagcgaggagtgagg

SEQ ID NO: 14752 - DNA, 23 bp, Homo sapiens
tgcactcacggtgccctacttgg

SEQ ID NO: 14753 - DNA, 23 bp, Homo sapiens
gttcgagtcggtgccctgagggg

SEQ ID NO: 14754 - DNA, 23 bp, Homo sapiens
cgagcgccacggctgctcattgg

SEQ ID NO: 14755 - DNA, 23 bp, Homo sapiens
ggggcggtcagctgttgtactgg

SEQ ID NO: 14756 - DNA, 23 bp, Homo sapiens
cgctgtgggtgcggctcacacgg

SEQ ID NO: 14757 - DNA, 23 bp, Homo sapiens
cgtggaaaggcccgtatgagcgg

SEQ ID NO: 14758 - DNA, 23 bp, Homo sapiens
caacaagtagaagcacttactgg

SEQ ID NO: 14759 - DNA, 23 bp, Homo sapiens
catcgtcttctgcaggttagagg

SEQ ID NO: 14760 - DNA, 23 bp, Homo sapiens
tctccaagctgtgcagtcacagg

SEQ ID NO: 14761 - DNA, 23 bp, Homo sapiens
ggtcttcttctgcaggtcaaagg

SEQ ID NO: 14762 - DNA, 23 bp, Homo sapiens
ccagtagttcatgccatcacagg

SEQ ID NO: 14763 - DNA, 23 bp, Homo sapiens
aacggccttggtctttagagtgg

SEQ ID NO: 14764 - DNA, 23 bp, Homo sapiens
tctgcaatactgtcatttgaagg

SEQ ID NO: 14765 - DNA, 23 bp, Homo sapiens
tgctttcagtgttctgttgatgg

SEQ ID NO: 14766 - DNA, 23 bp, Homo sapiens
gaaggaggactaagtgctgctgg

SEQ ID NO: 14767 - DNA, 23 bp, Homo sapiens
gcagacatcaaggacttctgagg

SEQ ID NO: 14768 - DNA, 23 bp, Homo sapiens
gtatctcacgctaggtgagaggg

SEQ ID NO: 14769 - DNA, 23 bp, Homo sapiens
tggacgaacagcttagtccttgg

SEQ ID NO: 14770 - DNA, 23 bp, Homo sapiens
caagcagccacgacagcagtggg

SEQ ID NO: 14771 - DNA, 23 bp, Homo sapiens
tgaaacacacatatcatacgtgg

SEQ ID NO: 14772 - DNA, 23 bp, Homo sapiens
gtgagattccaacgttgcagagg

SEQ ID NO: 14773 - DNA, 23 bp, Homo sapiens
gctaaatcaagtggtgagaaagg

SEQ ID NO: 14774 - DNA, 23 bp, Homo sapiens
tctcattttgtacttggttgtgg

SEQ ID NO: 14775 - DNA, 23 bp, Homo sapiens
ccctcagataggtcagccagagg

SEQ ID NO: 14776 - DNA, 23 bp, Homo sapiens
aaacatcaacgggaagaaaatgg

SEQ ID NO: 14777 - DNA, 23 bp, Homo sapiens
aatcttcaaagcctgctcagtgg

SEQ ID NO: 14778 - DNA, 23 bp, Homo sapiens
attcaggagcaactgtgatcagg

SEQ ID NO: 14779 - DNA, 23 bp, Homo sapiens
ggttggaagaatgtggctcttgg

SEQ ID NO: 14780 - DNA, 23 bp, Homo sapiens
cagattttgctgcttctccctgg

SEQ ID NO: 14781 - DNA, 23 bp, Homo sapiens
actggaggctctctccgtgaagg

SEQ ID NO: 14782 - DNA, 23 bp, Homo sapiens
gtgccagggacaggaaagatagg

SEQ ID NO: 14783 - DNA, 23 bp, Homo sapiens
acaaggtcagattcaagacgagg

SEQ ID NO: 14784 - DNA, 23 bp, Homo sapiens
cggctacaccaacatcatgcggg

SEQ ID NO: 14785 - DNA, 23 bp, Homo sapiens
gtgttgttcctgtgccgtgatgg

SEQ ID NO: 14786 - DNA, 23 bp, Homo sapiens
agttgatgtcacttaggtccagg

SEQ ID NO: 14787 - DNA, 23 bp, Homo sapiens
gcagagtctggggctcaggttgg

SEQ ID NO: 14788 - DNA, 23 bp, Homo sapiens
gggagggggctagcagcccccgg

SEQ ID NO: 14789 - DNA, 23 bp, Homo sapiens
gatactttcggaagaggagcagg

SEQ ID NO: 14790 - DNA, 23 bp, Homo sapiens
agcgattcctggaaccctgaggg

SEQ ID NO: 14791 - DNA, 23 bp, Homo sapiens
gcggacctgcgctactttgaggg

SEQ ID NO: 14792 - DNA, 23 bp, Homo sapiens
acagtgactccctgcagtagggg

SEQ ID NO: 14793 - DNA, 23 bp, Homo sapiens
agtgactccctggagtagtcggg

SEQ ID NO: 14794 - DNA, 23 bp, Homo sapiens
ggacagtctcttcttagaatcgg

SEQ ID NO: 14795 - DNA, 23 bp, Homo sapiens
taccactcccttaaagactgagg

SEQ ID NO: 14796 - DNA, 23 bp, Homo sapiens
ctccagaaggcttcacctatggg

SEQ ID NO: 14797 - DNA, 23 bp, Homo sapiens
cccagggtccccagactcatggg

SEQ ID NO: 14798 - DNA, 23 bp, Homo sapiens
aggagctcataggtatgttctgg

SEQ ID NO: 14799 - DNA, 23 bp, Homo sapiens
gcccaggttaaactacacacagg

SEQ ID NO: 14800 - DNA, 23 bp, Homo sapiens
tcaaggtagtcagtcacacttgg

SEQ ID NO: 14801 - DNA, 23 bp, Homo sapiens
ttcataatgacacctgcatgcgg

SEQ ID NO: 14802 - DNA, 23 bp, Homo sapiens
gaggagaaggaagagttatgagg

SEQ ID NO: 14803 - DNA, 23 bp, Homo sapiens
ggcacaggagtcagggcccaagg

SEQ ID NO: 14804 - DNA, 23 bp, Homo sapiens
ttgagaacatgactccaataagg

SEQ ID NO: 14805 - DNA, 23 bp, Homo sapiens
tcaactctgacaatacttcttgg

SEQ ID NO: 14806 - DNA, 23 bp, Homo sapiens
gaagaggggactcagcaacgagg

SEQ ID NO: 14807 - DNA, 23 bp, Homo sapiens
cccaccctgcaaaaaagcctggg

SEQ ID NO: 14808 - DNA, 23 bp, Homo sapiens
cctatgagaggctttatcttagg

SEQ ID NO: 14809 - DNA, 23 bp, Homo sapiens
ggtgtgggcttctagcacccagg

SEQ ID NO: 14810 - DNA, 23 bp, Homo sapiens
atcccaacaagctgtgcaccggg

SEQ ID NO: 14811 - DNA, 23 bp, Homo sapiens
aaacctcagaggctctagggagg

SEQ ID NO: 14812 - DNA, 23 bp, Homo sapiens
aaagctgaaactgaggtcactgg

SEQ ID NO: 14813 - DNA, 23 bp, Homo sapiens
ccagtacatgaactatgctttgg

SEQ ID NO: 14814 - DNA, 23 bp, Homo sapiens
atgaacgtggccgggtaggtggg

SEQ ID NO: 14815 - DNA, 23 bp, Homo sapiens
tagtgcccgaagttgctgcttgg

SEQ ID NO: 14816 - DNA, 23 bp, Homo sapiens
cctccaagggcacagacctgagg

SEQ ID NO: 14817 - DNA, 23 bp, Homo sapiens
gaggctccctggggcctaggagg

SEQ ID NO: 14818 - DNA, 23 bp, Homo sapiens
ccaggctcgggagagggcagggg

SEQ ID NO: 14819 - DNA, 23 bp, Homo sapiens
tcccaacatcctctgctcctagg

SEQ ID NO: 14820 - DNA, 23 bp, Homo sapiens
agctgctgctctcaccctgaggg

SEQ ID NO: 14821 - DNA, 23 bp, Homo sapiens
atcatgttacagaactcttcagg

SEQ ID NO: 14822 - DNA, 23 bp, Homo sapiens
actgtactaaagttggttgcagg

SEQ ID NO: 14823 - DNA, 23 bp, Homo sapiens
tggttgaatgctcaatttgatgg

SEQ ID NO: 14824 - DNA, 23 bp, Homo sapiens
cccactgctacagcaaatttagg

SEQ ID NO: 14825 - DNA, 23 bp, Homo sapiens
ccccaaacctgaggatcacatgg

SEQ ID NO: 14826 - DNA, 23 bp, Homo sapiens
ggagtgagggtgtcagggtgagg

SEQ ID NO: 14827 - DNA, 23 bp, Homo sapiens
tcaagagagatatcaacagaagg

SEQ ID NO: 14828 - DNA, 23 bp, Homo sapiens
agttatcttgctgtcaaaccagg

SEQ ID NO: 14829 - DNA, 23 bp, Homo sapiens
agccccgctcccgaccttctcgg

SEQ ID NO: 14830 - DNA, 23 bp, Homo sapiens
atttcacatgaagctaaggaagg

SEQ ID NO: 14831 - DNA, 23 bp, Homo sapiens
tttccatcaagcttttcagtagg

SEQ ID NO: 14832 - DNA, 23 bp, Homo sapiens
ctgaatgcatgatggaaatgagg

SEQ ID NO: 14833 - DNA, 23 bp, Homo sapiens
agggcctctgtgggggctactgg

SEQ ID NO: 14834 - DNA, 23 bp, Homo sapiens
gacaacatgcgaccgtgaccagg

SEQ ID NO: 14835 - DNA, 23 bp, Homo sapiens
tcctccctggggaccctcagagg

SEQ ID NO: 14836 - DNA, 23 bp, Homo sapiens
cctgagaccaccatgctgtgagg

SEQ ID NO: 14837 - DNA, 23 bp, Homo sapiens
gatttcaggtttaggtccagagg

SEQ ID NO: 14838 - DNA, 23 bp, Homo sapiens
ggacccacccccgggcctagagg

SEQ ID NO: 14839 - DNA, 23 bp, Homo sapiens
aaatcaaagttgtagacctctgg

SEQ ID NO: 14840 - DNA, 23 bp, Homo sapiens
cgcgcctgtcaaggtttcatggg

SEQ ID NO: 14841 - DNA, 23 bp, Homo sapiens
ccaaccctcaagctctcaagtgg

SEQ ID NO: 14842 - DNA, 23 bp, Homo sapiens
cctggcaggagcattcacagagg

SEQ ID NO: 14843 - DNA, 23 bp, Homo sapiens
cagtgggatgggggcatcagagg

SEQ ID NO: 14844 - DNA, 23 bp, Homo sapiens
cgaccttatctcgctcctccagg

SEQ ID NO: 14845 - DNA, 23 bp, Homo sapiens
gagaacacgcagctctgaactgg

SEQ ID NO: 14846 - DNA, 23 bp, Homo sapiens
gagtttcatactactgttgctgg

SEQ ID NO: 14847 - DNA, 23 bp, Homo sapiens
tgctgcttcagtttgcattttgg

SEQ ID NO: 14848 - DNA, 23 bp, Homo sapiens
atctccctccaggactaggctgg

SEQ ID NO: 14849 - DNA, 23 bp, Homo sapiens
tccgcatccagcgctcctgaggg

SEQ ID NO: 14850 - DNA, 23 bp, Homo sapiens
gagggggatgagtcctgaggtgg

SEQ ID NO: 14851 - DNA, 23 bp, Homo sapiens
atgctgcccttagtcactgtcgg

SEQ ID NO: 14852 - DNA, 23 bp, Homo sapiens
cgaggctggggtacaactagagg

SEQ ID NO: 14853 - DNA, 23 bp, Homo sapiens
accaggagaaatgcaacaagagg

SEQ ID NO: 14854 - DNA, 23 bp, Homo sapiens
tctggtttatcatcactgcttgg

SEQ ID NO: 14855 - DNA, 23 bp, Homo sapiens
tcttttgctgtttcagatacagg

SEQ ID NO: 14856 - DNA, 23 bp, Homo sapiens
tggggcgggctcctcagcgatgg

SEQ ID NO: 14857 - DNA, 23 bp, Homo sapiens
ctcaaaagctggaggagatcagg

SEQ ID NO: 14858 - DNA, 23 bp, Homo sapiens
ttcccaccactgacggtcagagg

SEQ ID NO: 14859 - DNA, 23 bp, Homo sapiens
aggaaagtagtgaggagaatggg

SEQ ID NO: 14860 - DNA, 23 bp, Homo sapiens
aacgatgaaactggagaatgagg

SEQ ID NO: 14861 - DNA, 23 bp, Homo sapiens
gaagctgctgtggtgctgacggg

SEQ ID NO: 14862 - DNA, 23 bp, Homo sapiens
gattcagcagaagatcctgatgg

SEQ ID NO: 14863 - DNA, 23 bp, Homo sapiens
tgagtcaggaaagaagctgaggg

SEQ ID NO: 14864 - DNA, 23 bp, Homo sapiens
caagtagtgctatcaagtgttgg

SEQ ID NO: 14865 - DNA, 23 bp, Homo sapiens
acataaacaaacagtgaagcagg

SEQ ID NO: 14866 - DNA, 23 bp, Homo sapiens
ccatagtgcccatggaggtttgg

SEQ ID NO: 14867 - DNA, 23 bp, Homo sapiens
gcatgatccccctagaagtgtgg

SEQ ID NO: 14868 - DNA, 23 bp, Homo sapiens
aacgcctgccgcctgctctgagg

SEQ ID NO: 14869 - DNA, 23 bp, Homo sapiens
tgcgtttggcagggctgaggggg

SEQ ID NO: 14870 - DNA, 23 bp, Homo sapiens
ttcatcatgttatacgttccggg

SEQ ID NO: 14871 - DNA, 23 bp, Homo sapiens
gccccattcttggttaggtttgg

SEQ ID NO: 14872 - DNA, 23 bp, Homo sapiens
cctgagtctgccgtggcctgagg

SEQ ID NO: 14873 - DNA, 23 bp, Homo sapiens
agtctctttacttcccagttcgg

SEQ ID NO: 14874 - DNA, 23 bp, Homo sapiens
tttgatagcttcaatccactcgg

SEQ ID NO: 14875 - DNA, 23 bp, Homo sapiens
acgcaaacgtgccttcttagtgg

SEQ ID NO: 14876 - DNA, 23 bp, Homo sapiens
cagagcttgttcagtcactttgg

SEQ ID NO: 14877 - DNA, 23 bp, Homo sapiens
cttccggtcagtgacgtgtgagg

SEQ ID NO: 14878 - DNA, 23 bp, Homo sapiens
tacggacctctgatgtgtgatgg

SEQ ID NO: 14879 - DNA, 23 bp, Homo sapiens
tcagtttcttcaggaagagaagg

SEQ ID NO: 14880 - DNA, 23 bp, Homo sapiens
ctcccaagccctggctactgagg

SEQ ID NO: 14881 - DNA, 23 bp, Homo sapiens
cttttgggcggattagaagctgg

SEQ ID NO: 14882 - DNA, 23 bp, Homo sapiens
actcagccgcagctcacagaagg

SEQ ID NO: 14883 - DNA, 23 bp, Homo sapiens
tatgcttcttcccagccagtagg

SEQ ID NO: 14884 - DNA, 23 bp, Homo sapiens
cgacagcagctataccatgcggg

SEQ ID NO: 14885 - DNA, 23 bp, Homo sapiens
cttggctcagtatgttaggaggg

SEQ ID NO: 14886 - DNA, 23 bp, Homo sapiens
ttctttgcatgctgggtcacggg

SEQ ID NO: 14887 - DNA, 23 bp, Homo sapiens
aatctgatgaggtggtatgatgg

SEQ ID NO: 14888 - DNA, 23 bp, Homo sapiens
gctgggtcatcatgtcctgcagg

SEQ ID NO: 14889 - DNA, 23 bp, Homo sapiens
ggtagttcgaggggtttttgcgg

SEQ ID NO: 14890 - DNA, 23 bp, Homo sapiens
tggtgtcaagtgttttctgttgg

SEQ ID NO: 14891 - DNA, 23 bp, Homo sapiens
tgtaggaatgtgggtgtagacgg

SEQ ID NO: 14892 - DNA, 23 bp, Homo sapiens
tcccagggctcagaaccagcagg

SEQ ID NO: 14893 - DNA, 23 bp, Homo sapiens
cagccacgggcatggccttaggg

SEQ ID NO: 14894 - DNA, 23 bp, Homo sapiens
ctctattttgggtcttctagggg

SEQ ID NO: 14895 - DNA, 23 bp, Homo sapiens
ctcccggggtggaaagtgatggg

SEQ ID NO: 14896 - DNA, 23 bp, Homo sapiens
tgcaggccgggggtcagctgtgg

SEQ ID NO: 14897 - DNA, 23 bp, Homo sapiens
gatgatgatagcagtgactaagg

SEQ ID NO: 14898 - DNA, 23 bp, Homo sapiens
agttcaagcagctttgcttaagg

SEQ ID NO: 14899 - DNA, 23 bp, Homo sapiens
gtggagctctcagaaacatctgg

SEQ ID NO: 14900 - DNA, 23 bp, Homo sapiens
ctcatgtcctggctcacatgtgg

SEQ ID NO: 14901 - DNA, 23 bp, Homo sapiens
tgaggcctgcgttcagtgtctgg

SEQ ID NO: 14902 - DNA, 23 bp, Homo sapiens
ttccaggccttgaactctgtcgg

SEQ ID NO: 14903 - DNA, 23 bp, Homo sapiens
ggccctgggtaggggcctggagg

SEQ ID NO: 14904 - DNA, 23 bp, Homo sapiens
accctgacagtcatcaggcctgg

SEQ ID NO: 14905 - DNA, 23 bp, Homo sapiens
tgagcgtggagttaagcagcagg

SEQ ID NO: 14906 - DNA, 23 bp, Homo sapiens
ggggccccacatcattcagctgg

SEQ ID NO: 14907 - DNA, 23 bp, Homo sapiens
cgcagaatcctctgaaatttagg

SEQ ID NO: 14908 - DNA, 23 bp, Homo sapiens
agaaatattcacagcaacgttgg

SEQ ID NO: 14909 - DNA, 23 bp, Homo sapiens
gctccccagctttcagagtaagg

SEQ ID NO: 14910 - DNA, 23 bp, Homo sapiens
tggctgcttggggcagctgcagg

SEQ ID NO: 14911 - DNA, 23 bp, Homo sapiens
cccggtgctatctcgtccccagg

SEQ ID NO: 14912 - DNA, 23 bp, Homo sapiens
gttccagctgagtggcttgcagg

SEQ ID NO: 14913 - DNA, 23 bp, Homo sapiens
agcctaaatcaggaaccagcagg

SEQ ID NO: 14914 - DNA, 23 bp, Homo sapiens
aggcgaaaatgttctgttcctgg

SEQ ID NO: 14915 - DNA, 23 bp, Homo sapiens
tcccgagacccctggtgctgagg

SEQ ID NO: 14916 - DNA, 23 bp, Homo sapiens
tcggctggagtcaggtgttctgg

SEQ ID NO: 14917 - DNA, 23 bp, Homo sapiens
ggcttgtgcagtggatctgatgg

SEQ ID NO: 14918 - DNA, 23 bp, Homo sapiens
accggaagagcctgatgtgaggg

SEQ ID NO: 14919 - DNA, 23 bp, Homo sapiens
tacaggagaagtgcaccctaggg

SEQ ID NO: 14920 - DNA, 23 bp, Homo sapiens
ctaatgatggtgctggttgttgg

SEQ ID NO: 14921 - DNA, 23 bp, Homo sapiens
ctctcacagaagccacaggacgg

SEQ ID NO: 14922 - DNA, 23 bp, Homo sapiens
gtctggggtgcgttactccctgg

SEQ ID NO: 14923 - DNA, 23 bp, Homo sapiens
cagcacacttctcttctaaaggg

SEQ ID NO: 14924 - DNA, 23 bp, Homo sapiens
ccacttctccccacagacctagg

SEQ ID NO: 14925 - DNA, 23 bp, Homo sapiens
ggaagtcctccataatcattagg

SEQ ID NO: 14926 - DNA, 23 bp, Homo sapiens
gaatctactctgttcctttctgg

SEQ ID NO: 14927 - DNA, 23 bp, Homo sapiens
ctcagctcttcttgcgcagctgg

SEQ ID NO: 14928 - DNA, 23 bp, Homo sapiens
gagttttatgctcagatcgctgg

SEQ ID NO: 14929 - DNA, 23 bp, Homo sapiens
cccggaggagaagaagtaggggg

SEQ ID NO: 14930 - DNA, 23 bp, Homo sapiens
ctacagctactgcccgccagcgg

SEQ ID NO: 14931 - DNA, 23 bp, Homo sapiens
catgggtcagaagtccagctcgg

SEQ ID NO: 14932 - DNA, 23 bp, Homo sapiens
aggggagggcagctattaggagg

SEQ ID NO: 14933 - DNA, 23 bp, Homo sapiens
atctttgtaagagcatgttcagg

SEQ ID NO: 14934 - DNA, 23 bp, Homo sapiens
tcagggcttgggtcctaggctgg

SEQ ID NO: 14935 - DNA, 23 bp, Homo sapiens
caccaaatggtcaaacaactagg

SEQ ID NO: 14936 - DNA, 23 bp, Homo sapiens
actagatactctgcagcatgcgg

SEQ ID NO: 14937 - DNA, 23 bp, Homo sapiens
gccaccagtcagatggctggcgg

SEQ ID NO: 14938 - DNA, 23 bp, Homo sapiens
ttcttcctctatcaaccaaatgg

SEQ ID NO: 14939 - DNA, 23 bp, Homo sapiens
ctccttcgtcgatccctaattgg

SEQ ID NO: 14940 - DNA, 23 bp, Homo sapiens
agactcacacatttgcatgaagg

SEQ ID NO: 14941 - DNA, 23 bp, Homo sapiens
gcagagtggttgagtgtcagggg

SEQ ID NO: 14942 - DNA, 23 bp, Homo sapiens
ttctacgggggatcagaacttgg

SEQ ID NO: 14943 - DNA, 23 bp, Homo sapiens
tgagggaagttcgcctacaccgg

SEQ ID NO: 14944 - DNA, 23 bp, Homo sapiens
ggccccgctggaggtggcacagg

SEQ ID NO: 14945 - DNA, 23 bp, Homo sapiens
tggtgaattcattctgttcttgg

SEQ ID NO: 14946 - DNA, 23 bp, Homo sapiens
gagcaatcaccagccttgaaagg

SEQ ID NO: 14947 - DNA, 23 bp, Homo sapiens
gggcggggtccggcctcaggagg

SEQ ID NO: 14948 - DNA, 23 bp, Homo sapiens
caatcaccacaacatgatgtagg

SEQ ID NO: 14949 - DNA, 23 bp, Homo sapiens
aatcatcatggcgcagtacaagg

SEQ ID NO: 14950 - DNA, 23 bp, Homo sapiens
cctctcctctttcttcagtgagg

SEQ ID NO: 14951 - DNA, 23 bp, Homo sapiens
gggtttatggcaagctgtgttgg

SEQ ID NO: 14952 - DNA, 23 bp, Homo sapiens
tcccaggacactggtcataccgg

SEQ ID NO: 14953 - DNA, 23 bp, Homo sapiens
tctaccgctgcttccctgatggg

SEQ ID NO: 14954 - DNA, 23 bp, Homo sapiens
cccatccctactagctttctagg

SEQ ID NO: 14955 - DNA, 23 bp, Homo sapiens
tcaaaacaataagaatccccagg

SEQ ID NO: 14956 - DNA, 23 bp, Homo sapiens
tcttttctaccttagtcacttgg

SEQ ID NO: 14957 - DNA, 23 bp, Homo sapiens
tgcccattttcaccatttaaagg

SEQ ID NO: 14958 - DNA, 23 bp, Homo sapiens
ctccggtcctctttttactgtgg

SEQ ID NO: 14959 - DNA, 23 bp, Homo sapiens
gggccggcgggcgcttcaccagg

SEQ ID NO: 14960 - DNA, 23 bp, Homo sapiens
tcagtcgtctcaggtaacttcgg

SEQ ID NO: 14961 - DNA, 23 bp, Homo sapiens
agacacagctggggatcaggtgg

SEQ ID NO: 14962 - DNA, 23 bp, Homo sapiens
agccgtgaccacctgctgtgagg

SEQ ID NO: 14963 - DNA, 23 bp, Homo sapiens
cgccgcttccccgactagcgcgg

SEQ ID NO: 14964 - DNA, 23 bp, Homo sapiens
ctcccccacacgggcttataagg

SEQ ID NO: 14965 - DNA, 23 bp, Homo sapiens
atatcatgtgacttctgcgaagg

SEQ ID NO: 14966 - DNA, 23 bp, Homo sapiens
aagaaactcatccagtcagctgg

SEQ ID NO: 14967 - DNA, 23 bp, Homo sapiens
tttgcatgcttaatgggaaaagg

SEQ ID NO: 14968 - DNA, 23 bp, Homo sapiens
tttgcatgtttgatgggcagggg

SEQ ID NO: 14969 - DNA, 23 bp, Homo sapiens
aaaaatcaggagtgtggtagtgg

SEQ ID NO: 14970 - DNA, 23 bp, Homo sapiens
aaaatgaaagccgtgatgattgg

SEQ ID NO: 14971 - DNA, 23 bp, Homo sapiens
acaccatggtggcctctaactgg

SEQ ID NO: 14972 - DNA, 23 bp, Homo sapiens
tctctctatcttgaacgttgtgg

SEQ ID NO: 14973 - DNA, 23 bp, Homo sapiens
ttctttgaacattcactggctgg

SEQ ID NO: 14974 - DNA, 23 bp, Homo sapiens
gagggctcagacagctgctgtgg

SEQ ID NO: 14975 - DNA, 23 bp, Homo sapiens
ggggctacagggatgcctgcagg

SEQ ID NO: 14976 - DNA, 23 bp, Homo sapiens
tgagaaggagggcttcatggagg

SEQ ID NO: 14977 - DNA, 23 bp, Homo sapiens
gaaccagttggagagaaagaagg

SEQ ID NO: 14978 - DNA, 23 bp, Homo sapiens
cagctggggctcagctgctcagg

SEQ ID NO: 14979 - DNA, 23 bp, Homo sapiens
catgtccattgagagctgagagg

SEQ ID NO: 14980 - DNA, 23 bp, Homo sapiens
gtgtccagcgacagctaaggtgg

SEQ ID NO: 14981 - DNA, 23 bp, Homo sapiens
ctcagctgtctaagctcatgagg

SEQ ID NO: 14982 - DNA, 23 bp, Homo sapiens
gttgcttcctaaatgtacctggg

SEQ ID NO: 14983 - DNA, 23 bp, Homo sapiens
ttctcagtttgatgaacagctgg

SEQ ID NO: 14984 - DNA, 23 bp, Homo sapiens
aaacaaggtcacagatctatagg

SEQ ID NO: 14985 - DNA, 23 bp, Homo sapiens
cactggagattgtaggtcagagg

SEQ ID NO: 14986 - DNA, 23 bp, Homo sapiens
ctgtctgagccagagctcacagg

SEQ ID NO: 14987 - DNA, 23 bp, Homo sapiens
actagaaagagaacgagggctgg

SEQ ID NO: 14988 - DNA, 23 bp, Homo sapiens
catctacgagtgctacagtgagg

SEQ ID NO: 14989 - DNA, 23 bp, Homo sapiens
tctcacctgcacaaactgtgagg

SEQ ID NO: 14990 - DNA, 23 bp, Homo sapiens
gttactggaaggaatcagagagg

SEQ ID NO: 14991 - DNA, 23 bp, Homo sapiens
cagccgcccagtctaatcacagg

SEQ ID NO: 14992 - DNA, 23 bp, Homo sapiens
aggtatcagacttgccaacaagg

SEQ ID NO: 14993 - DNA, 23 bp, Homo sapiens
ccccctcctcagtgggcagcagg

SEQ ID NO: 14994 - DNA, 23 bp, Homo sapiens
cccccctggggaccctagagagg

SEQ ID NO: 14995 - DNA, 23 bp, Homo sapiens
ggctggcggtctcctcactcagg

SEQ ID NO: 14996 - DNA, 23 bp, Homo sapiens
ggagctggttgctgtgctgaggg

SEQ ID NO: 14997 - DNA, 23 bp, Homo sapiens
gagctcacacacctccctcctgg

SEQ ID NO: 14998 - DNA, 23 bp, Homo sapiens
gtccaagcaggagggcagcgagg

SEQ ID NO: 14999 - DNA, 23 bp, Homo sapiens
atgtggattctagcagtatgagg

SEQ ID NO: 15000 - DNA, 23 bp, Homo sapiens
gagaagggtagcactctcagagg

SEQ ID NO: 15001 - DNA, 23 bp, Homo sapiens
cttgggactcaatgcctcactgg

SEQ ID NO: 15002 - DNA, 23 bp, Homo sapiens
gagactaaattagaaaggggtgg

SEQ ID NO: 15003 - DNA, 23 bp, Homo sapiens
ggcctcccagcagagctgagagg

SEQ ID NO: 15004 - DNA, 23 bp, Homo sapiens
gtcaacgtcaatagggtccctgg

SEQ ID NO: 15005 - DNA, 23 bp, Homo sapiens
taatgagtgctactctgtgcagg

SEQ ID NO: 15006 - DNA, 23 bp, Homo sapiens
tggcgccggggaggcaggtaggg

SEQ ID NO: 15007 - DNA, 23 bp, Homo sapiens
acagctcatgaggcgtgaccggg

SEQ ID NO: 15008 - DNA, 23 bp, Homo sapiens
gaactgctgttctcctaacgtgg

SEQ ID NO: 15009 - DNA, 23 bp, Homo sapiens
tagaagacaaagaaaggttgtgg

SEQ ID NO: 15010 - DNA, 23 bp, Homo sapiens
gtgcaccagaatctatgagaagg

SEQ ID NO: 15011 - DNA, 23 bp, Homo sapiens
aagtcaaatgtgtggttaccggg

SEQ ID NO: 15012 - DNA, 23 bp, Homo sapiens
acagaaagcagtggaggtggggg

SEQ ID NO: 15013 - DNA, 23 bp, Homo sapiens
aggccggggagcggttctaccgg

SEQ ID NO: 15014 - DNA, 23 bp, Homo sapiens
agatacgcagtaacatgtgttgg

SEQ ID NO: 15015 - DNA, 23 bp, Homo sapiens
ggactgcagtggcatcatcttgg

SEQ ID NO: 15016 - DNA, 23 bp, Homo sapiens
tcatgtagtttctggaagatagg

SEQ ID NO: 15017 - DNA, 23 bp, Homo sapiens
tttgggcttggtcctgataaagg

SEQ ID NO: 15018 - DNA, 23 bp, Homo sapiens
agttctgagaaatgacacccagg

SEQ ID NO: 15019 - DNA, 23 bp, Homo sapiens
agaacctagtgactaaagtctgg

SEQ ID NO: 15020 - DNA, 23 bp, Homo sapiens
gtgctggccagccccccaagtgg

SEQ ID NO: 15021 - DNA, 23 bp, Homo sapiens
acaagtctaagtcccgatcaagg

SEQ ID NO: 15022 - DNA, 23 bp, Homo sapiens
agtgaaccagtttgactatcagg

SEQ ID NO: 15023 - DNA, 23 bp, Homo sapiens
cctccccgtcgtaaacgctgagg

SEQ ID NO: 15024 - DNA, 23 bp, Homo sapiens
gtaaacgctgaggaatgatgtgg

SEQ ID NO: 15025 - DNA, 23 bp, Homo sapiens
ttcaacagaatgtggcaaccagg

SEQ ID NO: 15026 - DNA, 23 bp, Homo sapiens
gggtctggggtgcagacctgagg

SEQ ID NO: 15027 - DNA, 23 bp, Homo sapiens
tcttgtgcatatccttcagccgg

SEQ ID NO: 15028 - DNA, 23 bp, Homo sapiens
gctgggcggggctcagccctcgg

SEQ ID NO: 15029 - DNA, 23 bp, Homo sapiens
gcgttcatccttggaagatctgg

SEQ ID NO: 15030 - DNA, 23 bp, Homo sapiens
ataacagtagtctcctaacacgg

SEQ ID NO: 15031 - DNA, 23 bp, Homo sapiens
cgtcgccccgggagcttagcagg

SEQ ID NO: 15032 - DNA, 23 bp, Homo sapiens
gctgcaccacgtttttaacaagg

SEQ ID NO: 15033 - DNA, 23 bp, Homo sapiens
gactgtatctgagattagcatgg

SEQ ID NO: 15034 - DNA, 23 bp, Homo sapiens
gcactcagaagtgcccttccagg

SEQ ID NO: 15035 - DNA, 23 bp, Homo sapiens
tatggccgctggaatcatgaggg

SEQ ID NO: 15036 - DNA, 23 bp, Homo sapiens
caactcatctgctgtttgtctgg

SEQ ID NO: 15037 - DNA, 23 bp, Homo sapiens
cctgttctcccgagcctacttgg

SEQ ID NO: 15038 - DNA, 23 bp, Homo sapiens
tcccaagccctgggaaacatagg

SEQ ID NO: 15039 - DNA, 23 bp, Homo sapiens
gaggaatgtgataactaggttgg

SEQ ID NO: 15040 - DNA, 23 bp, Homo sapiens
caagtcctcccagggcaaatagg

SEQ ID NO: 15041 - DNA, 23 bp, Homo sapiens
gaatccagaaaggtttgatctgg

SEQ ID NO: 15042 - DNA, 23 bp, Homo sapiens
gttctttcaactcctcagtatgg

SEQ ID NO: 15043 - DNA, 23 bp, Homo sapiens
gcttcttggggggccactagcgg

SEQ ID NO: 15044 - DNA, 23 bp, Homo sapiens
ctcagaaggttgggctgtgaggg

SEQ ID NO: 15045 - DNA, 23 bp, Homo sapiens
ggaaagacaaaaggcgttaatgg

SEQ ID NO: 15046 - DNA, 23 bp, Homo sapiens
gacacggacaaggatagttttgg

SEQ ID NO: 15047 - DNA, 23 bp, Homo sapiens
ttatggcaatattcgagctgtgg

SEQ ID NO: 15048 - DNA, 23 bp, Homo sapiens
ccagaatggtaatgtgtagccgg

SEQ ID NO: 15049 - DNA, 23 bp, Homo sapiens
cgactccaaggcaggtcaactgg

SEQ ID NO: 15050 - DNA, 23 bp, Homo sapiens
gctcactgcactttgctgcttgg

SEQ ID NO: 15051 - DNA, 23 bp, Homo sapiens
ggtcggggtctcacagccccagg

SEQ ID NO: 15052 - DNA, 23 bp, Homo sapiens
actcttctctagtgaaaaactgg

SEQ ID NO: 15053 - DNA, 23 bp, Homo sapiens
atggaatctttgtatcagtgtgg

SEQ ID NO: 15054 - DNA, 23 bp, Homo sapiens
cccacccaccaggcctgaggggg

SEQ ID NO: 15055 - DNA, 23 bp, Homo sapiens
ggctcagccacagatgcctgagg

SEQ ID NO: 15056 - DNA, 23 bp, Homo sapiens
cctctgaccaggacgggtagagg

SEQ ID NO: 15057 - DNA, 23 bp, Homo sapiens
tggatcagctgcagttggaaggg

SEQ ID NO: 15058 - DNA, 23 bp, Homo sapiens
cccaccgcggggaggaagactgg

SEQ ID NO: 15059 - DNA, 23 bp, Homo sapiens
gtcattcaaagttctgaccacgg

SEQ ID NO: 15060 - DNA, 23 bp, Homo sapiens
caaccaaaacagggagctgatgg

SEQ ID NO: 15061 - DNA, 23 bp, Homo sapiens
tctgaaggattaaaggaaacagg

SEQ ID NO: 15062 - DNA, 23 bp, Homo sapiens
cagagagcaacaccatgatcagg

SEQ ID NO: 15063 - DNA, 23 bp, Homo sapiens
gcagcgactgactttgacagagg

SEQ ID NO: 15064 - DNA, 23 bp, Homo sapiens
aatgaacacttgtgagagactgg

SEQ ID NO: 15065 - DNA, 23 bp, Homo sapiens
ggaaaaggaggaggaggaagagg

SEQ ID NO: 15066 - DNA, 23 bp, Homo sapiens
tcccaaacattctagttagctgg

SEQ ID NO: 15067 - DNA, 23 bp, Homo sapiens
gaagacacacacctctagtccgg

SEQ ID NO: 15068 - DNA, 23 bp, Homo sapiens
tgcgcctcggctgcgctcacagg

SEQ ID NO: 15069 - DNA, 23 bp, Homo sapiens
acacttgtgtaagttcacttggg

SEQ ID NO: 15070 - DNA, 23 bp, Homo sapiens
atagtctgtgtttcactacctgg

SEQ ID NO: 15071 - DNA, 23 bp, Homo sapiens
agctgcttccagtttcaccttgg

SEQ ID NO: 15072 - DNA, 23 bp, Homo sapiens
ggacaggccccctaagctgcggg

SEQ ID NO: 15073 - DNA, 23 bp, Homo sapiens
tggaagatcacctactgaggagg

SEQ ID NO: 15074 - DNA, 23 bp, Homo sapiens
tgctacaggagactcagacgagg

SEQ ID NO: 15075 - DNA, 23 bp, Homo sapiens
catggctgagagcaactgaaggg

SEQ ID NO: 15076 - DNA, 23 bp, Homo sapiens
ggatgacatcacctgttactggg

SEQ ID NO: 15077 - DNA, 23 bp, Homo sapiens
agaagctgacctagatctgatgg

SEQ ID NO: 15078 - DNA, 23 bp, Homo sapiens
gttgtgccgtgaaatcctaaggg

SEQ ID NO: 15079 - DNA, 23 bp, Homo sapiens
gtgcaggtcgtcaggatctgagg

SEQ ID NO: 15080 - DNA, 23 bp, Homo sapiens
cccaaggaccggagcgaatgagg

SEQ ID NO: 15081 - DNA, 23 bp, Homo sapiens
gggatgcttgcaaggtcaccagg

SEQ ID NO: 15082 - DNA, 23 bp, Homo sapiens
aaaccacttttttgagtcagggg

SEQ ID NO: 15083 - DNA, 23 bp, Homo sapiens
agatggcagtttatttcctctgg

SEQ ID NO: 15084 - DNA, 23 bp, Homo sapiens
ggtcttacgtggtgcctcatagg

SEQ ID NO: 15085 - DNA, 23 bp, Homo sapiens
gtggtgagcaagagagctaaggg

SEQ ID NO: 15086 - DNA, 23 bp, Homo sapiens
accctcaggccttcactggtagg

SEQ ID NO: 15087 - DNA, 23 bp, Homo sapiens
ttcaaaatcaagctttgagcagg

SEQ ID NO: 15088 - DNA, 23 bp, Homo sapiens
cggggcccggggctggctaatgg

SEQ ID NO: 15089 - DNA, 23 bp, Homo sapiens
agggtttatgcagaggcattcgg

SEQ ID NO: 15090 - DNA, 23 bp, Homo sapiens
ttcttacagggtttatgcagagg

SEQ ID NO: 15091 - DNA, 23 bp, Homo sapiens
agaagaagaacagaatgaagagg

SEQ ID NO: 15092 - DNA, 23 bp, Homo sapiens
tgtggatgaatttgcttttctgg

SEQ ID NO: 15093 - DNA, 23 bp, Homo sapiens
tccaggcagtgctatggtccagg

SEQ ID NO: 15094 - DNA, 23 bp, Homo sapiens
aagcagagacaccacaatgaagg

SEQ ID NO: 15095 - DNA, 23 bp, Homo sapiens
gggcagcactaatgtgttaatgg

SEQ ID NO: 15096 - DNA, 23 bp, Homo sapiens
tgatgacagtaaatgcatcatgg

SEQ ID NO: 15097 - DNA, 23 bp, Homo sapiens
gacaaacttgtgaagctagaggg

SEQ ID NO: 15098 - DNA, 23 bp, Homo sapiens
gcaggatcagatttccacattgg

SEQ ID NO: 15099 - DNA, 23 bp, Homo sapiens
agggtatgtttgggattgtttgg

SEQ ID NO: 15100 - DNA, 23 bp, Homo sapiens
gagaacctgctgagcgggactgg

SEQ ID NO: 15101 - DNA, 23 bp, Homo sapiens
cccagggtcacacagtgatgagg

SEQ ID NO: 15102 - DNA, 23 bp, Homo sapiens
gctcaggcgtttctctgctctgg

SEQ ID NO: 15103 - DNA, 23 bp, Homo sapiens
tggggctacagacaaaatgaagg

SEQ ID NO: 15104 - DNA, 23 bp, Homo sapiens
cgccagctggggagagctaaagg

SEQ ID NO: 15105 - DNA, 23 bp, Homo sapiens
cggggtagctgctatctcagagg

SEQ ID NO: 15106 - DNA, 23 bp, Homo sapiens
tcggtattttgtagctgaactgg

SEQ ID NO: 15107 - DNA, 23 bp, Homo sapiens
ggccaaggcgagtggatcacggg

SEQ ID NO: 15108 - DNA, 23 bp, Homo sapiens
tgaactagatgcggttcagatgg

SEQ ID NO: 15109 - DNA, 23 bp, Homo sapiens
aagcggtccaaccggcggtgagg

SEQ ID NO: 15110 - DNA, 23 bp, Homo sapiens
ctgcataaaggactagaatgtgg

SEQ ID NO: 15111 - DNA, 23 bp, Homo sapiens
cagaccgcctggcaaagcggagg

SEQ ID NO: 15112 - DNA, 23 bp, Homo sapiens
acagtgacgaggagaactgaggg

SEQ ID NO: 15113 - DNA, 23 bp, Homo sapiens
agctaaacactcatcattcgcgg

SEQ ID NO: 15114 - DNA, 23 bp, Homo sapiens
ggcaagctgcagttaatttatgg

SEQ ID NO: 15115 - DNA, 23 bp, Homo sapiens
actgaaagctgcgctttgtctgg

SEQ ID NO: 15116 - DNA, 23 bp, Homo sapiens
gcggtagctactgcaccagccgg

SEQ ID NO: 15117 - DNA, 23 bp, Homo sapiens
ttttaatcgggtgttttctgtgg

SEQ ID NO: 15118 - DNA, 23 bp, Homo sapiens
aagccacccattgtttcctaagg

SEQ ID NO: 15119 - DNA, 23 bp, Homo sapiens
ctctctgagccgccgcctccggg

SEQ ID NO: 15120 - DNA, 23 bp, Homo sapiens
tcctctgctcattgccatgaagg

SEQ ID NO: 15121 - DNA, 23 bp, Homo sapiens
tccctgatggacgattacttggg

SEQ ID NO: 15122 - DNA, 23 bp, Homo sapiens
aatgcgtgggggcctaacccagg

SEQ ID NO: 15123 - DNA, 23 bp, Homo sapiens
agagaggctggcttcaggcgagg

SEQ ID NO: 15124 - DNA, 23 bp, Homo sapiens
ggcttcaggcgaggttcagaagg

SEQ ID NO: 15125 - DNA, 23 bp, Homo sapiens
tgagagtgaatctttcaagatgg

SEQ ID NO: 15126 - DNA, 23 bp, Homo sapiens
tgaggatattttcgatgtgaagg

SEQ ID NO: 15127 - DNA, 23 bp, Homo sapiens
gggggagagaggaggtcactcgg

SEQ ID NO: 15128 - DNA, 23 bp, Homo sapiens
agcaggaaggaattgagtagggg

SEQ ID NO: 15129 - DNA, 23 bp, Homo sapiens
gaaggggaagcaggcacgtccgg

SEQ ID NO: 15130 - DNA, 23 bp, Homo sapiens
ccaatcagatgcagagaatgtgg

SEQ ID NO: 15131 - DNA, 23 bp, Homo sapiens
cctccttctgggtgttcttcagg

SEQ ID NO: 15132 - DNA, 23 bp, Homo sapiens
taagggatgaagatgacgattgg

SEQ ID NO: 15133 - DNA, 23 bp, Homo sapiens
tttctttggactatgtgacaagg

SEQ ID NO: 15134 - DNA, 23 bp, Homo sapiens
ctgtccaagtacaatgaatgagg

SEQ ID NO: 15135 - DNA, 23 bp, Homo sapiens
tctggatcactgtctcttcatgg

SEQ ID NO: 15136 - DNA, 23 bp, Homo sapiens
cctccacctgctcattttaccgg

SEQ ID NO: 15137 - DNA, 23 bp, Homo sapiens
aagactgtactgtccctttaagg

SEQ ID NO: 15138 - DNA, 23 bp, Homo sapiens
actgtatttacatgacagagtgg

SEQ ID NO: 15139 - DNA, 23 bp, Homo sapiens
catggatgaggcaacctattagg

SEQ ID NO: 15140 - DNA, 23 bp, Homo sapiens
cagtgatgacaatatggacgagg

SEQ ID NO: 15141 - DNA, 23 bp, Homo sapiens
gaagtccttcaggccctgaatgg

SEQ ID NO: 15142 - DNA, 23 bp, Homo sapiens
ggacaccgctggagggattaggg

SEQ ID NO: 15143 - DNA, 23 bp, Homo sapiens
ggggtgtcagctgaagaagtagg

SEQ ID NO: 15144 - DNA, 23 bp, Homo sapiens
gctccgggctcactccttcctgg

SEQ ID NO: 15145 - DNA, 23 bp, Homo sapiens
gggacaaaggctactttttgcgg

SEQ ID NO: 15146 - DNA, 23 bp, Homo sapiens
cccagattcttaggagccaaagg

SEQ ID NO: 15147 - DNA, 23 bp, Homo sapiens
tcttgtaggcatgatgccttcgg

SEQ ID NO: 15148 - DNA, 23 bp, Homo sapiens
cctacaagaagggcgagtgaggg

SEQ ID NO: 15149 - DNA, 23 bp, Homo sapiens
aggaggtctcatgtctgttctgg

SEQ ID NO: 15150 - DNA, 23 bp, Homo sapiens
atttccaaagctggataagttgg

SEQ ID NO: 15151 - DNA, 23 bp, Homo sapiens
gggaccctttgcagatgtgctgg

SEQ ID NO: 15152 - DNA, 23 bp, Homo sapiens
tagagatgccatgatgtctcagg

SEQ ID NO: 15153 - DNA, 23 bp, Homo sapiens
gggagagccacacttgatggtgg

SEQ ID NO: 15154 - DNA, 23 bp, Homo sapiens
ccttcgctggaaagacagctggg

SEQ ID NO: 15155 - DNA, 23 bp, Homo sapiens
ctggactcatgggacttttgagg

SEQ ID NO: 15156 - DNA, 23 bp, Homo sapiens
cggttacagggaagcagacgtgg

SEQ ID NO: 15157 - DNA, 23 bp, Homo sapiens
ttctggagtcattagcaaagtgg

SEQ ID NO: 15158 - DNA, 23 bp, Homo sapiens
tacaaagggaaactgctgattgg

SEQ ID NO: 15159 - DNA, 23 bp, Homo sapiens
gttcacaatacaaggctctgtgg

SEQ ID NO: 15160 - DNA, 23 bp, Homo sapiens
taccatgggaaaattctcatagg

SEQ ID NO: 15161 - DNA, 23 bp, Homo sapiens
atttgcgaggattgctattgagg

SEQ ID NO: 15162 - DNA, 23 bp, Homo sapiens
tttcctttcatggcatttctggg

SEQ ID NO: 15163 - DNA, 23 bp, Homo sapiens
ttagacggcaaagaattcacagg

SEQ ID NO: 15164 - DNA, 23 bp, Homo sapiens
tgaggaggctgcagaagcaatgg

SEQ ID NO: 15165 - DNA, 23 bp, Homo sapiens
catccacatccgagtcttcaggg

SEQ ID NO: 15166 - DNA, 23 bp, Homo sapiens
acccacacgcctgaactttaagg

SEQ ID NO: 15167 - DNA, 23 bp, Homo sapiens
ttttcagggaaggtggcagctgg

SEQ ID NO: 15168 - DNA, 23 bp, Homo sapiens
tcatttatcacagtatcgtctgg

SEQ ID NO: 15169 - DNA, 23 bp, Homo sapiens
ccctggacgtgtggagctagggg

SEQ ID NO: 15170 - DNA, 23 bp, Homo sapiens
ttctaccgtctcataggctgagg

SEQ ID NO: 15171 - DNA, 23 bp, Homo sapiens
tctagaagacgattaagggaagg

SEQ ID NO: 15172 - DNA, 23 bp, Homo sapiens
gattacatcttctgcaactgtgg

SEQ ID NO: 15173 - DNA, 23 bp, Homo sapiens
ctactgtaagttgctcatagtgg

SEQ ID NO: 15174 - DNA, 23 bp, Homo sapiens
tgtccactgtacttaaatactgg

SEQ ID NO: 15175 - DNA, 23 bp, Homo sapiens
ccatgctaatttctggagactgg

SEQ ID NO: 15176 - DNA, 23 bp, Homo sapiens
ccaccgcaaatgcttgtaggtgg

SEQ ID NO: 15177 - DNA, 23 bp, Homo sapiens
gcatttgcggtggacaatggagg

SEQ ID NO: 15178 - DNA, 23 bp, Homo sapiens
tgaagaaaagcagatagaagtgg

SEQ ID NO: 15179 - DNA, 23 bp, Homo sapiens
ccggaggcagagagaaaaacggg

SEQ ID NO: 15180 - DNA, 23 bp, Homo sapiens
tctctctgtggaaggcttttagg

SEQ ID NO: 15181 - DNA, 23 bp, Homo sapiens
gcctccaaggcacagtgagctgg

SEQ ID NO: 15182 - DNA, 23 bp, Homo sapiens
ctgccccttaccagccttgatgg

SEQ ID NO: 15183 - DNA, 23 bp, Homo sapiens
aaccccagcacggggtaagtggg

SEQ ID NO: 15184 - DNA, 23 bp, Homo sapiens
cactcggctatcggcttgtcagg

SEQ ID NO: 15185 - DNA, 23 bp, Homo sapiens
gagaaactttttggtctcagtgg

SEQ ID NO: 15186 - DNA, 23 bp, Homo sapiens
gcggggtcactgcactgagccgg

SEQ ID NO: 15187 - DNA, 23 bp, Homo sapiens
ctcccccagctcgagttcactgg

SEQ ID NO: 15188 - DNA, 23 bp, Homo sapiens
gaacgctcgtctgcagcccgtgg

SEQ ID NO: 15189 - DNA, 23 bp, Homo sapiens
atcttgccatgatctctgactgg

SEQ ID NO: 15190 - DNA, 23 bp, Homo sapiens
ttctctgccacttactgaggggg

SEQ ID NO: 15191 - DNA, 23 bp, Homo sapiens
gccaagagtcttctaaatgccgg

SEQ ID NO: 15192 - DNA, 23 bp, Homo sapiens
ctgcgccctgccgcaatcagtgg

SEQ ID NO: 15193 - DNA, 23 bp, Homo sapiens
tctcccatgcattcaaactgagg

SEQ ID NO: 15194 - DNA, 23 bp, Homo sapiens
ctgggcctcctcagattttaggg

SEQ ID NO: 15195 - DNA, 23 bp, Homo sapiens
ggccaggggctgagccctaaggg

SEQ ID NO: 15196 - DNA, 23 bp, Homo sapiens
aaacgcctcctcctctataaagg

SEQ ID NO: 15197 - DNA, 23 bp, Homo sapiens
ggagcccttaacagactctctgg

SEQ ID NO: 15198 - DNA, 23 bp, Homo sapiens
gtaaatgctgctttactggctgg

SEQ ID NO: 15199 - DNA, 23 bp, Homo sapiens
ctgcacagtaccaacagacgtgg

SEQ ID NO: 15200 - DNA, 23 bp, Homo sapiens
gatgtttcaatcacttgccaagg

SEQ ID NO: 15201 - DNA, 23 bp, Homo sapiens
gggccgcccagggaagagagtgg

SEQ ID NO: 15202 - DNA, 23 bp, Homo sapiens
gcagcgtcagggcgcagagcagg

SEQ ID NO: 15203 - DNA, 23 bp, Homo sapiens
gctactgcaggagatctacaggg

SEQ ID NO: 15204 - DNA, 23 bp, Homo sapiens
gcggccatcattctgtgtggagg

SEQ ID NO: 15205 - DNA, 23 bp, Homo sapiens
tctacaaggacatgtactaacgg

SEQ ID NO: 15206 - DNA, 23 bp, Homo sapiens
gctcctgcaggagatctacaagg

SEQ ID NO: 15207 - DNA, 23 bp, Homo sapiens
ggcttcacattcagcaaacctgg

SEQ ID NO: 15208 - DNA, 23 bp, Homo sapiens
aagctcagagaagcttgcgcagg

SEQ ID NO: 15209 - DNA, 23 bp, Homo sapiens
gttaaggctgttatcaatgcagg

SEQ ID NO: 15210 - DNA, 23 bp, Homo sapiens
tgtagaattagaatggtagctgg

SEQ ID NO: 15211 - DNA, 23 bp, Homo sapiens
ttcttgattctgggagcatctgg

SEQ ID NO: 15212 - DNA, 23 bp, Homo sapiens
gaaactcccaaggctcagccagg

SEQ ID NO: 15213 - DNA, 23 bp, Homo sapiens
ggcttccagcagagttgacctgg

SEQ ID NO: 15214 - DNA, 23 bp, Homo sapiens
ctggggaacccgagttgagaagg

SEQ ID NO: 15215 - DNA, 23 bp, Homo sapiens
agcacagtgaagacaggctgagg

SEQ ID NO: 15216 - DNA, 23 bp, Homo sapiens
tctcgacacacagcttttatagg

SEQ ID NO: 15217 - DNA, 23 bp, Homo sapiens
gccacaggcggtcatgctgctgg

SEQ ID NO: 15218 - DNA, 23 bp, Homo sapiens
ggtaaccgctcaggtcaggacgg

SEQ ID NO: 15219 - DNA, 23 bp, Homo sapiens
ataaaagatctgtctgctactgg

SEQ ID NO: 15220 - DNA, 23 bp, Homo sapiens
taaaagatctgtctgctactggg

SEQ ID NO: 15221 - DNA, 23 bp, Homo sapiens
ctctcatttgtgtttagccaagg

SEQ ID NO: 15222 - DNA, 23 bp, Homo sapiens
ggctgttcttagtgtgcacctgg

SEQ ID NO: 15223 - DNA, 23 bp, Homo sapiens
ggttggattctgctacagtcagg

SEQ ID NO: 15224 - DNA, 23 bp, Homo sapiens
gcagatggacggtatgtgatggg

SEQ ID NO: 15225 - DNA, 23 bp, Homo sapiens
acatgagtatgtgcgaacagtgg

SEQ ID NO: 15226 - DNA, 23 bp, Homo sapiens
catttttcttgactgcccagagg

SEQ ID NO: 15227 - DNA, 23 bp, Homo sapiens
acctggaggcctgcactagcagg

SEQ ID NO: 15228 - DNA, 23 bp, Homo sapiens
ctgggggccatggctagtcccgg

SEQ ID NO: 15229 - DNA, 23 bp, Homo sapiens
tgagtcttcatctgtaatgctgg

SEQ ID NO: 15230 - DNA, 23 bp, Homo sapiens
aggcccgtggaccacagtcttgg

SEQ ID NO: 15231 - DNA, 23 bp, Homo sapiens
atcagctaatctgtcccacctgg

SEQ ID NO: 15232 - DNA, 23 bp, Homo sapiens
ctgcccccaactctgatgactgg

SEQ ID NO: 15233 - DNA, 23 bp, Homo sapiens
agcagttactgcttgttttctgg

SEQ ID NO: 15234 - DNA, 23 bp, Homo sapiens
aggctctccaaaatcttgagtgg

SEQ ID NO: 15235 - DNA, 23 bp, Homo sapiens
tctcacctgttcaatctctttgg

SEQ ID NO: 15236 - DNA, 23 bp, Homo sapiens
tggaggccatggagcgctttggg

SEQ ID NO: 15237 - DNA, 23 bp, Homo sapiens
gaattgtccacagtcagcaatgg

SEQ ID NO: 15238 - DNA, 23 bp, Homo sapiens
tttgccatcgccaaggagtaggg

SEQ ID NO: 15239 - DNA, 23 bp, Homo sapiens
ttgtggttgagatcgctgattgg

SEQ ID NO: 15240 - DNA, 23 bp, Homo sapiens
ggcacagaaagataaagagaagg

SEQ ID NO: 15241 - DNA, 23 bp, Homo sapiens
cgagctctacgtcagcttccagg

SEQ ID NO: 15242 - DNA, 23 bp, Homo sapiens
gcaggcaggaagcttctagatgg

SEQ ID NO: 15243 - DNA, 23 bp, Homo sapiens
tgtggggagtacgtgtgaggcgg

SEQ ID NO: 15244 - DNA, 23 bp, Homo sapiens
tggccacagattagctcaactgg

SEQ ID NO: 15245 - DNA, 23 bp, Homo sapiens
ggaacagatgaagacaaaagcgg

SEQ ID NO: 15246 - DNA, 23 bp, Homo sapiens
tgtggtgatctcgcagtgtgggg

SEQ ID NO: 15247 - DNA, 23 bp, Homo sapiens
gggtagcaagtctacccagaagg

SEQ ID NO: 15248 - DNA, 23 bp, Homo sapiens
gcggccaacctgctgctaccagg

SEQ ID NO: 15249 - DNA, 23 bp, Homo sapiens
gttttggggacttcagctcctgg

SEQ ID NO: 15250 - DNA, 23 bp, Homo sapiens
aggggcagacatacctctagtgg

SEQ ID NO: 15251 - DNA, 23 bp, Homo sapiens
tatcatagctactgagcaaatgg

SEQ ID NO: 15252 - DNA, 23 bp, Homo sapiens
acttctttggacttctgcttcgg

SEQ ID NO: 15253 - DNA, 23 bp, Homo sapiens
gaatggctggatacaaggagggg

SEQ ID NO: 15254 - DNA, 23 bp, Homo sapiens
atgtgtagaattactgacagtgg

SEQ ID NO: 15255 - DNA, 23 bp, Homo sapiens
gcaggcccaggaggtccctgagg

SEQ ID NO: 15256 - DNA, 23 bp, Homo sapiens
ttgttcctaatacctcatctcgg

SEQ ID NO: 15257 - DNA, 23 bp, Homo sapiens
cttggtatctgggcagaagtagg

SEQ ID NO: 15258 - DNA, 23 bp, Homo sapiens
cctcccaccagggggtgaattgg

SEQ ID NO: 15259 - DNA, 23 bp, Homo sapiens
ctggaatgcagagtagaaggtgg

SEQ ID NO: 15260 - DNA, 23 bp, Homo sapiens
gatgcagggacaaagatgagtgg

SEQ ID NO: 15261 - DNA, 23 bp, Homo sapiens
atccacatagagaaagtgatggg

SEQ ID NO: 15262 - DNA, 23 bp, Homo sapiens
gaaggtttttaaggctaccatgg

SEQ ID NO: 15263 - DNA, 23 bp, Homo sapiens
atcctttacttcatcaacacagg

SEQ ID NO: 15264 - DNA, 23 bp, Homo sapiens
ttccatgcccagatcttccttgg

SEQ ID NO: 15265 - DNA, 23 bp, Homo sapiens
ggctccaccaagaagctaggtgg

SEQ ID NO: 15266 - DNA, 23 bp, Homo sapiens
ggatgactgctagtctcgcttgg

SEQ ID NO: 15267 - DNA, 23 bp, Homo sapiens
tctaatgaccgactgggctcagg

SEQ ID NO: 15268 - DNA, 23 bp, Homo sapiens
gccaggcagttactcctgagggg

SEQ ID NO: 15269 - DNA, 23 bp, Homo sapiens
ctttgcctccagtggacgatggg

SEQ ID NO: 15270 - DNA, 23 bp, Homo sapiens
tgacaatataacagtcatggtgg

SEQ ID NO: 15271 - DNA, 23 bp, Homo sapiens
tacagtgtctgaatcctcagtgg

SEQ ID NO: 15272 - DNA, 23 bp, Homo sapiens
gggctcagccttggacatggagg

SEQ ID NO: 15273 - DNA, 23 bp, Homo sapiens
acagcaggtcactaacagccagg

SEQ ID NO: 15274 - DNA, 23 bp, Homo sapiens
agagttggggatcagctgttagg

SEQ ID NO: 15275 - DNA, 23 bp, Homo sapiens
ggtgtgcgggggctatttcttgg

SEQ ID NO: 15276 - DNA, 23 bp, Homo sapiens
cagctaatccgccgaagaaaagg

SEQ ID NO: 15277 - DNA, 23 bp, Homo sapiens
tgctttgtgatcataccccttgg

SEQ ID NO: 15278 - DNA, 23 bp, Homo sapiens
tttgaagctttctgaatggacgg

SEQ ID NO: 15279 - DNA, 23 bp, Homo sapiens
aatgggccccccctgccctaggg

SEQ ID NO: 15280 - DNA, 23 bp, Homo sapiens
agagggatttagtgctgcattgg

SEQ ID NO: 15281 - DNA, 23 bp, Homo sapiens
gaggctaaaggatgaaaatgggg

SEQ ID NO: 15282 - DNA, 23 bp, Homo sapiens
gagggtatgggggaattccaagg

SEQ ID NO: 15283 - DNA, 23 bp, Homo sapiens
aatctggagcctagcctacttgg

SEQ ID NO: 15284 - DNA, 23 bp, Homo sapiens
gctcttctggcttgttaaaaagg

SEQ ID NO: 15285 - DNA, 23 bp, Homo sapiens
ggggcaagaactagagctcctgg

SEQ ID NO: 15286 - DNA, 23 bp, Homo sapiens
agcaaactctccaagtgacccgg

SEQ ID NO: 15287 - DNA, 23 bp, Homo sapiens
ttcaggcgagtgttcgctgtcgg

SEQ ID NO: 15288 - DNA, 23 bp, Homo sapiens
tcaaaggagtaaagtctagcagg

SEQ ID NO: 15289 - DNA, 23 bp, Homo sapiens
ggagagtgcaagagggtcagggg

SEQ ID NO: 15290 - DNA, 23 bp, Homo sapiens
aatcatacactcttcttctgcgg

SEQ ID NO: 15291 - DNA, 23 bp, Homo sapiens
aggatctggagtttcagggcagg

SEQ ID NO: 15292 - DNA, 23 bp, Homo sapiens
gtctctcaggcttatttctgagg

SEQ ID NO: 15293 - DNA, 23 bp, Homo sapiens
ctggacctcagtgggaggcgtgg

SEQ ID NO: 15294 - DNA, 23 bp, Homo sapiens
gttctcaagcaatgttgagttgg

SEQ ID NO: 15295 - DNA, 23 bp, Homo sapiens
ccgtgctgcctgctcatgtgagg

SEQ ID NO: 15296 - DNA, 23 bp, Homo sapiens
cacacggagactaggagatacgg

SEQ ID NO: 15297 - DNA, 23 bp, Homo sapiens
gtggaagatgacgaaaaggatgg

SEQ ID NO: 15298 - DNA, 23 bp, Homo sapiens
tgttggaagatggtcaccgccgg

SEQ ID NO: 15299 - DNA, 23 bp, Homo sapiens
ggattccaagggagccaactcgg

SEQ ID NO: 15300 - DNA, 23 bp, Homo sapiens
cccctctgagcctggcacatagg

SEQ ID NO: 15301 - DNA, 23 bp, Homo sapiens
caatgaaagagaggagcagcggg

SEQ ID NO: 15302 - DNA, 23 bp, Homo sapiens
tgctgcagaccagtaattaatgg

SEQ ID NO: 15303 - DNA, 23 bp, Homo sapiens
ttgttttgctgttggtcacttgg

SEQ ID NO: 15304 - DNA, 23 bp, Homo sapiens
cacactaaagatgtccagtaagg

SEQ ID NO: 15305 - DNA, 23 bp, Homo sapiens
tggcggcagctcagtagtgaagg

SEQ ID NO: 15306 - DNA, 23 bp, Homo sapiens
aaagctggctcagtccatcgtgg

SEQ ID NO: 15307 - DNA, 23 bp, Homo sapiens
gtgaagcaggcatcttctaaggg

SEQ ID NO: 15308 - DNA, 23 bp, Homo sapiens
ctcagctgtgtgccacgcagcgg

SEQ ID NO: 15309 - DNA, 23 bp, Homo sapiens
gcaccggacactgaggcgatggg

SEQ ID NO: 15310 - DNA, 23 bp, Homo sapiens
cgtttctgggtcacacaagatgg

SEQ ID NO: 15311 - DNA, 23 bp, Homo sapiens
acatcatgccctaagtaacctgg

SEQ ID NO: 15312 - DNA, 23 bp, Homo sapiens
gtgtcacagtgtctcctgcccgg

SEQ ID NO: 15313 - DNA, 23 bp, Homo sapiens
tcctggctatcctgggaagaggg

SEQ ID NO: 15314 - DNA, 23 bp, Homo sapiens
cacctgcagtcactagtagtagg

SEQ ID NO: 15315 - DNA, 23 bp, Homo sapiens
ctgggggagaatggagaacttgg

SEQ ID NO: 15316 - DNA, 23 bp, Homo sapiens
cccgcgcggctcagatgaagtgg

SEQ ID NO: 15317 - DNA, 23 bp, Homo sapiens
gcgcctcgtctcagataaagtgg

SEQ ID NO: 15318 - DNA, 23 bp, Homo sapiens
ctctctggcttggttctcatagg

SEQ ID NO: 15319 - DNA, 23 bp, Homo sapiens
caggctcagagcgcgtccgcagg

SEQ ID NO: 15320 - DNA, 23 bp, Homo sapiens
atattggtgtccaaatcactggg

SEQ ID NO: 15321 - DNA, 23 bp, Homo sapiens
caaccaacttctgcatgtgaagg

SEQ ID NO: 15322 - DNA, 23 bp, Homo sapiens
agatcgatgccacgttcgtcagg

SEQ ID NO: 15323 - DNA, 23 bp, Homo sapiens
ggacagcctcacgtactgagggg

SEQ ID NO: 15324 - DNA, 23 bp, Homo sapiens
tcaaatcagcaaggaaggtgtgg

SEQ ID NO: 15325 - DNA, 23 bp, Homo sapiens
tcaactacagccgagggtgctgg

SEQ ID NO: 15326 - DNA, 23 bp, Homo sapiens
aaggaaacttgcaaacactgagg

SEQ ID NO: 15327 - DNA, 23 bp, Homo sapiens
tttcattacaggaagtagtctgg

SEQ ID NO: 15328 - DNA, 23 bp, Homo sapiens
gtggtgagcctcatgttacacgg

SEQ ID NO: 15329 - DNA, 23 bp, Homo sapiens
cgtcaaatactttgcccaggagg

SEQ ID NO: 15330 - DNA, 23 bp, Homo sapiens
gttcttgcattggcataatgagg

SEQ ID NO: 15331 - DNA, 23 bp, Homo sapiens
tggggtattagtctgtgctttgg

SEQ ID NO: 15332 - DNA, 23 bp, Homo sapiens
tacggcaatgatattttccttgg

SEQ ID NO: 15333 - DNA, 23 bp, Homo sapiens
ccaggacaaggttaactaggtgg

SEQ ID NO: 15334 - DNA, 23 bp, Homo sapiens
ggtaaactctgacatgcactagg

SEQ ID NO: 15335 - DNA, 23 bp, Homo sapiens
gtctctagttgattttgtcctgg

SEQ ID NO: 15336 - DNA, 23 bp, Homo sapiens
atgtggaaagcttcaatcagtgg

SEQ ID NO: 15337 - DNA, 23 bp, Homo sapiens
tctcgcgggcggcgtcacagcgg

SEQ ID NO: 15338 - DNA, 23 bp, Homo sapiens
tcagagatcatgtatcatcaagg

SEQ ID NO: 15339 - DNA, 23 bp, Homo sapiens
cagctttgtatgagctagtaagg

SEQ ID NO: 15340 - DNA, 23 bp, Homo sapiens
tgtctagctctgacccccactgg

SEQ ID NO: 15341 - DNA, 23 bp, Homo sapiens
tctagccaaagccaatccccagg

SEQ ID NO: 15342 - DNA, 23 bp, Homo sapiens
cgcggcgccccggaggctagcgg

SEQ ID NO: 15343 - DNA, 23 bp, Homo sapiens
tgaggggtcagagagcctcctgg

SEQ ID NO: 15344 - DNA, 23 bp, Homo sapiens
aagagaggtcttagacgtgatgg

SEQ ID NO: 15345 - DNA, 23 bp, Homo sapiens
actaacggcacggacagcaatgg

SEQ ID NO: 15346 - DNA, 23 bp, Homo sapiens
cctgggaagtagtgggtcactgg

SEQ ID NO: 15347 - DNA, 23 bp, Homo sapiens
tctaggtcagctgctgagacagg

SEQ ID NO: 15348 - DNA, 23 bp, Homo sapiens
gcaggactctaagtcatgaatgg

SEQ ID NO: 15349 - DNA, 23 bp, Homo sapiens
agatatccacaaaaagatggtgg

SEQ ID NO: 15350 - DNA, 23 bp, Homo sapiens
agaaaaaggctcatacgatgagg

SEQ ID NO: 15351 - DNA, 23 bp, Homo sapiens
caggggccgggcggggtcacagg

SEQ ID NO: 15352 - DNA, 23 bp, Homo sapiens
agcgtcctcaacctactagaagg

SEQ ID NO: 15353 - DNA, 23 bp, Homo sapiens
agaagtcaccgatgaaccaatgg

SEQ ID NO: 15354 - DNA, 23 bp, Homo sapiens
cctcaacttcccaaactgcgggg

SEQ ID NO: 15355 - DNA, 23 bp, Homo sapiens
tgatgatgaggatgaagataagg

SEQ ID NO: 15356 - DNA, 23 bp, Homo sapiens
atattttatgagccaagacgagg

SEQ ID NO: 15357 - DNA, 23 bp, Homo sapiens
agattttaggagctaagatgagg

SEQ ID NO: 15358 - DNA, 23 bp, Homo sapiens
ccaaatcctgataagacttgagg

SEQ ID NO: 15359 - DNA, 23 bp, Homo sapiens
ctccacagagtcacaccctctgg

SEQ ID NO: 15360 - DNA, 23 bp, Homo sapiens
taaagatacacaaccacggaagg

SEQ ID NO: 15361 - DNA, 23 bp, Homo sapiens
ctgcagctaggaatgatgtgagg

SEQ ID NO: 15362 - DNA, 23 bp, Homo sapiens
ggtgcctggaagacgtcacgtgg

SEQ ID NO: 15363 - DNA, 23 bp, Homo sapiens
aggatgggcgaaggcctcaaagg

SEQ ID NO: 15364 - DNA, 23 bp, Homo sapiens
ccggaagggcctgcatccccagg

SEQ ID NO: 15365 - DNA, 23 bp, Homo sapiens
ccagaaggagctgccttaaatgg

SEQ ID NO: 15366 - DNA, 23 bp, Homo sapiens
gggcggcagcagcatcacactgg

SEQ ID NO: 15367 - DNA, 23 bp, Homo sapiens
agtgaatggccctgtatgacggg

SEQ ID NO: 15368 - DNA, 23 bp, Homo sapiens
ttccagcactcccaggacagtgg

SEQ ID NO: 15369 - DNA, 23 bp, Homo sapiens
gggcccaaggttacctcctgagg

SEQ ID NO: 15370 - DNA, 23 bp, Homo sapiens
aactatacgggtttcatccaagg

SEQ ID NO: 15371 - DNA, 23 bp, Homo sapiens
attgaaccttggctctcctgagg

SEQ ID NO: 15372 - DNA, 23 bp, Homo sapiens
caccgtccttctttcaatagtgg

SEQ ID NO: 15373 - DNA, 23 bp, Homo sapiens
tatgatgctgacatcctcatagg

SEQ ID NO: 15374 - DNA, 23 bp, Homo sapiens
aggtggcattataagtccagcgg

SEQ ID NO: 15375 - DNA, 23 bp, Homo sapiens
ggcctcccgaaccaagcagcagg

SEQ ID NO: 15376 - DNA, 23 bp, Homo sapiens
acggcctacttcctgctgaaggg

SEQ ID NO: 15377 - DNA, 23 bp, Homo sapiens
ctcgtcctccccactgtcagagg

SEQ ID NO: 15378 - DNA, 23 bp, Homo sapiens
tcagcctggttctggtcagctgg

SEQ ID NO: 15379 - DNA, 23 bp, Homo sapiens
atgggatatatacagggcagagg

SEQ ID NO: 15380 - DNA, 23 bp, Homo sapiens
gaataggcagttggttagtcagg

SEQ ID NO: 15381 - DNA, 23 bp, Homo sapiens
taagtgaaattagcatgcctggg

SEQ ID NO: 15382 - DNA, 23 bp, Homo sapiens
tgtttgcattggccatgattggg

SEQ ID NO: 15383 - DNA, 23 bp, Homo sapiens
ccgctataaaggctgaatgatgg

SEQ ID NO: 15384 - DNA, 23 bp, Homo sapiens
cttctggctcagattcagaaagg

SEQ ID NO: 15385 - DNA, 23 bp, Homo sapiens
gcagaagtggatcatagacctgg

SEQ ID NO: 15386 - DNA, 23 bp, Homo sapiens
gaatttcgggaggccgaggcagg

SEQ ID NO: 15387 - DNA, 23 bp, Homo sapiens
cgacagaggctcaccactccagg

SEQ ID NO: 15388 - DNA, 23 bp, Homo sapiens
ggacaaactcttctaccagaagg

SEQ ID NO: 15389 - DNA, 23 bp, Homo sapiens
agagcaggaggctggatcctagg

SEQ ID NO: 15390 - DNA, 23 bp, Homo sapiens
gcttggctcacagaagctgcagg

SEQ ID NO: 15391 - DNA, 23 bp, Homo sapiens
cctaccggtcttaccgtcccagg

SEQ ID NO: 15392 - DNA, 23 bp, Homo sapiens
tgtttcatgcctaattagctggg

SEQ ID NO: 15393 - DNA, 23 bp, Homo sapiens
gagctccatctttgctgctaggg

SEQ ID NO: 15394 - DNA, 23 bp, Homo sapiens
gacttccatctttgctcctaggg

SEQ ID NO: 15395 - DNA, 23 bp, Homo sapiens
ttgaatgcctgctgtcagggtgg

SEQ ID NO: 15396 - DNA, 23 bp, Homo sapiens
gccttcactaagagcaaagatgg

SEQ ID NO: 15397 - DNA, 23 bp, Homo sapiens
tggggaaggcctgcctagtgggg

SEQ ID NO: 15398 - DNA, 23 bp, Homo sapiens
cggggaaggcctgcctagtgggg

SEQ ID NO: 15399 - DNA, 23 bp, Homo sapiens
tttacgacctggaggtagatcgg

SEQ ID NO: 15400 - DNA, 23 bp, Homo sapiens
tcaatttttgcttgtggggaagg

SEQ ID NO: 15401 - DNA, 23 bp, Homo sapiens
agcagtattgatctgcctccagg

SEQ ID NO: 15402 - DNA, 23 bp, Homo sapiens
agcagcattgatctgcctccagg

SEQ ID NO: 15403 - DNA, 23 bp, Homo sapiens
tgatggcaggcattcaacagagg

SEQ ID NO: 15404 - DNA, 23 bp, Homo sapiens
gatggcccctggagccctactgg

SEQ ID NO: 15405 - DNA, 23 bp, Homo sapiens
atgactggggaggctgtcactgg

SEQ ID NO: 15406 - DNA, 23 bp, Homo sapiens
tgtcattgaaccttgattactgg

SEQ ID NO: 15407 - DNA, 23 bp, Homo sapiens
tgaatcctagattactggggagg

SEQ ID NO: 15408 - DNA, 23 bp, Homo sapiens
tccagaagtagcatcagatttgg

SEQ ID NO: 15409 - DNA, 23 bp, Homo sapiens
tgatcagggcttctcaggactgg

SEQ ID NO: 15410 - DNA, 23 bp, Homo sapiens
ccaagccaaatatggattctagg

SEQ ID NO: 15411 - DNA, 23 bp, Homo sapiens
gcaagggtggacctttaaatggg

SEQ ID NO: 15412 - DNA, 23 bp, Homo sapiens
agagatttctatgacagtgcggg

SEQ ID NO: 15413 - DNA, 23 bp, Homo sapiens
acaagaaacagttgaaccaatgg

SEQ ID NO: 15414 - DNA, 23 bp, Homo sapiens
ccagggtggaagtcatggtttgg

SEQ ID NO: 15415 - DNA, 23 bp, Homo sapiens
gagttttaccccgacatttaggg

SEQ ID NO: 15416 - DNA, 23 bp, Homo sapiens
tacgcagtgggctgtgtggaggg

SEQ ID NO: 15417 - DNA, 23 bp, Homo sapiens
cgggcgcgctcacagcaccatgg

SEQ ID NO: 15418 - DNA, 23 bp, Homo sapiens
ccccgaggttgggggcggcgggg

SEQ ID NO: 15419 - DNA, 23 bp, Homo sapiens
agtcttcatgaaacttcatgtgg

SEQ ID NO: 15420 - DNA, 23 bp, Homo sapiens
ggcccagccccaggtgcaggcgg

SEQ ID NO: 15421 - DNA, 23 bp, Homo sapiens
ccggctgcccagcccgtcagagg

SEQ ID NO: 15422 - DNA, 23 bp, Homo sapiens
agtgtctactctttgaagaatgg

SEQ ID NO: 15423 - DNA, 23 bp, Homo sapiens
cctttggcttcactgattccagg

SEQ ID NO: 15424 - DNA, 23 bp, Homo sapiens
tgttttgggggcttttctacagg

SEQ ID NO: 15425 - DNA, 23 bp, Homo sapiens
taacagtgctgtgtattcagcgg

SEQ ID NO: 15426 - DNA, 23 bp, Homo sapiens
ggtgtagctgacagctaataggg

SEQ ID NO: 15427 - DNA, 23 bp, Homo sapiens
gcgtcctcttgtgctcatccagg

SEQ ID NO: 15428 - DNA, 23 bp, Homo sapiens
gagcccagaatcaatcgaagtgg

SEQ ID NO: 15429 - DNA, 23 bp, Homo sapiens
aaggtcaagagatcaaagaaagg

SEQ ID NO: 15430 - DNA, 23 bp, Homo sapiens
atgacctcgcataattgactcgg

SEQ ID NO: 15431 - DNA, 23 bp, Homo sapiens
gaagccctacgtctgcagggagg

SEQ ID NO: 15432 - DNA, 23 bp, Homo sapiens
gcccagcgctcacttctgcttgg

SEQ ID NO: 15433 - DNA, 23 bp, Homo sapiens
ttctccaaacacaattaggctgg

SEQ ID NO: 15434 - DNA, 23 bp, Homo sapiens
ttccaaagagtactttcagaagg

SEQ ID NO: 15435 - DNA, 23 bp, Homo sapiens
aaatacttcagctttccagctgg

SEQ ID NO: 15436 - DNA, 23 bp, Homo sapiens
aatatcatctcacagctctgagg

SEQ ID NO: 15437 - DNA, 23 bp, Homo sapiens
ttctccaagagacttaaggctgg

SEQ ID NO: 15438 - DNA, 23 bp, Homo sapiens
ccaggaagcagggaagctaaagg

SEQ ID NO: 15439 - DNA, 23 bp, Homo sapiens
tcctgctcctgctgtgtgtcggg

SEQ ID NO: 15440 - DNA, 23 bp, Homo sapiens
ttgctgctgctgctgcttcttgg

SEQ ID NO: 15441 - DNA, 23 bp, Homo sapiens
atgctgctaaaggaacagtgtgg

SEQ ID NO: 15442 - DNA, 23 bp, Homo sapiens
gaaagcgctgtgagctaaggagg

SEQ ID NO: 15443 - DNA, 23 bp, Homo sapiens
gcaaacgctgctgctgccattgg

SEQ ID NO: 15444 - DNA, 23 bp, Homo sapiens
cctgcagtccgtggtcatctagg

SEQ ID NO: 15445 - DNA, 23 bp, Homo sapiens
cgcggtgcctgaacgtcgactgg

SEQ ID NO: 15446 - DNA, 23 bp, Homo sapiens
atgcagtgtttcagaatttcagg

SEQ ID NO: 15447 - DNA, 23 bp, Homo sapiens
tggggcatttgggtgttcagagg

SEQ ID NO: 15448 - DNA, 23 bp, Homo sapiens
ccaaagggtaagaatcagacagg

SEQ ID NO: 15449 - DNA, 23 bp, Homo sapiens
tcttttcattcttctccagctgg

SEQ ID NO: 15450 - DNA, 23 bp, Homo sapiens
agctcactgttctcaccacacgg

SEQ ID NO: 15451 - DNA, 23 bp, Homo sapiens
ttcatctgttcctactgagctgg

SEQ ID NO: 15452 - DNA, 23 bp, Homo sapiens
ctccgtgccgctggcttagaagg

SEQ ID NO: 15453 - DNA, 23 bp, Homo sapiens
aggacagttgtaccagactttgg

SEQ ID NO: 15454 - DNA, 23 bp, Homo sapiens
tactgaggagactgcccctgtgg

SEQ ID NO: 15455 - DNA, 23 bp, Homo sapiens
aagaagaaaaagggacacaaggg

SEQ ID NO: 15456 - DNA, 23 bp, Homo sapiens
gcagaggacagttgcacagcagg

SEQ ID NO: 15457 - DNA, 23 bp, Homo sapiens
agaactgcatcgtggcttgaagg

SEQ ID NO: 15458 - DNA, 23 bp, Homo sapiens
cgcactgcaccatgtgctagtgg

SEQ ID NO: 15459 - DNA, 23 bp, Homo sapiens
aatctggataaatcccgaaaagg

SEQ ID NO: 15460 - DNA, 23 bp, Homo sapiens
ggatagccaattgcagtttgagg

SEQ ID NO: 15461 - DNA, 23 bp, Homo sapiens
tctctggaaatggatatggaagg

SEQ ID NO: 15462 - DNA, 23 bp, Homo sapiens
agtagacgtgaacaacgcagtgg

SEQ ID NO: 15463 - DNA, 23 bp, Homo sapiens
tctcagttataacagtgaagtgg

SEQ ID NO: 15464 - DNA, 23 bp, Homo sapiens
aattctattgtgtgacttccagg

SEQ ID NO: 15465 - DNA, 23 bp, Homo sapiens
agaaactagagacagatcaacgg

SEQ ID NO: 15466 - DNA, 23 bp, Homo sapiens
tccgcccccagctcttcatatgg

SEQ ID NO: 15467 - DNA, 23 bp, Homo sapiens
gctatacaagcccatttgaaggg

SEQ ID NO: 15468 - DNA, 23 bp, Homo sapiens
aggagttttctgagttttagggg

SEQ ID NO: 15469 - DNA, 23 bp, Homo sapiens
attggttggtctgcaaagaatgg

SEQ ID NO: 15470 - DNA, 23 bp, Homo sapiens
ttcatagtcatcaaagttgctgg

SEQ ID NO: 15471 - DNA, 23 bp, Homo sapiens
ggagagaagaagccctgagctgg

SEQ ID NO: 15472 - DNA, 23 bp, Homo sapiens
cgtttctgtctccttttgtttgg

SEQ ID NO: 15473 - DNA, 23 bp, Homo sapiens
tcagatcttctcaggccccgagg

SEQ ID NO: 15474 - DNA, 23 bp, Homo sapiens
acacaaaactgttgtactgctgg

SEQ ID NO: 15475 - DNA, 23 bp, Homo sapiens
aggagcattcccctgggctaagg

SEQ ID NO: 15476 - DNA, 23 bp, Homo sapiens
gggcgggagctgtgctcagacgg

SEQ ID NO: 15477 - DNA, 23 bp, Homo sapiens
gcgtggatctgggcaacctcggg

SEQ ID NO: 15478 - DNA, 23 bp, Homo sapiens
tctgggcaacctcgggcagtagg

SEQ ID NO: 15479 - DNA, 23 bp, Homo sapiens
catacttttgcttcatgcagtgg

SEQ ID NO: 15480 - DNA, 23 bp, Homo sapiens
tcatactgcactctgtaagatgg

SEQ ID NO: 15481 - DNA, 23 bp, Homo sapiens
atctacttagctcttgacttcgg

SEQ ID NO: 15482 - DNA, 23 bp, Homo sapiens
ttggaccaaaatgaatttgctgg

SEQ ID NO: 15483 - DNA, 23 bp, Homo sapiens
gagcacctcctggaagattgagg

SEQ ID NO: 15484 - DNA, 23 bp, Homo sapiens
cagtgggctctcagggcatcagg

SEQ ID NO: 15485 - DNA, 23 bp, Homo sapiens
ggaggggcgtctagaacccgcgg

SEQ ID NO: 15486 - DNA, 23 bp, Homo sapiens
cggcgggtgagattacatgacgg

SEQ ID NO: 15487 - DNA, 23 bp, Homo sapiens
taaggctatggttgcaattctgg

SEQ ID NO: 15488 - DNA, 23 bp, Homo sapiens
tcttctgcagacatcaaaagagg

SEQ ID NO: 15489 - DNA, 23 bp, Homo sapiens
cccaccgttccggccgaaagtgg

SEQ ID NO: 15490 - DNA, 23 bp, Homo sapiens
tcatgaaccccgggatggagcgg

SEQ ID NO: 15491 - DNA, 23 bp, Homo sapiens
cgaccatgacgagctctagctgg

SEQ ID NO: 15492 - DNA, 23 bp, Homo sapiens
tccaccgaggagtcggtgtgagg

SEQ ID NO: 15493 - DNA, 23 bp, Homo sapiens
ttataggagatggaactcagagg

SEQ ID NO: 15494 - DNA, 23 bp, Homo sapiens
gagcgcatcagtgttctctgagg

SEQ ID NO: 15495 - DNA, 23 bp, Homo sapiens
ggctcctaatccagatgatatgg

SEQ ID NO: 15496 - DNA, 23 bp, Homo sapiens
ggatgggagccctggatgtgagg

SEQ ID NO: 15497 - DNA, 23 bp, Homo sapiens
acctgatgacaactcaggatggg

SEQ ID NO: 15498 - DNA, 23 bp, Homo sapiens
tccagatgagctatcaggctggg

SEQ ID NO: 15499 - DNA, 23 bp, Homo sapiens
cactggttcgacgtgtagccagg

SEQ ID NO: 15500 - DNA, 23 bp, Homo sapiens
atcactttgtgcattgccacagg

SEQ ID NO: 15501 - DNA, 23 bp, Homo sapiens
agcagggcagcccggcgcagggg

SEQ ID NO: 15502 - DNA, 23 bp, Homo sapiens
agccgcgcccgtgccgcagaagg

SEQ ID NO: 15503 - DNA, 23 bp, Homo sapiens
gggcttagcagttgttgttgtgg

SEQ ID NO: 15504 - DNA, 23 bp, Homo sapiens
ggtgctatgtcgtcccaggatgg

SEQ ID NO: 15505 - DNA, 23 bp, Homo sapiens
ccagaatatgaccgtcagcgtgg

SEQ ID NO: 15506 - DNA, 23 bp, Homo sapiens
cttattgttctcaggagtcccgg

SEQ ID NO: 15507 - DNA, 23 bp, Homo sapiens
tatatgctcttcagctctactgg

SEQ ID NO: 15508 - DNA, 23 bp, Homo sapiens
tgagaggcacccaacatcaaggg

SEQ ID NO: 15509 - DNA, 23 bp, Homo sapiens
ttagtcaagctatcagtgaaagg

SEQ ID NO: 15510 - DNA, 23 bp, Homo sapiens
aattagtgtcttctacatcgcgg

SEQ ID NO: 15511 - DNA, 23 bp, Homo sapiens
ccaggaagagaacatgcagaagg

SEQ ID NO: 15512 - DNA, 23 bp, Homo sapiens
ggaattgctatggcctcacttgg

SEQ ID NO: 15513 - DNA, 23 bp, Homo sapiens
ggcagcatcgctcctgcagaagg

SEQ ID NO: 15514 - DNA, 23 bp, Homo sapiens
tggggtggtcagggacatgcagg

SEQ ID NO: 15515 - DNA, 23 bp, Homo sapiens
ggccttcgttgcgggtcaggagg

SEQ ID NO: 15516 - DNA, 23 bp, Homo sapiens
accgactaccggatgcgctgagg

SEQ ID NO: 15517 - DNA, 23 bp, Homo sapiens
acacttacttcagagcgctgagg

SEQ ID NO: 15518 - DNA, 23 bp, Homo sapiens
agcagtgtgcatatcttgagggg

SEQ ID NO: 15519 - DNA, 23 bp, Homo sapiens
catcaactgtcatctccagatgg

SEQ ID NO: 15520 - DNA, 23 bp, Homo sapiens
ctacatgtcagcgtcagagtagg

SEQ ID NO: 15521 - DNA, 23 bp, Homo sapiens
tgcttttatggctgtttcactgg

SEQ ID NO: 15522 - DNA, 23 bp, Homo sapiens
cacttggcacgcagggctagagg

SEQ ID NO: 15523 - DNA, 23 bp, Homo sapiens
aggcaacgctcagtcctccatgg

SEQ ID NO: 15524 - DNA, 23 bp, Homo sapiens
ctgcatctcaggaactgctctgg

SEQ ID NO: 15525 - DNA, 23 bp, Homo sapiens
ttgctcaagagtggtcagtctgg

SEQ ID NO: 15526 - DNA, 23 bp, Homo sapiens
cctcgatttcacagtagacttgg

SEQ ID NO: 15527 - DNA, 23 bp, Homo sapiens
catccaggttgaaatgggagagg

SEQ ID NO: 15528 - DNA, 23 bp, Homo sapiens
tctggctttgatctggctcacgg

SEQ ID NO: 15529 - DNA, 23 bp, Homo sapiens
atcttcctgatagtgggatgagg

SEQ ID NO: 15530 - DNA, 23 bp, Homo sapiens
atcggcccggggcctcacagcgg

SEQ ID NO: 15531 - DNA, 23 bp, Homo sapiens
ggaagccccccagaagagctggg

SEQ ID NO: 15532 - DNA, 23 bp, Homo sapiens
tcaaaccccaacctcagttgagg

SEQ ID NO: 15533 - DNA, 23 bp, Homo sapiens
tcttcctgtgcacaggtggacgg

SEQ ID NO: 15534 - DNA, 23 bp, Homo sapiens
tgtgctggcgggtgctaggcagg

SEQ ID NO: 15535 - DNA, 23 bp, Homo sapiens
gaccccctcaggggtgctagtgg

SEQ ID NO: 15536 - DNA, 23 bp, Homo sapiens
attgatgttcttcaagtccatgg

SEQ ID NO: 15537 - DNA, 23 bp, Homo sapiens
tactccagagcgattacttttgg

SEQ ID NO: 15538 - DNA, 23 bp, Homo sapiens
gatgcctgccaccgaagaggtgg

SEQ ID NO: 15539 - DNA, 23 bp, Homo sapiens
cagaagaggtggactgtatcagg

SEQ ID NO: 15540 - DNA, 23 bp, Homo sapiens
atcagctatcaatgttgtgatgg

SEQ ID NO: 15541 - DNA, 23 bp, Homo sapiens
gttacctccctgaagctgtaggg

SEQ ID NO: 15542 - DNA, 23 bp, Homo sapiens
ccatccaagtcctggaactgagg

SEQ ID NO: 15543 - DNA, 23 bp, Homo sapiens
cagagcctccaatttgaacgggg

SEQ ID NO: 15544 - DNA, 23 bp, Homo sapiens
ctcactcatgtccatcagtttgg

SEQ ID NO: 15545 - DNA, 23 bp, Homo sapiens
caagcctgtcccagagtgggtgg

SEQ ID NO: 15546 - DNA, 23 bp, Homo sapiens
tgctcagggagagttcgtgaggg

SEQ ID NO: 15547 - DNA, 23 bp, Homo sapiens
ttcaaagtcttctggcctccagg

SEQ ID NO: 15548 - DNA, 23 bp, Homo sapiens
actcatgaagcagctcttgtagg

SEQ ID NO: 15549 - DNA, 23 bp, Homo sapiens
cttaaccccgaaacagctactgg

SEQ ID NO: 15550 - DNA, 23 bp, Homo sapiens
aggtctccaggtactcactctgg

SEQ ID NO: 15551 - DNA, 23 bp, Homo sapiens
tacagacccatccaaatgtgtgg

SEQ ID NO: 15552 - DNA, 23 bp, Homo sapiens
tcagaagggccagggcctacagg

SEQ ID NO: 15553 - DNA, 23 bp, Homo sapiens
acaaagggagatggtgaatgggg

SEQ ID NO: 15554 - DNA, 23 bp, Homo sapiens
cttgcagtagtctcaatcagtgg

SEQ ID NO: 15555 - DNA, 23 bp, Homo sapiens
gactcttacataatccccaatgg

SEQ ID NO: 15556 - DNA, 23 bp, Homo sapiens
tcacgacagagcgcatgaagagg

SEQ ID NO: 15557 - DNA, 23 bp, Homo sapiens
gacacacgcagtcattcaggtgg

SEQ ID NO: 15558 - DNA, 23 bp, Homo sapiens
gccggagagggaatgagtaatgg

SEQ ID NO: 15559 - DNA, 23 bp, Homo sapiens
ggctctcttgttctatactttgg

SEQ ID NO: 15560 - DNA, 23 bp, Homo sapiens
tcctccccctccaacctgatggg

SEQ ID NO: 15561 - DNA, 23 bp, Homo sapiens
cgagtttgggacctacgcacagg

SEQ ID NO: 15562 - DNA, 23 bp, Homo sapiens
caggaccttcaagctgtggatgg

SEQ ID NO: 15563 - DNA, 23 bp, Homo sapiens
aagaacccttttggagcaactgg

SEQ ID NO: 15564 - DNA, 23 bp, Homo sapiens
agaacagctcattgggtcactgg

SEQ ID NO: 15565 - DNA, 23 bp, Homo sapiens
cctacagcacgccttcatccagg

SEQ ID NO: 15566 - DNA, 23 bp, Homo sapiens
atggcaaccgctcaatcagaagg

SEQ ID NO: 15567 - DNA, 23 bp, Homo sapiens
agggaaacggtcaggcatacagg

SEQ ID NO: 15568 - DNA, 23 bp, Homo sapiens
accaaggggttcagtaactgtgg

SEQ ID NO: 15569 - DNA, 23 bp, Homo sapiens
aggccccagaggctggctgaggg

SEQ ID NO: 15570 - DNA, 23 bp, Homo sapiens
ataaagggacatggctgaatagg

SEQ ID NO: 15571 - DNA, 23 bp, Homo sapiens
ataaaggaacatggctgaacagg

SEQ ID NO: 15572 - DNA, 23 bp, Homo sapiens
ttcccattctggatttatagcgg

SEQ ID NO: 15573 - DNA, 23 bp, Homo sapiens
ccttttccgaaacatcactgtgg

SEQ ID NO: 15574 - DNA, 23 bp, Homo sapiens
tcctaccttttcagaaacatagg

SEQ ID NO: 15575 - DNA, 23 bp, Homo sapiens
tcaaagctgcttgtagaaagtgg

SEQ ID NO: 15576 - DNA, 23 bp, Homo sapiens
tggggcggggtcacccgcagcgg

SEQ ID NO: 15577 - DNA, 23 bp, Homo sapiens
tattcagtcagaatcactgctgg

SEQ ID NO: 15578 - DNA, 23 bp, Homo sapiens
ggagcagccccactggacctagg

SEQ ID NO: 15579 - DNA, 23 bp, Homo sapiens
gaggagcaggaacaatcatcagg

SEQ ID NO: 15580 - DNA, 23 bp, Homo sapiens
ggggctactgcttgtcctcgtgg

SEQ ID NO: 15581 - DNA, 23 bp, Homo sapiens
aggacggtcatcaaagtgaaggg

SEQ ID NO: 15582 - DNA, 23 bp, Homo sapiens
catacatcacacggttgtagtgg

SEQ ID NO: 15583 - DNA, 23 bp, Homo sapiens
gctgggctcacagcgtgctcagg

SEQ ID NO: 15584 - DNA, 23 bp, Homo sapiens
ccacccatgagactgtactgagg

SEQ ID NO: 15585 - DNA, 23 bp, Homo sapiens
tagtggtcaatacgcaatgtcgg

SEQ ID NO: 15586 - DNA, 23 bp, Homo sapiens
aggtcaaatgtgctttaatgcgg

SEQ ID NO: 15587 - DNA, 23 bp, Homo sapiens
tgtgggaagcagttcattcctgg

SEQ ID NO: 15588 - DNA, 23 bp, Homo sapiens
tgggggtgggggtctatgcctgg

SEQ ID NO: 15589 - DNA, 23 bp, Homo sapiens
tgtgggaggcaactcattcctgg

SEQ ID NO: 15590 - DNA, 23 bp, Homo sapiens
gggcacggagatgtctctttagg

SEQ ID NO: 15591 - DNA, 23 bp, Homo sapiens
tcaccaccgggtggagccacagg

SEQ ID NO: 15592 - DNA, 23 bp, Homo sapiens
cccttctccctctcttgaacagg

SEQ ID NO: 15593 - DNA, 23 bp, Homo sapiens
cttacacaacagcacagatccgg

SEQ ID NO: 15594 - DNA, 23 bp, Homo sapiens
gatgttggagatctatggtgagg

SEQ ID NO: 15595 - DNA, 23 bp, Homo sapiens
gggccggggtctgtcctcatagg

SEQ ID NO: 15596 - DNA, 23 bp, Homo sapiens
gggaaggcacagtctcacagagg

SEQ ID NO: 15597 - DNA, 23 bp, Homo sapiens
ggaactagactgatgacttttgg

SEQ ID NO: 15598 - DNA, 23 bp, Homo sapiens
cacggaggggctagagtgagagg

SEQ ID NO: 15599 - DNA, 23 bp, Homo sapiens
ccaacagagagcacagctgatgg

SEQ ID NO: 15600 - DNA, 23 bp, Homo sapiens
tacctgtaattccagcacattgg

SEQ ID NO: 15601 - DNA, 23 bp, Homo sapiens
aggcgctgcaggtcagacctcgg

SEQ ID NO: 15602 - DNA, 23 bp, Homo sapiens
ggggctgtggtctggctcagtgg

SEQ ID NO: 15603 - DNA, 23 bp, Homo sapiens
tctggtaatctagaattcagtgg

SEQ ID NO: 15604 - DNA, 23 bp, Homo sapiens
tgaattctagattaccagagtgg

SEQ ID NO: 15605 - DNA, 23 bp, Homo sapiens
ggccggcagagtgtcgtgtgagg

SEQ ID NO: 15606 - DNA, 23 bp, Homo sapiens
atagttcaggacagtcaccttgg

SEQ ID NO: 15607 - DNA, 23 bp, Homo sapiens
caggggtggcgactcagctgagg

SEQ ID NO: 15608 - DNA, 23 bp, Homo sapiens
aggactacagccgtatagagggg

SEQ ID NO: 15609 - DNA, 23 bp, Homo sapiens
agcagctactttcccttgccagg

SEQ ID NO: 15610 - DNA, 23 bp, Homo sapiens
gccacccaggacagtgtgagagg

SEQ ID NO: 15611 - DNA, 23 bp, Homo sapiens
ttccgagcaggaggcttaccagg

SEQ ID NO: 15612 - DNA, 23 bp, Homo sapiens
ggcaagaggaactccctcagcgg

SEQ ID NO: 15613 - DNA, 23 bp, Homo sapiens
tgtcaaagtggaggagagtaagg

SEQ ID NO: 15614 - DNA, 23 bp, Homo sapiens
tcttcggttttgatcgcctgagg

SEQ ID NO: 15615 - DNA, 23 bp, Homo sapiens
aagtttgcagcttcatttgatgg

SEQ ID NO: 15616 - DNA, 23 bp, Homo sapiens
ctggggctcacgtcttgcacagg

SEQ ID NO: 15617 - DNA, 23 bp, Homo sapiens
tcgaaagcagctcttcagtgagg

SEQ ID NO: 15618 - DNA, 23 bp, Homo sapiens
ccctggcgctgacaagtagtggg

SEQ ID NO: 15619 - DNA, 23 bp, Homo sapiens
tgacaaggtagtcagtgagatgg

SEQ ID NO: 15620 - DNA, 23 bp, Homo sapiens
gcagcaccacgagaactactggg

SEQ ID NO: 15621 - DNA, 23 bp, Homo sapiens
aggcctgggctagggtcccatgg

SEQ ID NO: 15622 - DNA, 23 bp, Homo sapiens
gcctcctgcgtcatcaacttagg

SEQ ID NO: 15623 - DNA, 23 bp, Homo sapiens
tcccacagtgtataagtgagggg

SEQ ID NO: 15624 - DNA, 23 bp, Homo sapiens
gaccgctcttcaaagctcgatgg

SEQ ID NO: 15625 - DNA, 23 bp, Homo sapiens
ggcggagggtggggaatgaatgg

SEQ ID NO: 15626 - DNA, 23 bp, Homo sapiens
gacaccatagacctgtgaagagg

SEQ ID NO: 15627 - DNA, 23 bp, Homo sapiens
ggcctcccctgatctctcactgg

SEQ ID NO: 15628 - DNA, 23 bp, Homo sapiens
caggtgccaacagtcaactgagg

SEQ ID NO: 15629 - DNA, 23 bp, Homo sapiens
ggcttcataacggattctaacgg

SEQ ID NO: 15630 - DNA, 23 bp, Homo sapiens
actggacttcagttcaccgtagg

SEQ ID NO: 15631 - DNA, 23 bp, Homo sapiens
atactgggggctttagctattgg

SEQ ID NO: 15632 - DNA, 23 bp, Homo sapiens
ttggtgacactttttatccaagg

SEQ ID NO: 15633 - DNA, 23 bp, Homo sapiens
gcaaaggagagccagattaaggg

SEQ ID NO: 15634 - DNA, 23 bp, Homo sapiens
ggaccaggggctttagctgttgg

SEQ ID NO: 15635 - DNA, 23 bp, Homo sapiens
gggctcaggtaggctcagaccgg

SEQ ID NO: 15636 - DNA, 23 bp, Homo sapiens
tggcaatgcccaaggcgggaagg

SEQ ID NO: 15637 - DNA, 23 bp, Homo sapiens
ggggccgccgcgcgctcctaggg

SEQ ID NO: 15638 - DNA, 23 bp, Homo sapiens
actacctggattgtagggagggg

SEQ ID NO: 15639 - DNA, 23 bp, Homo sapiens
ggccccgggggtctcacttctgg

SEQ ID NO: 15640 - DNA, 23 bp, Homo sapiens
ggaccgggggctttagctgttgg

SEQ ID NO: 15641 - DNA, 23 bp, Homo sapiens
cacatatagcccctggattcagg

SEQ ID NO: 15642 - DNA, 23 bp, Homo sapiens
aacgatgccaattgtgcttacgg

SEQ ID NO: 15643 - DNA, 23 bp, Homo sapiens
tctcctgatccagagctgagggg

SEQ ID NO: 15644 - DNA, 23 bp, Homo sapiens
ctggattgagaacactgctaagg

SEQ ID NO: 15645 - DNA, 23 bp, Homo sapiens
gctggctggtcagtgctgtgagg

SEQ ID NO: 15646 - DNA, 23 bp, Homo sapiens
gctgctccttgccctgctgtggg

SEQ ID NO: 15647 - DNA, 23 bp, Homo sapiens
gcatcggctgtggtcgctgaggg

SEQ ID NO: 15648 - DNA, 23 bp, Homo sapiens
agggaggtcaggagcccatctgg

SEQ ID NO: 15649 - DNA, 23 bp, Homo sapiens
tgggagaggcgggaggatgaggg

SEQ ID NO: 15650 - DNA, 23 bp, Homo sapiens
ggagagccactgctaaccctggg

SEQ ID NO: 15651 - DNA, 23 bp, Homo sapiens
tcctgtgagttatctgcccctgg

SEQ ID NO: 15652 - DNA, 23 bp, Homo sapiens
gggagggcacacagagtcagagg

SEQ ID NO: 15653 - DNA, 23 bp, Homo sapiens
caaccaaccagctgctgacaggg

SEQ ID NO: 15654 - DNA, 23 bp, Homo sapiens
gcaaaagaaaacaagcacgaagg

SEQ ID NO: 15655 - DNA, 23 bp, Homo sapiens
aaatagctctgaacaacacatgg

SEQ ID NO: 15656 - DNA, 23 bp, Homo sapiens
gcatcagttttgcagatgaaagg

SEQ ID NO: 15657 - DNA, 23 bp, Homo sapiens
agacatggctcagggttgcctgg

SEQ ID NO: 15658 - DNA, 23 bp, Homo sapiens
ccgcaaggttgtggctcaggcgg

SEQ ID NO: 15659 - DNA, 23 bp, Homo sapiens
ctgccacagctcagttattttgg

SEQ ID NO: 15660 - DNA, 23 bp, Homo sapiens
tggctcagcgagcactgagctgg

SEQ ID NO: 15661 - DNA, 23 bp, Homo sapiens
aagagaacatccagaagtgacgg

SEQ ID NO: 15662 - DNA, 23 bp, Homo sapiens
atatgcgtcatcaatgagcacgg

SEQ ID NO: 15663 - DNA, 23 bp, Homo sapiens
actgccagtgaaagaatcagagg

SEQ ID NO: 15664 - DNA, 23 bp, Homo sapiens
ctgtgggaggggcggttcagggg

SEQ ID NO: 15665 - DNA, 23 bp, Homo sapiens
gcctctcaacagtcacttcttgg

SEQ ID NO: 15666 - DNA, 23 bp, Homo sapiens
gctgaaagaaaagccttagttgg

SEQ ID NO: 15667 - DNA, 23 bp, Homo sapiens
gatggagggggctcaggctgcgg

SEQ ID NO: 15668 - DNA, 23 bp, Homo sapiens
cttagtcttcttcatgaacgtgg

SEQ ID NO: 15669 - DNA, 23 bp, Homo sapiens
acgccatgtgtggaactaggagg

SEQ ID NO: 15670 - DNA, 23 bp, Homo sapiens
gtcacgcgtgttccccagcgtgg

SEQ ID NO: 15671 - DNA, 23 bp, Homo sapiens
aattgaagacgttcagaagctgg

SEQ ID NO: 15672 - DNA, 23 bp, Homo sapiens
cacttcatctcagcctttaccgg

SEQ ID NO: 15673 - DNA, 23 bp, Homo sapiens
caggggcaggcagtgggcggcgg

SEQ ID NO: 15674 - DNA, 23 bp, Homo sapiens
atccatgtcagctaagtatcagg

SEQ ID NO: 15675 - DNA, 23 bp, Homo sapiens
tgcttaatgcttggtgtttcagg

SEQ ID NO: 15676 - DNA, 23 bp, Homo sapiens
gctggcttcacagctgattgcgg

SEQ ID NO: 15677 - DNA, 23 bp, Homo sapiens
aggctgtacaagataatctgtgg

SEQ ID NO: 15678 - DNA, 23 bp, Homo sapiens
cccatcagctctacatctgaggg

SEQ ID NO: 15679 - DNA, 23 bp, Homo sapiens
gtatgtgcagaagttgtcagggg

SEQ ID NO: 15680 - DNA, 23 bp, Homo sapiens
gacttcgactgtcatggatttgg

SEQ ID NO: 15681 - DNA, 23 bp, Homo sapiens
gttggcaatagggttttaggtgg

SEQ ID NO: 15682 - DNA, 23 bp, Homo sapiens
gttgtccacctccagcttatagg

SEQ ID NO: 15683 - DNA, 23 bp, Homo sapiens
tgacatcacggctgctacgttgg

SEQ ID NO: 15684 - DNA, 23 bp, Homo sapiens
tgacatcacagctgctatgttgg

SEQ ID NO: 15685 - DNA, 23 bp, Homo sapiens
tgacatcacggctgctataatgg

SEQ ID NO: 15686 - DNA, 23 bp, Homo sapiens
gactttgactgtgatggatttgg

SEQ ID NO: 15687 - DNA, 23 bp, Homo sapiens
tgacttcacggctgctatattgg

SEQ ID NO: 15688 - DNA, 23 bp, Homo sapiens
ctctgtctggtttccatggcagg

SEQ ID NO: 15689 - DNA, 23 bp, Homo sapiens
ctttgggaggtcacagcagaagg

SEQ ID NO: 15690 - DNA, 23 bp, Homo sapiens
gactctgactgtcacggatttgg

SEQ ID NO: 15691 - DNA, 23 bp, Homo sapiens
cttggcaatagggatttaggtgg

SEQ ID NO: 15692 - DNA, 23 bp, Homo sapiens
tcgtaactcagccactggcaagg

SEQ ID NO: 15693 - DNA, 23 bp, Homo sapiens
gtcatgactgagactctgtcagg

SEQ ID NO: 15694 - DNA, 23 bp, Homo sapiens
acgcaagcaagaggaacaaatgg

SEQ ID NO: 15695 - DNA, 23 bp, Homo sapiens
agagactgaaatatctctgaagg

SEQ ID NO: 15696 - DNA, 23 bp, Homo sapiens
cgctaccagcagcaatacaatgg

SEQ ID NO: 15697 - DNA, 23 bp, Homo sapiens
gcttacaaaagcgcagacagtgg

SEQ ID NO: 15698 - DNA, 23 bp, Homo sapiens
agaaaaggctgatgaaccaatgg

SEQ ID NO: 15699 - DNA, 23 bp, Homo sapiens
tctcgtcttgtatctctaattgg

SEQ ID NO: 15700 - DNA, 23 bp, Homo sapiens
gcttactccaactgaagttaagg

SEQ ID NO: 15701 - DNA, 23 bp, Homo sapiens
agaagcagagaaatatgctaagg

SEQ ID NO: 15702 - DNA, 23 bp, Homo sapiens
ggatggaaggccacatgcattgg

SEQ ID NO: 15703 - DNA, 23 bp, Homo sapiens
tttcttctcacgctcagctttgg

SEQ ID NO: 15704 - DNA, 23 bp, Homo sapiens
agaacttgaagaggttatcaagg

SEQ ID NO: 15705 - DNA, 23 bp, Homo sapiens
ctctctctgctagagcaacaagg

SEQ ID NO: 15706 - DNA, 23 bp, Homo sapiens
acattgaacttgctgtcatgagg

SEQ ID NO: 15707 - DNA, 23 bp, Homo sapiens
caatgttttttccaccagactgg

SEQ ID NO: 15708 - DNA, 23 bp, Homo sapiens
ggaaactgtttccttaaggaagg

SEQ ID NO: 15709 - DNA, 23 bp, Homo sapiens
aactgtgcaggctatggaggtgg

SEQ ID NO: 15710 - DNA, 23 bp, Homo sapiens
gatgccagcagggactgagacgg

SEQ ID NO: 15711 - DNA, 23 bp, Homo sapiens
atgatgttaggagccctgtttgg

SEQ ID NO: 15712 - DNA, 23 bp, Homo sapiens
gggaacagggttagtccattcgg

SEQ ID NO: 15713 - DNA, 23 bp, Homo sapiens
catgtgggcaatatcccagttgg

SEQ ID NO: 15714 - DNA, 23 bp, Homo sapiens
ctgcatccaccctctttcagggg

SEQ ID NO: 15715 - DNA, 23 bp, Homo sapiens
tctactacgtggacagtgaaggg

SEQ ID NO: 15716 - DNA, 23 bp, Homo sapiens
caggcggatcactcctccactgg

SEQ ID NO: 15717 - DNA, 23 bp, Homo sapiens
ctagaatcccaggattcaggcgg

SEQ ID NO: 15718 - DNA, 23 bp, Homo sapiens
aacaatggacacttcctgaatgg

SEQ ID NO: 15719 - DNA, 23 bp, Homo sapiens
accgggaagccaatcaataatgg

SEQ ID NO: 15720 - DNA, 23 bp, Homo sapiens
gtggaccatcgagtcatcttggg

SEQ ID NO: 15721 - DNA, 23 bp, Homo sapiens
cattagagatacagcccctcagg

SEQ ID NO: 15722 - DNA, 23 bp, Homo sapiens
cagttgtatgtcatgtaacgagg

SEQ ID NO: 15723 - DNA, 23 bp, Homo sapiens
ttgaagaagggatgagagtgggg

SEQ ID NO: 15724 - DNA, 23 bp, Homo sapiens
aacctacaatactacgcctaggg

SEQ ID NO: 15725 - DNA, 23 bp, Homo sapiens
cctgaccgtgggcccctcagggg

SEQ ID NO: 15726 - DNA, 23 bp, Homo sapiens
tgtcatcaagaaggacgagcagg

SEQ ID NO: 15727 - DNA, 23 bp, Homo sapiens
actgtccttctgcatgaccttgg

SEQ ID NO: 15728 - DNA, 23 bp, Homo sapiens
taagaagctggagtctaaattgg

SEQ ID NO: 15729 - DNA, 23 bp, Homo sapiens
atatactcaaatggttctggggg

SEQ ID NO: 15730 - DNA, 23 bp, Homo sapiens
aatgcaccgggcagcagccaagg

SEQ ID NO: 15731 - DNA, 23 bp, Homo sapiens
atactcaagagaatggtggaagg

SEQ ID NO: 15732 - DNA, 23 bp, Homo sapiens
caaagccaagaaactgacatagg

SEQ ID NO: 15733 - DNA, 23 bp, Homo sapiens
gtttcttggctttgttgtagagg

SEQ ID NO: 15734 - DNA, 23 bp, Homo sapiens
tacgcatctcatagccaaagagg

SEQ ID NO: 15735 - DNA, 23 bp, Homo sapiens
gcccatgacatcctcacctaggg

SEQ ID NO: 15736 - DNA, 23 bp, Homo sapiens
ccagtgtttagcagctatgttgg

SEQ ID NO: 15737 - DNA, 23 bp, Homo sapiens
cataattggggttcttccgaagg

SEQ ID NO: 15738 - DNA, 23 bp, Homo sapiens
gatgacagcttcccttgagctgg

SEQ ID NO: 15739 - DNA, 23 bp, Homo sapiens
cggcaagaaggacaagaaggagg

SEQ ID NO: 15740 - DNA, 23 bp, Homo sapiens
gtttccacgacagcagtagaagg

SEQ ID NO: 15741 - DNA, 23 bp, Homo sapiens
tactgccagttcttgctatcagg

SEQ ID NO: 15742 - DNA, 23 bp, Homo sapiens
aaaggataggaaagaggacaagg

SEQ ID NO: 15743 - DNA, 23 bp, Homo sapiens
agacgatcatctccagctgccgg

SEQ ID NO: 15744 - DNA, 23 bp, Homo sapiens
agggacaatcatctttgcagagg

SEQ ID NO: 15745 - DNA, 23 bp, Homo sapiens
aagcccaggggagaaacaaaggg

SEQ ID NO: 15746 - DNA, 23 bp, Homo sapiens
ccctgcaggctaggggttaaggg

SEQ ID NO: 15747 - DNA, 23 bp, Homo sapiens
tccgcaatgcttatgtgaggagg

SEQ ID NO: 15748 - DNA, 23 bp, Homo sapiens
tcccgggttcagtacatagatgg

SEQ ID NO: 15749 - DNA, 23 bp, Homo sapiens
aatgcagagactctgtactgagg

SEQ ID NO: 15750 - DNA, 23 bp, Homo sapiens
gcatggtgacacaagaagatcgg

SEQ ID NO: 15751 - DNA, 23 bp, Homo sapiens
gcccgaggcctgacagacgcggg

SEQ ID NO: 15752 - DNA, 23 bp, Homo sapiens
tacattcttgaggccttcacagg

SEQ ID NO: 15753 - DNA, 23 bp, Homo sapiens
tgagtgactacgtacccgggtgg

SEQ ID NO: 15754 - DNA, 23 bp, Homo sapiens
tgcccgcgtctgtcaggcctcgg

SEQ ID NO: 15755 - DNA, 23 bp, Homo sapiens
tctttagtatctcagtgctttgg

SEQ ID NO: 15756 - DNA, 23 bp, Homo sapiens
attagatcagaaaagtgcagggg

SEQ ID NO: 15757 - DNA, 23 bp, Homo sapiens
gtgtgccaggtgtggtgacctgg

SEQ ID NO: 15758 - DNA, 23 bp, Homo sapiens
aggtggggcccactctttaatgg

SEQ ID NO: 15759 - DNA, 23 bp, Homo sapiens
gccactcagctagaacttttcgg

SEQ ID NO: 15760 - DNA, 23 bp, Homo sapiens
tctctgggaggcttagatcaagg

SEQ ID NO: 15761 - DNA, 23 bp, Homo sapiens
cccgggaagagtacagataatgg

SEQ ID NO: 15762 - DNA, 23 bp, Homo sapiens
agtcaagggggcaactttgaagg

SEQ ID NO: 15763 - DNA, 23 bp, Homo sapiens
tgtagagctgctgggagaactgg

SEQ ID NO: 15764 - DNA, 23 bp, Homo sapiens
cctgcggctgtggtggctgaggg

SEQ ID NO: 15765 - DNA, 23 bp, Homo sapiens
tggcagtcccaggacctaccagg

SEQ ID NO: 15766 - DNA, 23 bp, Homo sapiens
agaagaggccattgagcacgggg

SEQ ID NO: 15767 - DNA, 23 bp, Homo sapiens
tcctacctggagaagctttgagg

SEQ ID NO: 15768 - DNA, 23 bp, Homo sapiens
agatgatcccaattactctttgg

SEQ ID NO: 15769 - DNA, 23 bp, Homo sapiens
gaagcagggactaatttttgagg

SEQ ID NO: 15770 - DNA, 23 bp, Homo sapiens
cagtgcatacaggaaatggctgg

SEQ ID NO: 15771 - DNA, 23 bp, Homo sapiens
tgggggcctgtgcccctagatgg

SEQ ID NO: 15772 - DNA, 23 bp, Homo sapiens
agaaagacactctcagatgatgg

SEQ ID NO: 15773 - DNA, 23 bp, Homo sapiens
attttgagaaggaaactctgagg

SEQ ID NO: 15774 - DNA, 23 bp, Homo sapiens
ctgttcccacgagatatttttgg

SEQ ID NO: 15775 - DNA, 23 bp, Homo sapiens
tgcccttgggggcaggtgatggg

SEQ ID NO: 15776 - DNA, 23 bp, Homo sapiens
accagggttactcagccaacagg

SEQ ID NO: 15777 - DNA, 23 bp, Homo sapiens
ccactttcatttgccttcactgg

SEQ ID NO: 15778 - DNA, 23 bp, Homo sapiens
agattttaatcaccctcagttgg

SEQ ID NO: 15779 - DNA, 23 bp, Homo sapiens
aggcagaggctagatctcctcgg

SEQ ID NO: 15780 - DNA, 23 bp, Homo sapiens
tcagctgctctttcacccagtgg

SEQ ID NO: 15781 - DNA, 23 bp, Homo sapiens
ttgtaatttggtcaaccacacgg

SEQ ID NO: 15782 - DNA, 23 bp, Homo sapiens
ctgttgtctgaatgaagccccgg

SEQ ID NO: 15783 - DNA, 23 bp, Homo sapiens
ctagcttgaggtaaattcagtgg

SEQ ID NO: 15784 - DNA, 23 bp, Homo sapiens
tcacgtcaccacagtatgagggg

SEQ ID NO: 15785 - DNA, 23 bp, Homo sapiens
tgcaggctggagctgcctgaggg

SEQ ID NO: 15786 - DNA, 23 bp, Homo sapiens
tcaaaagtcaccaatggcgttgg

SEQ ID NO: 15787 - DNA, 23 bp, Homo sapiens
gcaccaactccaaactgacctgg

SEQ ID NO: 15788 - DNA, 23 bp, Homo sapiens
tcatcaaaaggttcattctctgg

SEQ ID NO: 15789 - DNA, 23 bp, Homo sapiens
tggctaactttcaaataggatgg

SEQ ID NO: 15790 - DNA, 23 bp, Homo sapiens
tctcaggacacaaactcaaatgg

SEQ ID NO: 15791 - DNA, 23 bp, Homo sapiens
aagacacctgggagtaggtgagg

SEQ ID NO: 15792 - DNA, 23 bp, Homo sapiens
tgaaaaacactgtcacagactgg

SEQ ID NO: 15793 - DNA, 23 bp, Homo sapiens
gtgggccgggttctaactcgagg

SEQ ID NO: 15794 - DNA, 23 bp, Homo sapiens
taagtgcatgacggaacaatagg

SEQ ID NO: 15795 - DNA, 23 bp, Homo sapiens
cctctggttgtgcttagaagtgg

SEQ ID NO: 15796 - DNA, 23 bp, Homo sapiens
agtaaacaggctgacctttgagg

SEQ ID NO: 15797 - DNA, 23 bp, Homo sapiens
aatttccccaaaattcctcctgg

SEQ ID NO: 15798 - DNA, 23 bp, Homo sapiens
cttgatgtggagcgaccatttgg

SEQ ID NO: 15799 - DNA, 23 bp, Homo sapiens
gaaggatctttcttaacagcagg

SEQ ID NO: 15800 - DNA, 23 bp, Homo sapiens
gctctaatgatggacagaaaggg

SEQ ID NO: 15801 - DNA, 23 bp, Homo sapiens
tgtctttactgttgagattctgg

SEQ ID NO: 15802 - DNA, 23 bp, Homo sapiens
tgataagttcagtgtttcactgg

SEQ ID NO: 15803 - DNA, 23 bp, Homo sapiens
aggcatcagctgctggtcacagg

SEQ ID NO: 15804 - DNA, 23 bp, Homo sapiens
cgcggggacattcagtgcgctgg

SEQ ID NO: 15805 - DNA, 23 bp, Homo sapiens
aaaatgccagatctggagtaagg

SEQ ID NO: 15806 - DNA, 23 bp, Homo sapiens
tccacctgccatggatgatttgg

SEQ ID NO: 15807 - DNA, 23 bp, Homo sapiens
atggccaacattggaataaatgg

SEQ ID NO: 15808 - DNA, 23 bp, Homo sapiens
cttgctgatttctctgcaactgg

SEQ ID NO: 15809 - DNA, 23 bp, Homo sapiens
tcgatggagatggactaggctgg

SEQ ID NO: 15810 - DNA, 23 bp, Homo sapiens
tcagcttgaaatgtcagcagagg

SEQ ID NO: 15811 - DNA, 23 bp, Homo sapiens
ccatctgctccctgtgtcatggg

SEQ ID NO: 15812 - DNA, 23 bp, Homo sapiens
tctgaaggacttgctgaaatggg

SEQ ID NO: 15813 - DNA, 23 bp, Homo sapiens
tgctgaaaggagataatttgggg

SEQ ID NO: 15814 - DNA, 23 bp, Homo sapiens
atgatgacaggaggtaacattgg

SEQ ID NO: 15815 - DNA, 23 bp, Homo sapiens
accatccacagagctctgagggg

SEQ ID NO: 15816 - DNA, 23 bp, Homo sapiens
acgttcttttagtagtactgtgg

SEQ ID NO: 15817 - DNA, 23 bp, Homo sapiens
ccatgaaaaaagtcttggagagg

SEQ ID NO: 15818 - DNA, 23 bp, Homo sapiens
tgggagacagtcatgtgaccagg

SEQ ID NO: 15819 - DNA, 23 bp, Homo sapiens
catgcacaagctgctggtgttgg

SEQ ID NO: 15820 - DNA, 23 bp, Homo sapiens
aactgaggatgttctctgaatgg

SEQ ID NO: 15821 - DNA, 23 bp, Homo sapiens
cgtcgctggagctcgattcacgg

SEQ ID NO: 15822 - DNA, 23 bp, Homo sapiens
ggagctcgattcacggtaacagg

SEQ ID NO: 15823 - DNA, 23 bp, Homo sapiens
ctaggtgtcaagtactgtgcagg

SEQ ID NO: 15824 - DNA, 23 bp, Homo sapiens
ctcctaggggaggctcagtgtgg

SEQ ID NO: 15825 - DNA, 23 bp, Homo sapiens
cccacccacctgcagagtgacgg

SEQ ID NO: 15826 - DNA, 23 bp, Homo sapiens
cgctccacagcagctcaggtcgg

SEQ ID NO: 15827 - DNA, 23 bp, Homo sapiens
gtggacagcaagccgtgaggagg

SEQ ID NO: 15828 - DNA, 23 bp, Homo sapiens
tgctgtctagtcatcctcgtcgg

SEQ ID NO: 15829 - DNA, 23 bp, Homo sapiens
ggttaggtgggagaggctaccgg

SEQ ID NO: 15830 - DNA, 23 bp, Homo sapiens
caagaaacaggagaagatgctgg

SEQ ID NO: 15831 - DNA, 23 bp, Homo sapiens
agcaggagcaacagcaacgaggg

SEQ ID NO: 15832 - DNA, 23 bp, Homo sapiens
ccctccaggagtcacagatgagg

SEQ ID NO: 15833 - DNA, 23 bp, Homo sapiens
acagttgtttctatgaccgttgg

SEQ ID NO: 15834 - DNA, 23 bp, Homo sapiens
ccctaaccaatgaagctaagtgg

SEQ ID NO: 15835 - DNA, 23 bp, Homo sapiens
gcattgctgtgttcagtagaagg

SEQ ID NO: 15836 - DNA, 23 bp, Homo sapiens
cggggaggaaggtgggcctaggg

SEQ ID NO: 15837 - DNA, 23 bp, Homo sapiens
cctgtcacgtcgggctaggaggg

SEQ ID NO: 15838 - DNA, 23 bp, Homo sapiens
tcaccacgagtgaaagctagagg

SEQ ID NO: 15839 - DNA, 23 bp, Homo sapiens
actctttaagaacatccagctgg

SEQ ID NO: 15840 - DNA, 23 bp, Homo sapiens
ctgcacgggcaacaaaggatggg

SEQ ID NO: 15841 - DNA, 23 bp, Homo sapiens
gctatgtgttgctgttgaacagg

SEQ ID NO: 15842 - DNA, 23 bp, Homo sapiens
aacttttctgctgttgcatcagg

SEQ ID NO: 15843 - DNA, 23 bp, Homo sapiens
ggccggtcgtggtgcactgcagg

SEQ ID NO: 15844 - DNA, 23 bp, Homo sapiens
caagagatccaccttcagaatgg

SEQ ID NO: 15845 - DNA, 23 bp, Homo sapiens
tcatgtcacttcagaagctgagg

SEQ ID NO: 15846 - DNA, 23 bp, Homo sapiens
ttggggtgattaaatgagtctgg

SEQ ID NO: 15847 - DNA, 23 bp, Homo sapiens
actggcgttagacttacacccgg

SEQ ID NO: 15848 - DNA, 23 bp, Homo sapiens
tattaggtgtctgtcaatcttgg

SEQ ID NO: 15849 - DNA, 23 bp, Homo sapiens
tggttggcgcttttgttggctgg

SEQ ID NO: 15850 - DNA, 23 bp, Homo sapiens
cgttcctcttggaaaaagcaagg

SEQ ID NO: 15851 - DNA, 23 bp, Homo sapiens
tcttcggaaacttctgactttgg

SEQ ID NO: 15852 - DNA, 23 bp, Homo sapiens
tgcctggtgagttcaactctggg

SEQ ID NO: 15853 - DNA, 23 bp, Homo sapiens
ttctggcatggttcaaacgaagg

SEQ ID NO: 15854 - DNA, 23 bp, Homo sapiens
tttgtaattttcagccacactgg

SEQ ID NO: 15855 - DNA, 23 bp, Homo sapiens
tgtgggagcttagatgagcctgg

SEQ ID NO: 15856 - DNA, 23 bp, Homo sapiens
caaggaatccaccaccaacttgg

SEQ ID NO: 15857 - DNA, 23 bp, Homo sapiens
acactcaacaagacctgaacagg

SEQ ID NO: 15858 - DNA, 23 bp, Homo sapiens
cttaactaggatccagcatttgg

SEQ ID NO: 15859 - DNA, 23 bp, Homo sapiens
attgcattcaatgagacacatgg

SEQ ID NO: 15860 - DNA, 23 bp, Homo sapiens
taggagaagcgcagtcattctgg

SEQ ID NO: 15861 - DNA, 23 bp, Homo sapiens
gcacactaagaacaagagggagg

SEQ ID NO: 15862 - DNA, 23 bp, Homo sapiens
ttccctcaagaggaagtgagcgg

SEQ ID NO: 15863 - DNA, 23 bp, Homo sapiens
cggagggtggcaggggtcagggg

SEQ ID NO: 15864 - DNA, 23 bp, Homo sapiens
ggagagttactgactctccacgg

SEQ ID NO: 15865 - DNA, 23 bp, Homo sapiens
ttatgccaacttcaagtaagcgg

SEQ ID NO: 15866 - DNA, 23 bp, Homo sapiens
tctcaatgccttgaatagactgg

SEQ ID NO: 15867 - DNA, 23 bp, Homo sapiens
atacgctcacaggcacacccagg

SEQ ID NO: 15868 - DNA, 23 bp, Homo sapiens
gcaagtccagctttaaatcaagg

SEQ ID NO: 15869 - DNA, 23 bp, Homo sapiens
tccatgtcaccgcactgtagagg

SEQ ID NO: 15870 - DNA, 23 bp, Homo sapiens
ggggtttctacgttgcatagtgg

SEQ ID NO: 15871 - DNA, 23 bp, Homo sapiens
accacatatggtgcaaaccctgg

SEQ ID NO: 15872 - DNA, 23 bp, Homo sapiens
gcggtagttacgttgcatagtgg

SEQ ID NO: 15873 - DNA, 23 bp, Homo sapiens
catggagtccctagtgtgactgg

SEQ ID NO: 15874 - DNA, 23 bp, Homo sapiens
catccaggcccacaagttggagg

SEQ ID NO: 15875 - DNA, 23 bp, Homo sapiens
cggacagtttgcaatagaactgg

SEQ ID NO: 15876 - DNA, 23 bp, Homo sapiens
gaattaggcgatgtaaccattgg

SEQ ID NO: 15877 - DNA, 23 bp, Homo sapiens
aacacagcagtcggtacaagtgg

SEQ ID NO: 15878 - DNA, 23 bp, Homo sapiens
tacctggaatcatcttagttggg

SEQ ID NO: 15879 - DNA, 23 bp, Homo sapiens
aatacttgaattctggctgatgg

SEQ ID NO: 15880 - DNA, 23 bp, Homo sapiens
aaggggccccagggtctcactgg

SEQ ID NO: 15881 - DNA, 23 bp, Homo sapiens
cccctgaggctgccgctcactgg

SEQ ID NO: 15882 - DNA, 23 bp, Homo sapiens
atcagtgtgtgcaactgatgtgg

SEQ ID NO: 15883 - DNA, 23 bp, Homo sapiens
aggtgatgttgagcttgaatggg

SEQ ID NO: 15884 - DNA, 23 bp, Homo sapiens
acaagtcttcaatgactcactgg

SEQ ID NO: 15885 - DNA, 23 bp, Homo sapiens
catggctttaggttgcatagtgg

SEQ ID NO: 15886 - DNA, 23 bp, Homo sapiens
ccccatcccattgagctaaaagg

SEQ ID NO: 15887 - DNA, 23 bp, Homo sapiens
gggctggagtcaagatagcgggg

SEQ ID NO: 15888 - DNA, 23 bp, Homo sapiens
ctctcagctatatttccatcagg

SEQ ID NO: 15889 - DNA, 23 bp, Homo sapiens
gatgtggtccaagatcaggtcgg

SEQ ID NO: 15890 - DNA, 23 bp, Homo sapiens
ctagtgtcacggccccagtgagg

SEQ ID NO: 15891 - DNA, 23 bp, Homo sapiens
agagattcgccacagttgacagg

SEQ ID NO: 15892 - DNA, 23 bp, Homo sapiens
tcacctaaaactttactaggtgg

SEQ ID NO: 15893 - DNA, 23 bp, Homo sapiens
gcagcagttacttgaacaatcgg

SEQ ID NO: 15894 - DNA, 23 bp, Homo sapiens
ctccagaaagttcttcctgtagg

SEQ ID NO: 15895 - DNA, 23 bp, Homo sapiens
atatctatgtcacagcaaacagg

SEQ ID NO: 15896 - DNA, 23 bp, Homo sapiens
acgggttttcttctttaaacagg

SEQ ID NO: 15897 - DNA, 23 bp, Homo sapiens
atctagaaacagagatgaacagg

SEQ ID NO: 15898 - DNA, 23 bp, Homo sapiens
ttcaagcattctgtcgaccctgg

SEQ ID NO: 15899 - DNA, 23 bp, Homo sapiens
acatactgagctcctccatgtgg

SEQ ID NO: 15900 - DNA, 23 bp, Homo sapiens
gggggccaactgcacctgcctgg

SEQ ID NO: 15901 - DNA, 23 bp, Homo sapiens
gaagcagttgattacacagaagg

SEQ ID NO: 15902 - DNA, 23 bp, Homo sapiens
ttgccctcctatgagtgagaggg

SEQ ID NO: 15903 - DNA, 23 bp, Homo sapiens
gggaccactgtcacgcagagagg

SEQ ID NO: 15904 - DNA, 23 bp, Homo sapiens
ccccctaatggtatcatctgagg

SEQ ID NO: 15905 - DNA, 23 bp, Homo sapiens
atttacagcattccatttggtgg

SEQ ID NO: 15906 - DNA, 23 bp, Homo sapiens
tgaaaaactgagcacataggtgg

SEQ ID NO: 15907 - DNA, 23 bp, Homo sapiens
actgcagggtgaggaagaagggg

SEQ ID NO: 15908 - DNA, 23 bp, Homo sapiens
gaggtggatgaggattgaaacgg

SEQ ID NO: 15909 - DNA, 23 bp, Homo sapiens
gttcaatttcactctagtcgagg

SEQ ID NO: 15910 - DNA, 23 bp, Homo sapiens
tgatattctctctggatttgggg

SEQ ID NO: 15911 - DNA, 23 bp, Homo sapiens
ggggacggagacactgactgagg

SEQ ID NO: 15912 - DNA, 23 bp, Homo sapiens
gaaagctagtcatccagagcagg

SEQ ID NO: 15913 - DNA, 23 bp, Homo sapiens
tttggagacaccaacgaagaggg

SEQ ID NO: 15914 - DNA, 23 bp, Homo sapiens
aggtactgctcagcgaagccagg

SEQ ID NO: 15915 - DNA, 23 bp, Homo sapiens
ctatgctaccgtttgtctgaagg

SEQ ID NO: 15916 - DNA, 23 bp, Homo sapiens
tgagtgtccagggtcatccgtgg

SEQ ID NO: 15917 - DNA, 23 bp, Homo sapiens
ttagctttcagccaccagagtgg

SEQ ID NO: 15918 - DNA, 23 bp, Homo sapiens
atccacagacagagggcacaagg

SEQ ID NO: 15919 - DNA, 23 bp, Homo sapiens
ccgtagtaggtgctcaattacgg

SEQ ID NO: 15920 - DNA, 23 bp, Homo sapiens
tctctctcatcgaactcctaagg

SEQ ID NO: 15921 - DNA, 23 bp, Homo sapiens
tgatcttcattaagactccatgg

SEQ ID NO: 15922 - DNA, 23 bp, Homo sapiens
agactcagaagaagagatgctgg

SEQ ID NO: 15923 - DNA, 23 bp, Homo sapiens
gaccactgtggattcagactggg

SEQ ID NO: 15924 - DNA, 23 bp, Homo sapiens
gcagctgacccccgaagtgcggg

SEQ ID NO: 15925 - DNA, 23 bp, Homo sapiens
gggtagaggtgcagcgagactgg

SEQ ID NO: 15926 - DNA, 23 bp, Homo sapiens
aacccagtttgaaacgtaactgg

SEQ ID NO: 15927 - DNA, 23 bp, Homo sapiens
agcaggtgcgccctcatcgtcgg

SEQ ID NO: 15928 - DNA, 23 bp, Homo sapiens
ccccttcgagacagacatttggg

SEQ ID NO: 15929 - DNA, 23 bp, Homo sapiens
gagggcggaggaaaagccctagg

SEQ ID NO: 15930 - DNA, 23 bp, Homo sapiens
aacttttattagcgcttctctgg

SEQ ID NO: 15931 - DNA, 23 bp, Homo sapiens
aggaagcttcagccgatcttcgg

SEQ ID NO: 15932 - DNA, 23 bp, Homo sapiens
cttcggagcactgtgatcacagg

SEQ ID NO: 15933 - DNA, 23 bp, Homo sapiens
gagggtggagttggcgatgacgg

SEQ ID NO: 15934 - DNA, 23 bp, Homo sapiens
gtcccaccatggatctgaggagg

SEQ ID NO: 15935 - DNA, 23 bp, Homo sapiens
cagcggtcgtcacttccccaagg

SEQ ID NO: 15936 - DNA, 23 bp, Homo sapiens
cacctcagggctgcattaattgg

SEQ ID NO: 15937 - DNA, 23 bp, Homo sapiens
catctgctataaaacctgcctgg

SEQ ID NO: 15938 - DNA, 23 bp, Homo sapiens
cttcctcaagctcttctgctagg

SEQ ID NO: 15939 - DNA, 23 bp, Homo sapiens
aggtgttgctgcattttttctgg

SEQ ID NO: 15940 - DNA, 23 bp, Homo sapiens
tcacagggaaggattctaaaagg

SEQ ID NO: 15941 - DNA, 23 bp, Homo sapiens
gaggacctggagcggagctgagg

SEQ ID NO: 15942 - DNA, 23 bp, Homo sapiens
cagcctggccccagcgggcaagg

SEQ ID NO: 15943 - DNA, 23 bp, Homo sapiens
cttgacctttgctctcaggaagg

SEQ ID NO: 15944 - DNA, 23 bp, Homo sapiens
gctgcagtccatggctgaccagg

SEQ ID NO: 15945 - DNA, 23 bp, Homo sapiens
ctgggaggcaagaaggactaagg

SEQ ID NO: 15946 - DNA, 23 bp, Homo sapiens
gagctcagcagaaagtaggctgg

SEQ ID NO: 15947 - DNA, 23 bp, Homo sapiens
ggctgcagcgggctgcgtgaggg

SEQ ID NO: 15948 - DNA, 23 bp, Homo sapiens
tgaatcaaacgcatctgtctggg

SEQ ID NO: 15949 - DNA, 23 bp, Homo sapiens
aggcagggtgtgcctagtcccgg

SEQ ID NO: 15950 - DNA, 23 bp, Homo sapiens
tgcccaaaacatctggaacgtgg

SEQ ID NO: 15951 - DNA, 23 bp, Homo sapiens
gtctggtctggaggctcagatgg

SEQ ID NO: 15952 - DNA, 23 bp, Homo sapiens
acttttggtccatctgcagtggg

SEQ ID NO: 15953 - DNA, 23 bp, Homo sapiens
agctggtggctgctaacgatggg

SEQ ID NO: 15954 - DNA, 23 bp, Homo sapiens
atccagcagttccttcaccaagg

SEQ ID NO: 15955 - DNA, 23 bp, Homo sapiens
ttatttaaggaactgctggatgg

SEQ ID NO: 15956 - DNA, 23 bp, Homo sapiens
ctattccccaaaggcctcagagg

SEQ ID NO: 15957 - DNA, 23 bp, Homo sapiens
atgatgggagctgtcttaattgg

SEQ ID NO: 15958 - DNA, 23 bp, Homo sapiens
ttcagggtcacatgctcttgagg

SEQ ID NO: 15959 - DNA, 23 bp, Homo sapiens
gagggcccagacctgtggtgagg

SEQ ID NO: 15960 - DNA, 23 bp, Homo sapiens
acagagcatggaaatgtttgagg

SEQ ID NO: 15961 - DNA, 23 bp, Homo sapiens
gacccaggaaaggtgtgagctgg

SEQ ID NO: 15962 - DNA, 23 bp, Homo sapiens
actcaccccagcatatttttagg

SEQ ID NO: 15963 - DNA, 23 bp, Homo sapiens
agagaatgttgttaaccccatgg

SEQ ID NO: 15964 - DNA, 23 bp, Homo sapiens
gaaggtcataggttagttgccgg

SEQ ID NO: 15965 - DNA, 23 bp, Homo sapiens
tccttcatccagcaagtcaatgg

SEQ ID NO: 15966 - DNA, 23 bp, Homo sapiens
ttgaattcttagcctttcgttgg

SEQ ID NO: 15967 - DNA, 23 bp, Homo sapiens
aatcctacaagtctttgtgttgg

SEQ ID NO: 15968 - DNA, 23 bp, Homo sapiens
gccaagcacgctagagccccagg

SEQ ID NO: 15969 - DNA, 23 bp, Homo sapiens
ctcttccggtttaggactagtgg

SEQ ID NO: 15970 - DNA, 23 bp, Homo sapiens
tcagcttccgcttcggtcggcgg

SEQ ID NO: 15971 - DNA, 23 bp, Homo sapiens
agaattctcctttagacagtggg

SEQ ID NO: 15972 - DNA, 23 bp, Homo sapiens
tcagtgcatagtgcttgcattgg

SEQ ID NO: 15973 - DNA, 23 bp, Homo sapiens
cagagcgcccagatttcggctgg

SEQ ID NO: 15974 - DNA, 23 bp, Homo sapiens
agcttcttacagtagccaaatgg

SEQ ID NO: 15975 - DNA, 23 bp, Homo sapiens
aaatgaagatttaggacaggagg

SEQ ID NO: 15976 - DNA, 23 bp, Homo sapiens
accccacatgtgccggctgaggg

SEQ ID NO: 15977 - DNA, 23 bp, Homo sapiens
ccccaggtggttcaggctgcagg

SEQ ID NO: 15978 - DNA, 23 bp, Homo sapiens
gcagcacccgggcactcacacgg

SEQ ID NO: 15979 - DNA, 23 bp, Homo sapiens
ggaatcacactgggctgacctgg

SEQ ID NO: 15980 - DNA, 23 bp, Homo sapiens
gatctcaagatgcttgcctgtgg

SEQ ID NO: 15981 - DNA, 23 bp, Homo sapiens
tgggtctccaggcctcagggcgg

SEQ ID NO: 15982 - DNA, 23 bp, Homo sapiens
gtgatgttcaaactgtagactgg

SEQ ID NO: 15983 - DNA, 23 bp, Homo sapiens
tgcattctgtgcagctgaaatgg

SEQ ID NO: 15984 - DNA, 23 bp, Homo sapiens
ctttcccctcctccatttattgg

SEQ ID NO: 15985 - DNA, 23 bp, Homo sapiens
acctggagcagcacagctgatgg

SEQ ID NO: 15986 - DNA, 23 bp, Homo sapiens
tgaaatccaacaagttcacgtgg

SEQ ID NO: 15987 - DNA, 23 bp, Homo sapiens
gtggaggaggcgtgacaggctgg

SEQ ID NO: 15988 - DNA, 23 bp, Homo sapiens
cagtgctgtcagaacatctaagg

SEQ ID NO: 15989 - DNA, 23 bp, Homo sapiens
aaagctcttgcttcatctgtagg

SEQ ID NO: 15990 - DNA, 23 bp, Homo sapiens
ggtggaggcgcaggggtcacagg

SEQ ID NO: 15991 - DNA, 23 bp, Homo sapiens
actcaggttggcaaaaaagcagg

SEQ ID NO: 15992 - DNA, 23 bp, Homo sapiens
tatgaaccatccaggaaagctgg

SEQ ID NO: 15993 - DNA, 23 bp, Homo sapiens
ccatcctggaggtcaagtagagg

SEQ ID NO: 15994 - DNA, 23 bp, Homo sapiens
atcctcgagatcaaacactaagg

SEQ ID NO: 15995 - DNA, 23 bp, Homo sapiens
gtagggtgaggaaggctatttgg

SEQ ID NO: 15996 - DNA, 23 bp, Homo sapiens
aagtaggaaatcaacagcatcgg

SEQ ID NO: 15997 - DNA, 23 bp, Homo sapiens
aacaagtgctccctgggctgagg

SEQ ID NO: 15998 - DNA, 23 bp, Homo sapiens
caaccccagagagaaggctgtgg

SEQ ID NO: 15999 - DNA, 23 bp, Homo sapiens
acacaggactcagcaccagcagg

SEQ ID NO: 16000 - DNA, 23 bp, Homo sapiens
tttaatgttgaggttggtgcagg

SEQ ID NO: 16001 - DNA, 23 bp, Homo sapiens
ccaggagtggctgcacctagtgg

SEQ ID NO: 16002 - DNA, 23 bp, Homo sapiens
cacagagcaataaccaccacagg

SEQ ID NO: 16003 - DNA, 23 bp, Homo sapiens
tgctctgtgttataaactctggg

SEQ ID NO: 16004 - DNA, 23 bp, Homo sapiens
aaacatcttagcaagtgcagtgg

SEQ ID NO: 16005 - DNA, 23 bp, Homo sapiens
ccagtcaagcagtcaggtggagg

SEQ ID NO: 16006 - DNA, 23 bp, Homo sapiens
ggcggtggctgttgctaggaggg

SEQ ID NO: 16007 - DNA, 23 bp, Homo sapiens
tcaggcacaacacccagatctgg

SEQ ID NO: 16008 - DNA, 23 bp, Homo sapiens
ggtggagggtgctgttcttctgg

SEQ ID NO: 16009 - DNA, 23 bp, Homo sapiens
ggtcagcagcagctccgctttgg

SEQ ID NO: 16010 - DNA, 23 bp, Homo sapiens
ggtatgctacagctgctaaaagg

SEQ ID NO: 16011 - DNA, 23 bp, Homo sapiens
atgacaacagctgtagaagtagg

SEQ ID NO: 16012 - DNA, 23 bp, Homo sapiens
gtggtgctggccaaggtcagagg

SEQ ID NO: 16013 - DNA, 23 bp, Homo sapiens
ctgagctcagccaggttcaaggg

SEQ ID NO: 16014 - DNA, 23 bp, Homo sapiens
gaaaaggagaaaggggcatgtgg

SEQ ID NO: 16015 - DNA, 23 bp, Homo sapiens
tagcagatacatttcttctctgg

SEQ ID NO: 16016 - DNA, 23 bp, Homo sapiens
acagattctactctgagtagagg

SEQ ID NO: 16017 - DNA, 23 bp, Homo sapiens
actgcacacatagagcttctagg

SEQ ID NO: 16018 - DNA, 23 bp, Homo sapiens
agcagaaatagaacagtcacagg

SEQ ID NO: 16019 - DNA, 23 bp, Homo sapiens
agccaaacactactagcagcagg

SEQ ID NO: 16020 - DNA, 23 bp, Homo sapiens
ggaggacagcaggctgggggcgg

SEQ ID NO: 16021 - DNA, 23 bp, Homo sapiens
tgttcagcagcagccagagttgg

SEQ ID NO: 16022 - DNA, 23 bp, Homo sapiens
cctcacccttacctggagaaggg

SEQ ID NO: 16023 - DNA, 23 bp, Homo sapiens
ggcccttgggtcaacagcaccgg

SEQ ID NO: 16024 - DNA, 23 bp, Homo sapiens
aagccatatatcagcaacactgg

SEQ ID NO: 16025 - DNA, 23 bp, Homo sapiens
cgtttggtttcaacaaggacagg

SEQ ID NO: 16026 - DNA, 23 bp, Homo sapiens
caaagcctgcaatgacgtgctgg

SEQ ID NO: 16027 - DNA, 23 bp, Homo sapiens
aatgtccaggggtcaagctctgg

SEQ ID NO: 16028 - DNA, 23 bp, Homo sapiens
acagtctcctcagccctcatggg

SEQ ID NO: 16029 - DNA, 23 bp, Homo sapiens
gctggcaggggggctatgggagg

SEQ ID NO: 16030 - DNA, 23 bp, Homo sapiens
agcctgggctgctgctaactggg

SEQ ID NO: 16031 - DNA, 23 bp, Homo sapiens
ctccctgcacacacacggacagg

SEQ ID NO: 16032 - DNA, 23 bp, Homo sapiens
gccccctgggattcacatgaagg

SEQ ID NO: 16033 - DNA, 23 bp, Homo sapiens
tggctgtgccaaatcctagtagg

SEQ ID NO: 16034 - DNA, 23 bp, Homo sapiens
tcagcagaagcattctttcctgg

SEQ ID NO: 16035 - DNA, 23 bp, Homo sapiens
aagaggttgtcaaatcagagagg

SEQ ID NO: 16036 - DNA, 23 bp, Homo sapiens
ggagtgggatggctctcagcagg

SEQ ID NO: 16037 - DNA, 23 bp, Homo sapiens
gcagcagaactgctcatgctagg

SEQ ID NO: 16038 - DNA, 23 bp, Homo sapiens
gtgtgcacggggacactagcagg

SEQ ID NO: 16039 - DNA, 23 bp, Homo sapiens
tctctagcagctgcagctgctgg

SEQ ID NO: 16040 - DNA, 23 bp, Homo sapiens
atgctagaagaatcagaagaagg

SEQ ID NO: 16041 - DNA, 23 bp, Homo sapiens
cttacacctcattgaagctgtgg

SEQ ID NO: 16042 - DNA, 23 bp, Homo sapiens
ttcttcccccaggaggcttaggg

SEQ ID NO: 16043 - DNA, 23 bp, Homo sapiens
aaagctgggttatttcaaagagg

SEQ ID NO: 16044 - DNA, 23 bp, Homo sapiens
tacattcgatacattcagcaggg

SEQ ID NO: 16045 - DNA, 23 bp, Homo sapiens
agaaattttgcagctgtttctgg

SEQ ID NO: 16046 - DNA, 23 bp, Homo sapiens
aactgcaagatctcctagcgggg

SEQ ID NO: 16047 - DNA, 23 bp, Homo sapiens
ctggaatccttcgaggagtcagg

SEQ ID NO: 16048 - DNA, 23 bp, Homo sapiens
ttctctcctagagtcaacactgg

SEQ ID NO: 16049 - DNA, 23 bp, Homo sapiens
gtcacggcccacagctaggtggg

SEQ ID NO: 16050 - DNA, 23 bp, Homo sapiens
tggggctgcgggtgctgaccagg

SEQ ID NO: 16051 - DNA, 23 bp, Homo sapiens
aagaggccgcccaagagattcgg

SEQ ID NO: 16052 - DNA, 23 bp, Homo sapiens
cgctcaggagtgtggttgttagg

SEQ ID NO: 16053 - DNA, 23 bp, Homo sapiens
cacagagctcagcagccacacgg

SEQ ID NO: 16054 - DNA, 23 bp, Homo sapiens
gttactacaacactgattcctgg

SEQ ID NO: 16055 - DNA, 23 bp, Homo sapiens
cagtgttgtagcaactgaggggg

SEQ ID NO: 16056 - DNA, 23 bp, Homo sapiens
gggctcagttgctgcagcactgg

SEQ ID NO: 16057 - DNA, 23 bp, Homo sapiens
agatgacatgggagattagcagg

SEQ ID NO: 16058 - DNA, 23 bp, Homo sapiens
caggtcggctctgcattagcagg

SEQ ID NO: 16059 - DNA, 23 bp, Homo sapiens
cattgctgcctgtctcgtggagg

SEQ ID NO: 16060 - DNA, 23 bp, Homo sapiens
ttctgatatggagttggcattgg

SEQ ID NO: 16061 - DNA, 23 bp, Homo sapiens
agcagcatctgctccttgactgg

SEQ ID NO: 16062 - DNA, 23 bp, Homo sapiens
ttccgatgtgttcttctgtgagg

SEQ ID NO: 16063 - DNA, 23 bp, Homo sapiens
tagcgagcaacgaaagaaactgg

SEQ ID NO: 16064 - DNA, 23 bp, Homo sapiens
aatcaacagcaagatgagctagg

SEQ ID NO: 16065 - DNA, 23 bp, Homo sapiens
acagcacgaagaccctgctttgg

SEQ ID NO: 16066 - DNA, 23 bp, Homo sapiens
gtcccagaagacacctcacacgg

SEQ ID NO: 16067 - DNA, 23 bp, Homo sapiens
atgcaatatggtatcctggatgg

SEQ ID NO: 16068 - DNA, 23 bp, Homo sapiens
ccatgagggtgtcatgtctcagg

SEQ ID NO: 16069 - DNA, 23 bp, Homo sapiens
ggacatcaaggacacctgagggg

SEQ ID NO: 16070 - DNA, 23 bp, Homo sapiens
cgattgtattgtgactgtagtgg

SEQ ID NO: 16071 - DNA, 23 bp, Homo sapiens
agacagcaaccggggttcaaggg

SEQ ID NO: 16072 - DNA, 23 bp, Homo sapiens
ctggaactatgtgctctccttgg

SEQ ID NO: 16073 - DNA, 23 bp, Homo sapiens
gctgcaacaggaagacccaatgg

SEQ ID NO: 16074 - DNA, 23 bp, Homo sapiens
ctgcaacctcaagtttatgcagg

SEQ ID NO: 16075 - DNA, 23 bp, Homo sapiens
tagcagcgtcctcacctaagagg

SEQ ID NO: 16076 - DNA, 23 bp, Homo sapiens
tgaatctagctcactagctcagg

SEQ ID NO: 16077 - DNA, 23 bp, Homo sapiens
cccctcccctcagttactcatgg

SEQ ID NO: 16078 - DNA, 23 bp, Homo sapiens
ggcctctccccacagctgagggg

SEQ ID NO: 16079 - DNA, 23 bp, Homo sapiens
catcgagaccccatcagaggagg

SEQ ID NO: 16080 - DNA, 23 bp, Homo sapiens
gatcggaaaagatttggggcagg

SEQ ID NO: 16081 - DNA, 23 bp, Homo sapiens
gactacgaggagctctaggccgg

SEQ ID NO: 16082 - DNA, 23 bp, Homo sapiens
tcagctgctccattccctaatgg

SEQ ID NO: 16083 - DNA, 23 bp, Homo sapiens
gctgagacatttacaacagcagg

SEQ ID NO: 16084 - DNA, 23 bp, Homo sapiens
gcgcctgcagcctcctctagggg

SEQ ID NO: 16085 - DNA, 23 bp, Homo sapiens
tgggccagggctctagaagacgg

SEQ ID NO: 16086 - DNA, 23 bp, Homo sapiens
cctgaagacagtgtttgacgagg

SEQ ID NO: 16087 - DNA, 23 bp, Homo sapiens
atgtgacttcacttgagcattgg

SEQ ID NO: 16088 - DNA, 23 bp, Homo sapiens
aaacttctagcgtgtgccaatgg

SEQ ID NO: 16089 - DNA, 23 bp, Homo sapiens
catactcaagactcagattcagg

SEQ ID NO: 16090 - DNA, 23 bp, Homo sapiens
tagaagactacgagagtgatggg

SEQ ID NO: 16091 - DNA, 23 bp, Homo sapiens
aaccaagaaacaagcgtaatagg

SEQ ID NO: 16092 - DNA, 23 bp, Homo sapiens
tcatcgcaacacctggaccaagg

SEQ ID NO: 16093 - DNA, 23 bp, Homo sapiens
tgcagatattatagctacgatgg

SEQ ID NO: 16094 - DNA, 23 bp, Homo sapiens
cgtcatcaaagttctgactcagg

SEQ ID NO: 16095 - DNA, 23 bp, Homo sapiens
gcttgtatcacaagtccttcagg

SEQ ID NO: 16096 - DNA, 23 bp, Homo sapiens
aaatgcagtgttagctccctggg

SEQ ID NO: 16097 - DNA, 23 bp, Homo sapiens
aaacccaatgattcagtctttgg

SEQ ID NO: 16098 - DNA, 23 bp, Homo sapiens
agcttcagcttcaggaagacagg

SEQ ID NO: 16099 - DNA, 23 bp, Homo sapiens
gtaccacactcaggtgctagtgg

SEQ ID NO: 16100 - DNA, 23 bp, Homo sapiens
ttggtttgtcaagaaaagcaagg

SEQ ID NO: 16101 - DNA, 23 bp, Homo sapiens
atctgtagtcctagctgctcagg

SEQ ID NO: 16102 - DNA, 23 bp, Homo sapiens
aaaactaggctgggttacactgg

SEQ ID NO: 16103 - DNA, 23 bp, Homo sapiens
agtatccctatggcttctcttgg

SEQ ID NO: 16104 - DNA, 23 bp, Homo sapiens
caccatcaaggaggaaggcctgg

SEQ ID NO: 16105 - DNA, 23 bp, Homo sapiens
ctgtctctaggaatttccatagg

SEQ ID NO: 16106 - DNA, 23 bp, Homo sapiens
gaggaaggcctggttcttcaagg

SEQ ID NO: 16107 - DNA, 23 bp, Homo sapiens
ggccttgtccaatcagtcaaagg

SEQ ID NO: 16108 - DNA, 23 bp, Homo sapiens
tggaatcagaacagagactttgg

SEQ ID NO: 16109 - DNA, 23 bp, Homo sapiens
aattgtgtttttccaacacctgg

SEQ ID NO: 16110 - DNA, 23 bp, Homo sapiens
ctgggttataattcttcctctgg

SEQ ID NO: 16111 - DNA, 23 bp, Homo sapiens
gagcagagtgccacattacaggg

SEQ ID NO: 16112 - DNA, 23 bp, Homo sapiens
ccctcactcttctcagctgacgg

SEQ ID NO: 16113 - DNA, 23 bp, Homo sapiens
ggcctgagcctcagttaagatgg

SEQ ID NO: 16114 - DNA, 23 bp, Homo sapiens
tgcacttggaaactgtattctgg

SEQ ID NO: 16115 - DNA, 23 bp, Homo sapiens
aatataaccactcaagctactgg

SEQ ID NO: 16116 - DNA, 23 bp, Homo sapiens
ccagaccagctggttatcagcgg

SEQ ID NO: 16117 - DNA, 23 bp, Homo sapiens
gaggtcactgggaaatagctagg

SEQ ID NO: 16118 - DNA, 23 bp, Homo sapiens
gcggaagacagtgagggtgaagg

SEQ ID NO: 16119 - DNA, 23 bp, Homo sapiens
gagtttggagtggaataaggtgg

SEQ ID NO: 16120 - DNA, 23 bp, Homo sapiens
agtgaagaggacatgaataatgg

SEQ ID NO: 16121 - DNA, 23 bp, Homo sapiens
tgctgcaggaaagaatttaatgg

SEQ ID NO: 16122 - DNA, 23 bp, Homo sapiens
cgcacgccccctctctagggggg

SEQ ID NO: 16123 - DNA, 23 bp, Homo sapiens
agcccaggaataagaagtagtgg

SEQ ID NO: 16124 - DNA, 23 bp, Homo sapiens
cccttgaggacgtcttagtctgg

SEQ ID NO: 16125 - DNA, 23 bp, Homo sapiens
gaaccgacaggtaactgagctgg

SEQ ID NO: 16126 - DNA, 23 bp, Homo sapiens
gccgtggtatcacctctaggtgg

SEQ ID NO: 16127 - DNA, 23 bp, Homo sapiens
tacaggtctccatatcttgatgg

SEQ ID NO: 16128 - DNA, 23 bp, Homo sapiens
ctcccctgcttcatcctccctgg

SEQ ID NO: 16129 - DNA, 23 bp, Homo sapiens
tgcaaagtcaactagaagacagg

SEQ ID NO: 16130 - DNA, 23 bp, Homo sapiens
tctggaaagccaagattcaatgg

SEQ ID NO: 16131 - DNA, 23 bp, Homo sapiens
ctaagaaaggatttcttggcagg

SEQ ID NO: 16132 - DNA, 23 bp, Homo sapiens
tacccgtgtgccagcgatgcagg

SEQ ID NO: 16133 - DNA, 23 bp, Homo sapiens
ttgagactggtttttacacatgg

SEQ ID NO: 16134 - DNA, 23 bp, Homo sapiens
cccaatcaaaaaacaacggctgg

SEQ ID NO: 16135 - DNA, 23 bp, Homo sapiens
gcatctttctctgattctcttgg

SEQ ID NO: 16136 - DNA, 23 bp, Homo sapiens
gacccgggccaacgtggacaagg

SEQ ID NO: 16137 - DNA, 23 bp, Homo sapiens
ggccacgcaggctgctcagatgg

SEQ ID NO: 16138 - DNA, 23 bp, Homo sapiens
ggctcagccaataaatcctaagg

SEQ ID NO: 16139 - DNA, 23 bp, Homo sapiens
atttaatgatcggcatcagatgg

SEQ ID NO: 16140 - DNA, 23 bp, Homo sapiens
cagctactccctcagcggaacgg

SEQ ID NO: 16141 - DNA, 23 bp, Homo sapiens
acttcacttttccaggaggttgg

SEQ ID NO: 16142 - DNA, 23 bp, Homo sapiens
ttgccaagggcatcttctgaggg

SEQ ID NO: 16143 - DNA, 23 bp, Homo sapiens
ggtgcccaggcttcaggcacagg

SEQ ID NO: 16144 - DNA, 23 bp, Homo sapiens
tcaaatgacataaggtttgcagg

SEQ ID NO: 16145 - DNA, 23 bp, Homo sapiens
tgctggtttctggtctcacatgg

SEQ ID NO: 16146 - DNA, 23 bp, Homo sapiens
ctgccaaagtaacaaacaacagg

SEQ ID NO: 16147 - DNA, 23 bp, Homo sapiens
ggacacagacgcggatgatgggg

SEQ ID NO: 16148 - DNA, 23 bp, Homo sapiens
gaggacttcgatgaagatggggg

SEQ ID NO: 16149 - DNA, 23 bp, Homo sapiens
actgagggcattgtgtaggcggg

SEQ ID NO: 16150 - DNA, 23 bp, Homo sapiens
cagtgaggcccaggcctaggggg

SEQ ID NO: 16151 - DNA, 23 bp, Homo sapiens
gcaccgacacgctgctgtgaggg

SEQ ID NO: 16152 - DNA, 23 bp, Homo sapiens
ggctccagcttcattctcacagg

SEQ ID NO: 16153 - DNA, 23 bp, Homo sapiens
ggagaccaaggaggatgctgagg

SEQ ID NO: 16154 - DNA, 23 bp, Homo sapiens
gtgcaagtagtcatcaactctgg

SEQ ID NO: 16155 - DNA, 23 bp, Homo sapiens
ctcatcatgtcgagactgcatgg

SEQ ID NO: 16156 - DNA, 23 bp, Homo sapiens
tcttcgacaaacagaccctttgg

SEQ ID NO: 16157 - DNA, 23 bp, Homo sapiens
agacgaccgggagcacatagcgg

SEQ ID NO: 16158 - DNA, 23 bp, Homo sapiens
agtaggtagtattcatgaacagg

SEQ ID NO: 16159 - DNA, 23 bp, Homo sapiens
cgaaagctgtgatgagaatgagg

SEQ ID NO: 16160 - DNA, 23 bp, Homo sapiens
tcaaagtcacttcgaagccatgg

SEQ ID NO: 16161 - DNA, 23 bp, Homo sapiens
tgaacagcaggaagccttacagg

SEQ ID NO: 16162 - DNA, 23 bp, Homo sapiens
atgtaggtagtcttccactgtgg

SEQ ID NO: 16163 - DNA, 23 bp, Homo sapiens
tctgctgcagacgctgtacaagg

SEQ ID NO: 16164 - DNA, 23 bp, Homo sapiens
aggtaagcaagagatcagtctgg

SEQ ID NO: 16165 - DNA, 23 bp, Homo sapiens
cagtgcttcagcgcctttactgg

SEQ ID NO: 16166 - DNA, 23 bp, Homo sapiens
tggcaagcagcagatagctaagg

SEQ ID NO: 16167 - DNA, 23 bp, Homo sapiens
ttcaatcagcccccgtaaggagg

SEQ ID NO: 16168 - DNA, 23 bp, Homo sapiens
gaaatcatgtctgctgctctagg

SEQ ID NO: 16169 - DNA, 23 bp, Homo sapiens
gactttttgcgagccttcccagg

SEQ ID NO: 16170 - DNA, 23 bp, Homo sapiens
tgagcagcacatgccccagctgg

SEQ ID NO: 16171 - DNA, 23 bp, Homo sapiens
cagccatgccagctctggtgcgg

SEQ ID NO: 16172 - DNA, 23 bp, Homo sapiens
cacagagcagagacttactgtgg

SEQ ID NO: 16173 - DNA, 23 bp, Homo sapiens
atgttacatgcagaacagcatgg

SEQ ID NO: 16174 - DNA, 23 bp, Homo sapiens
gcctgcgtgatcctctgaggcgg

SEQ ID NO: 16175 - DNA, 23 bp, Homo sapiens
caacactgatcttgcttctccgg

SEQ ID NO: 16176 - DNA, 23 bp, Homo sapiens
agaccgggaagagaagacctagg

SEQ ID NO: 16177 - DNA, 23 bp, Homo sapiens
gaacaagtttctgctgtttgagg

SEQ ID NO: 16178 - DNA, 23 bp, Homo sapiens
cgagagctggagccatgaggagg

SEQ ID NO: 16179 - DNA, 23 bp, Homo sapiens
tgaaatgtctatggtcgacgagg

SEQ ID NO: 16180 - DNA, 23 bp, Homo sapiens
ggcagtggggctcacacccgagg

SEQ ID NO: 16181 - DNA, 23 bp, Homo sapiens
cgcgattcaagtctaaaaggagg

SEQ ID NO: 16182 - DNA, 23 bp, Homo sapiens
gctaatttggagaactgatctgg

SEQ ID NO: 16183 - DNA, 23 bp, Homo sapiens
tcagtcacatctcctagtttagg

SEQ ID NO: 16184 - DNA, 23 bp, Homo sapiens
tgtcacttcaagtacagaaaagg

SEQ ID NO: 16185 - DNA, 23 bp, Homo sapiens
cgagctctcctacaagctggagg

SEQ ID NO: 16186 - DNA, 23 bp, Homo sapiens
ctggaaacgaggcactcagttgg

SEQ ID NO: 16187 - DNA, 23 bp, Homo sapiens
ctatggtggctaccagtctctgg

SEQ ID NO: 16188 - DNA, 23 bp, Homo sapiens
gccaagacagggtcaagttaagg

SEQ ID NO: 16189 - DNA, 23 bp, Homo sapiens
gccaggagtcatacaaagccagg

SEQ ID NO: 16190 - DNA, 23 bp, Homo sapiens
catgtggcgtgggcggtcacggg

SEQ ID NO: 16191 - DNA, 23 bp, Homo sapiens
aaaatgtcttattgcacgagtgg

SEQ ID NO: 16192 - DNA, 23 bp, Homo sapiens
cctgggggccagggcaaaggggg

SEQ ID NO: 16193 - DNA, 23 bp, Homo sapiens
gaagcctccggaactgaagaagg

SEQ ID NO: 16194 - DNA, 23 bp, Homo sapiens
gctcactagtgtgaggcagtggg

SEQ ID NO: 16195 - DNA, 23 bp, Homo sapiens
tgctggcttagctgcggggcagg

SEQ ID NO: 16196 - DNA, 23 bp, Homo sapiens
ttcaggctgtcgcttttttttgg

SEQ ID NO: 16197 - DNA, 23 bp, Homo sapiens
tgggaataaaacctgtccaaagg

SEQ ID NO: 16198 - DNA, 23 bp, Homo sapiens
gccaatggaatgaaacttcttgg

SEQ ID NO: 16199 - DNA, 23 bp, Homo sapiens
ttggaataacacctgtatgtagg

SEQ ID NO: 16200 - DNA, 23 bp, Homo sapiens
aggctgctacctgacatcattgg

SEQ ID NO: 16201 - DNA, 23 bp, Homo sapiens
taagatgctttcccaacaattgg

SEQ ID NO: 16202 - DNA, 23 bp, Homo sapiens
cgcgtcccgcagactttaaatgg

SEQ ID NO: 16203 - DNA, 23 bp, Homo sapiens
ctcctggagctgcagacgtgagg

SEQ ID NO: 16204 - DNA, 23 bp, Homo sapiens
tagctctggcatttccttagggg

SEQ ID NO: 16205 - DNA, 23 bp, Homo sapiens
caaaaacagcagctgctgacggg

SEQ ID NO: 16206 - DNA, 23 bp, Homo sapiens
gggccctgattctcactcgtagg

SEQ ID NO: 16207 - DNA, 23 bp, Homo sapiens
ggcaggatgggcagctcaggtgg

SEQ ID NO: 16208 - DNA, 23 bp, Homo sapiens
ctggtcatctgcggcaacaaggg

SEQ ID NO: 16209 - DNA, 23 bp, Homo sapiens
ggagcgctgcgtcatcagctagg

SEQ ID NO: 16210 - DNA, 23 bp, Homo sapiens
ccccagcatccctcgctcactgg

SEQ ID NO: 16211 - DNA, 23 bp, Homo sapiens
ttgcaacaattcttcatctgtgg

SEQ ID NO: 16212 - DNA, 23 bp, Homo sapiens
cttctgaacagagcctgaggcgg

SEQ ID NO: 16213 - DNA, 23 bp, Homo sapiens
tgtgttaaactctgcctaagagg

SEQ ID NO: 16214 - DNA, 23 bp, Homo sapiens
tctttttctgtttggttctctgg

SEQ ID NO: 16215 - DNA, 23 bp, Homo sapiens
gggctgggctcagcttcaggtgg

SEQ ID NO: 16216 - DNA, 23 bp, Homo sapiens
gcaaggccagatcttcaagcagg

SEQ ID NO: 16217 - DNA, 23 bp, Homo sapiens
ggagccaaagatctgctccatgg

SEQ ID NO: 16218 - DNA, 23 bp, Homo sapiens
gtcttagctcaaatggagcaggg

SEQ ID NO: 16219 - DNA, 23 bp, Homo sapiens
ggtacagacggtggaggatgggg

SEQ ID NO: 16220 - DNA, 23 bp, Homo sapiens
agagaccagacaggatggtgagg

SEQ ID NO: 16221 - DNA, 23 bp, Homo sapiens
agatgtctaggaatccagcttgg

SEQ ID NO: 16222 - DNA, 23 bp, Homo sapiens
tattggttctcaaggagacgtgg

SEQ ID NO: 16223 - DNA, 23 bp, Homo sapiens
ctgtccgatcgggtcacatgagg

SEQ ID NO: 16224 - DNA, 23 bp, Homo sapiens
ggcgcgcaggcgtcacatgatgg

SEQ ID NO: 16225 - DNA, 23 bp, Homo sapiens
tcaaagccccctctgcactgggg

SEQ ID NO: 16226 - DNA, 23 bp, Homo sapiens
agtgctcctcctgcttcagacgg

SEQ ID NO: 16227 - DNA, 23 bp, Homo sapiens
aagggcttcaagatcttctgagg

SEQ ID NO: 16228 - DNA, 23 bp, Homo sapiens
ggggtacaagaggtcacccaagg

SEQ ID NO: 16229 - DNA, 23 bp, Homo sapiens
tgtgcgaatcccttgtgtagggg

SEQ ID NO: 16230 - DNA, 23 bp, Homo sapiens
ctcatggctcagattgttgctgg

SEQ ID NO: 16231 - DNA, 23 bp, Homo sapiens
gtgtggaagcctgattaaagcgg

SEQ ID NO: 16232 - DNA, 23 bp, Homo sapiens
gctggtggaggccaagtaactgg

SEQ ID NO: 16233 - DNA, 23 bp, Homo sapiens
ccagggcaaacctgggtaaccgg

SEQ ID NO: 16234 - DNA, 23 bp, Homo sapiens
gaagttctgaagttcagggatgg

SEQ ID NO: 16235 - DNA, 23 bp, Homo sapiens
cttctgcatctttatccatgagg

SEQ ID NO: 16236 - DNA, 23 bp, Homo sapiens
cactaggctgtcacagagcctgg

SEQ ID NO: 16237 - DNA, 23 bp, Homo sapiens
ctccaggagttctgcgtcatggg

SEQ ID NO: 16238 - DNA, 23 bp, Homo sapiens
tgtgggttgggaagtcagcttgg

SEQ ID NO: 16239 - DNA, 23 bp, Homo sapiens
tcacatgcagacattgaaagggg

SEQ ID NO: 16240 - DNA, 23 bp, Homo sapiens
tgtcatacatatatgccttcagg

SEQ ID NO: 16241 - DNA, 23 bp, Homo sapiens
cgaaacaacagtaggagatgtgg

SEQ ID NO: 16242 - DNA, 23 bp, Homo sapiens
gcggaagaggattttctaagtgg

SEQ ID NO: 16243 - DNA, 23 bp, Homo sapiens
gggcacaggagcatattacatgg

SEQ ID NO: 16244 - DNA, 23 bp, Homo sapiens
acgttccccagtgcccctagagg

SEQ ID NO: 16245 - DNA, 23 bp, Homo sapiens
taaaaacgtttgtggagatgggg

SEQ ID NO: 16246 - DNA, 23 bp, Homo sapiens
tcaaacaaggaagagaaatgagg

SEQ ID NO: 16247 - DNA, 23 bp, Homo sapiens
acagagtgaaagccgtatcatgg

SEQ ID NO: 16248 - DNA, 23 bp, Homo sapiens
aattctctgatggctattgaagg

SEQ ID NO: 16249 - DNA, 23 bp, Homo sapiens
ccttcctgggtgttagcatccgg

SEQ ID NO: 16250 - DNA, 23 bp, Homo sapiens
gcgtggatccagaaggacaaggg

SEQ ID NO: 16251 - DNA, 23 bp, Homo sapiens
gaactcagccagcccttgacagg

SEQ ID NO: 16252 - DNA, 23 bp, Homo sapiens
agcgaagggtaaagtgcaggcgg

SEQ ID NO: 16253 - DNA, 23 bp, Homo sapiens
aagcaagcaggccggcctaaagg

SEQ ID NO: 16254 - DNA, 23 bp, Homo sapiens
gcttttgtagttgccatcgctgg

SEQ ID NO: 16255 - DNA, 23 bp, Homo sapiens
tgcaggcactgaagtggaattgg

SEQ ID NO: 16256 - DNA, 23 bp, Homo sapiens
acatccgaactggagggacaagg

SEQ ID NO: 16257 - DNA, 23 bp, Homo sapiens
gtcttctgctccttgccttttgg

SEQ ID NO: 16258 - DNA, 23 bp, Homo sapiens
ggctggctaggtctcctcccagg

SEQ ID NO: 16259 - DNA, 23 bp, Homo sapiens
agaaatcatacagtctatgctgg

SEQ ID NO: 16260 - DNA, 23 bp, Homo sapiens
ctcctgggaaatgctacctccgg

SEQ ID NO: 16261 - DNA, 23 bp, Homo sapiens
ccccaccatctttagctcagtgg

SEQ ID NO: 16262 - DNA, 23 bp, Homo sapiens
cctggtgtggcaggggcaggtgg

SEQ ID NO: 16263 - DNA, 23 bp, Homo sapiens
cggagcaagcagggagtagatgg

SEQ ID NO: 16264 - DNA, 23 bp, Homo sapiens
acttccaggcctctgctgtcagg

SEQ ID NO: 16265 - DNA, 23 bp, Homo sapiens
caaaacggttgtatccccctcgg

SEQ ID NO: 16266 - DNA, 23 bp, Homo sapiens
ccagcccccacctacggcgttgg

SEQ ID NO: 16267 - DNA, 23 bp, Homo sapiens
gggtctcacgtcacttcagtagg

SEQ ID NO: 16268 - DNA, 23 bp, Homo sapiens
cccgcggcgacctacagcattgg

SEQ ID NO: 16269 - DNA, 23 bp, Homo sapiens
agcaatcaaaacagagtaagcgg

SEQ ID NO: 16270 - DNA, 23 bp, Homo sapiens
ccttctaaggtaaggtgaatagg

SEQ ID NO: 16271 - DNA, 23 bp, Homo sapiens
cgttttactgaaacgactacagg

SEQ ID NO: 16272 - DNA, 23 bp, Homo sapiens
atacaagagactaacctcagtgg

SEQ ID NO: 16273 - DNA, 23 bp, Homo sapiens
caagatgtagctaatgaccgtgg

SEQ ID NO: 16274 - DNA, 23 bp, Homo sapiens
ttgctcttgaagctgctcactgg

SEQ ID NO: 16275 - DNA, 23 bp, Homo sapiens
tcttagactttcggaacttttgg

SEQ ID NO: 16276 - DNA, 23 bp, Homo sapiens
gacttaaatgacaggcctatagg

SEQ ID NO: 16277 - DNA, 23 bp, Homo sapiens
ttaacttttcggggcccaactgg

SEQ ID NO: 16278 - DNA, 23 bp, Homo sapiens
ggctaccagcgccgcatgtaggg

SEQ ID NO: 16279 - DNA, 23 bp, Homo sapiens
gccaggtcactttcaagagctgg

SEQ ID NO: 16280 - DNA, 23 bp, Homo sapiens
atcgagtgtgacgtggtgaaagg

SEQ ID NO: 16281 - DNA, 23 bp, Homo sapiens
tggcgctgaccctgttatagtgg

SEQ ID NO: 16282 - DNA, 23 bp, Homo sapiens
ttgaacagcggatgaagatatgg

SEQ ID NO: 16283 - DNA, 23 bp, Homo sapiens
caagctagaagaagaacacatgg

SEQ ID NO: 16284 - DNA, 23 bp, Homo sapiens
caaattcagggtcttggatttgg

SEQ ID NO: 16285 - DNA, 23 bp, Homo sapiens
catggaaatctcgaagatgatgg

SEQ ID NO: 16286 - DNA, 23 bp, Homo sapiens
cagacccttcagctgtgagctgg

SEQ ID NO: 16287 - DNA, 23 bp, Homo sapiens
gaatcgtgccacgcttcgaaagg

SEQ ID NO: 16288 - DNA, 23 bp, Homo sapiens
gagtggtgacaaggtgctagggg

SEQ ID NO: 16289 - DNA, 23 bp, Homo sapiens
acatggtctggggggtaaagagg

SEQ ID NO: 16290 - DNA, 23 bp, Homo sapiens
gatggctggtctattgcattcgg

SEQ ID NO: 16291 - DNA, 23 bp, Homo sapiens
acatcatctaaaatgctctgggg

SEQ ID NO: 16292 - DNA, 23 bp, Homo sapiens
aggacaatgaatctcgttcttgg

SEQ ID NO: 16293 - DNA, 23 bp, Homo sapiens
atgaatatgagtctcgctcatgg

SEQ ID NO: 16294 - DNA, 23 bp, Homo sapiens
ctcttgcaaagaggagcaaatgg

SEQ ID NO: 16295 - DNA, 23 bp, Homo sapiens
ggttatgaccgctactcaggagg

SEQ ID NO: 16296 - DNA, 23 bp, Homo sapiens
ttaggactcactccacgatcagg

SEQ ID NO: 16297 - DNA, 23 bp, Homo sapiens
aagaaaggacagaagaaaagtgg

SEQ ID NO: 16298 - DNA, 23 bp, Homo sapiens
gcctgacaggatgcagtgagggg

SEQ ID NO: 16299 - DNA, 23 bp, Homo sapiens
aagccgcggagcctccagacggg

SEQ ID NO: 16300 - DNA, 23 bp, Homo sapiens
tggttccaagtagacgatgaagg

SEQ ID NO: 16301 - DNA, 23 bp, Homo sapiens
agcagtatgccgatcgggcgcgg

SEQ ID NO: 16302 - DNA, 23 bp, Homo sapiens
tcagcatcttctgcttttcctgg

SEQ ID NO: 16303 - DNA, 23 bp, Homo sapiens
tgtgttatcaaggcccctgatgg

SEQ ID NO: 16304 - DNA, 23 bp, Homo sapiens
ggtagcactacagaaattagtgg

SEQ ID NO: 16305 - DNA, 23 bp, Homo sapiens
tctctcatatcatgtgctacagg

SEQ ID NO: 16306 - DNA, 23 bp, Homo sapiens
aagaagctgggcctgagataggg

SEQ ID NO: 16307 - DNA, 23 bp, Homo sapiens
tcatgaccccttttttaaacagg

SEQ ID NO: 16308 - DNA, 23 bp, Homo sapiens
gaaaaactctgcttccagttagg

SEQ ID NO: 16309 - DNA, 23 bp, Homo sapiens
ggtgagacttaaagttatgctgg

SEQ ID NO: 16310 - DNA, 23 bp, Homo sapiens
aagctcaagcaacatcagaaagg

SEQ ID NO: 16311 - DNA, 23 bp, Homo sapiens
tcagaagaaggaggcctgattgg

SEQ ID NO: 16312 - DNA, 23 bp, Homo sapiens
tggacctgtgtagaagaatttgg

SEQ ID NO: 16313 - DNA, 23 bp, Homo sapiens
gacgtctaccagacatactgagg

SEQ ID NO: 16314 - DNA, 23 bp, Homo sapiens
tgacttgtatgtacatcttctgg

SEQ ID NO: 16315 - DNA, 23 bp, Homo sapiens
cttgacaacacagagtttcaagg

SEQ ID NO: 16316 - DNA, 23 bp, Homo sapiens
tttttaaaaggctgagtaccggg

SEQ ID NO: 16317 - DNA, 23 bp, Homo sapiens
gtttgcccggttcactgagatgg

SEQ ID NO: 16318 - DNA, 23 bp, Homo sapiens
tgactcttcgaacagcatctcgg

SEQ ID NO: 16319 - DNA, 23 bp, Homo sapiens
acagtagtagagatggaaaatgg

SEQ ID NO: 16320 - DNA, 23 bp, Homo sapiens
agaccggagacgtcgctgacagg

SEQ ID NO: 16321 - DNA, 23 bp, Homo sapiens
ggcaagtggtcaacagcaggtgg

SEQ ID NO: 16322 - DNA, 23 bp, Homo sapiens
cccactgttacttgttgaactgg

SEQ ID NO: 16323 - DNA, 23 bp, Homo sapiens
gactgttggtaagaatatgcagg

SEQ ID NO: 16324 - DNA, 23 bp, Homo sapiens
cccagacttacttagactgttgg

SEQ ID NO: 16325 - DNA, 23 bp, Homo sapiens
gattttgctcattatggtcgtgg

SEQ ID NO: 16326 - DNA, 23 bp, Homo sapiens
gaagtcttcagtgacgccaacgg

SEQ ID NO: 16327 - DNA, 23 bp, Homo sapiens
agccgatctgatagagggggagg

SEQ ID NO: 16328 - DNA, 23 bp, Homo sapiens
ggccggagcagatactaagcagg

SEQ ID NO: 16329 - DNA, 23 bp, Homo sapiens
ctcgtgtattactatatgcgtgg

SEQ ID NO: 16330 - DNA, 23 bp, Homo sapiens
ggggagagtcgatctgaaaaagg

SEQ ID NO: 16331 - DNA, 23 bp, Homo sapiens
gtattcaagaaggtgcagtgagg

SEQ ID NO: 16332 - DNA, 23 bp, Homo sapiens
caaaagtcagcacattcaagagg

SEQ ID NO: 16333 - DNA, 23 bp, Homo sapiens
catagatgaccgcaagtgcatgg

SEQ ID NO: 16334 - DNA, 23 bp, Homo sapiens
tgaacacttgacggcacacctgg

SEQ ID NO: 16335 - DNA, 23 bp, Homo sapiens
cctatggggcccttccctacagg

SEQ ID NO: 16336 - DNA, 23 bp, Homo sapiens
tacaggctgatcgtccacaacgg

SEQ ID NO: 16337 - DNA, 23 bp, Homo sapiens
ctacactgtgcagtttgatgtgg

SEQ ID NO: 16338 - DNA, 23 bp, Homo sapiens
cttcaggaaggtcagatagccgg

SEQ ID NO: 16339 - DNA, 23 bp, Homo sapiens
tggatgtggatcaggctctctgg

SEQ ID NO: 16340 - DNA, 23 bp, Homo sapiens
cggtagttaggataccactgtgg

SEQ ID NO: 16341 - DNA, 23 bp, Homo sapiens
actagggtagaagagcccgtcgg

SEQ ID NO: 16342 - DNA, 23 bp, Homo sapiens
ctaccgggcgcgcctaagtctgg

SEQ ID NO: 16343 - DNA, 23 bp, Homo sapiens
aacatgggagctccctctgctgg

SEQ ID NO: 16344 - DNA, 23 bp, Homo sapiens
atagtattcagcagaactgacgg

SEQ ID NO: 16345 - DNA, 23 bp, Homo sapiens
ctgatagtgccagcctggcctgg

SEQ ID NO: 16346 - DNA, 23 bp, Homo sapiens
ctgacaccacccagcaaggatgg

SEQ ID NO: 16347 - DNA, 23 bp, Homo sapiens
accctggccaagcagaagggggg

SEQ ID NO: 16348 - DNA, 23 bp, Homo sapiens
tccattggacaacagagagtggg

SEQ ID NO: 16349 - DNA, 23 bp, Homo sapiens
aataatgactcccagagatcagg

SEQ ID NO: 16350 - DNA, 23 bp, Homo sapiens
caccaaaatgcactcagtaatgg

SEQ ID NO: 16351 - DNA, 23 bp, Homo sapiens
gaagatggttaacagctgaaagg

SEQ ID NO: 16352 - DNA, 23 bp, Homo sapiens
gtgcctagagaagaggattaagg

SEQ ID NO: 16353 - DNA, 23 bp, Homo sapiens
ccgatccacctcagctgaactgg

SEQ ID NO: 16354 - DNA, 23 bp, Homo sapiens
cgcagtctctctaacactgcagg

SEQ ID NO: 16355 - DNA, 23 bp, Homo sapiens
gaaggagcaggcagctcagttgg

SEQ ID NO: 16356 - DNA, 23 bp, Homo sapiens
acctttgattgcgcgctgtgagg

SEQ ID NO: 16357 - DNA, 23 bp, Homo sapiens
ctggggctcattcaacgctgcgg

SEQ ID NO: 16358 - DNA, 23 bp, Homo sapiens
ccttgcgcttcagttcttaaagg

SEQ ID NO: 16359 - DNA, 23 bp, Homo sapiens
ctcgtggcgcctcctgtctgtgg

SEQ ID NO: 16360 - DNA, 23 bp, Homo sapiens
tgcagtcagatatgatgcagagg

SEQ ID NO: 16361 - DNA, 23 bp, Homo sapiens
acacgcacacaaactgacagtgg

SEQ ID NO: 16362 - DNA, 23 bp, Homo sapiens
atcagcaaagcaagcagagttgg

SEQ ID NO: 16363 - DNA, 23 bp, Homo sapiens
ggcaaacacgtcgtcagtgcagg

SEQ ID NO: 16364 - DNA, 23 bp, Homo sapiens
tgactaataagactgtatgctgg

SEQ ID NO: 16365 - DNA, 23 bp, Homo sapiens
catcccccggaggtaatcagagg

SEQ ID NO: 16366 - DNA, 23 bp, Homo sapiens
ggaggtttagatgaatgacttgg

SEQ ID NO: 16367 - DNA, 23 bp, Homo sapiens
tctaggatgactcagctctgtgg

SEQ ID NO: 16368 - DNA, 23 bp, Homo sapiens
ggagtctccgggagcatcagagg

SEQ ID NO: 16369 - DNA, 23 bp, Homo sapiens
acgtgtatgctgtggagaaaggg

SEQ ID NO: 16370 - DNA, 23 bp, Homo sapiens
ggagcataggtcaggagcacagg

SEQ ID NO: 16371 - DNA, 23 bp, Homo sapiens
tggaggacgtagaatttcactgg

SEQ ID NO: 16372 - DNA, 23 bp, Homo sapiens
cttgtgatggttatcacttgagg

SEQ ID NO: 16373 - DNA, 23 bp, Homo sapiens
aagccaagctaccaattacgggg

SEQ ID NO: 16374 - DNA, 23 bp, Homo sapiens
accagtgaagccacagattatgg

SEQ ID NO: 16375 - DNA, 23 bp, Homo sapiens
gcggtgctcacagctcatcgtgg

SEQ ID NO: 16376 - DNA, 23 bp, Homo sapiens
aaagccaccagtttctcaggagg

SEQ ID NO: 16377 - DNA, 23 bp, Homo sapiens
ggacgtcagggctcagagtgagg

SEQ ID NO: 16378 - DNA, 23 bp, Homo sapiens
cggggtggcatggaattagcagg

SEQ ID NO: 16379 - DNA, 23 bp, Homo sapiens
agaggaggtgtgtttgtgtatgg

SEQ ID NO: 16380 - DNA, 23 bp, Homo sapiens
caacagccaccatcacttattgg

SEQ ID NO: 16381 - DNA, 23 bp, Homo sapiens
ttcttcacattttagtgtcctgg

SEQ ID NO: 16382 - DNA, 23 bp, Homo sapiens
gtttgagcctcaaaaagtgaagg

SEQ ID NO: 16383 - DNA, 23 bp, Homo sapiens
gggaagcggccggggtcagtcgg

SEQ ID NO: 16384 - DNA, 23 bp, Homo sapiens
tagatgggtgataatatggtagg

SEQ ID NO: 16385 - DNA, 23 bp, Homo sapiens
acatacacttgtccgctcctagg

SEQ ID NO: 16386 - DNA, 23 bp, Homo sapiens
gggcctcccaatagactaacagg

SEQ ID NO: 16387 - DNA, 23 bp, Homo sapiens
aggaatccggtgggagtagctgg

SEQ ID NO: 16388 - DNA, 23 bp, Homo sapiens
aatctgctccagaggttatctgg

SEQ ID NO: 16389 - DNA, 23 bp, Homo sapiens
gatggttggcctgctaaaatagg

SEQ ID NO: 16390 - DNA, 23 bp, Homo sapiens
accttagcttcatagagccttgg

SEQ ID NO: 16391 - DNA, 23 bp, Homo sapiens
gctggattcagtagactgcttgg

SEQ ID NO: 16392 - DNA, 23 bp, Homo sapiens
aagctctgttctgctcatcttgg

SEQ ID NO: 16393 - DNA, 23 bp, Homo sapiens
actgaaactgaagtacttcaagg

SEQ ID NO: 16394 - DNA, 23 bp, Homo sapiens
cagaaatgctagtcaagttctgg

SEQ ID NO: 16395 - DNA, 23 bp, Homo sapiens
gggctgtcttccttttcataagg

SEQ ID NO: 16396 - DNA, 23 bp, Homo sapiens
actctgcgacagattcgacaagg

SEQ ID NO: 16397 - DNA, 23 bp, Homo sapiens
acatttgctttatgctgctttgg

SEQ ID NO: 16398 - DNA, 23 bp, Homo sapiens
aaggaactgaaaaagctggcggg

SEQ ID NO: 16399 - DNA, 23 bp, Homo sapiens
taaatggactctaacctcagtgg

SEQ ID NO: 16400 - DNA, 23 bp, Homo sapiens
ttatccaatgaggaacccaacgg

SEQ ID NO: 16401 - DNA, 23 bp, Homo sapiens
gccttgccttgcacttgctctgg

SEQ ID NO: 16402 - DNA, 23 bp, Homo sapiens
ttataaatctggtcacctctagg

SEQ ID NO: 16403 - DNA, 23 bp, Homo sapiens
gcaaacatgcttcagcaatctgg

SEQ ID NO: 16404 - DNA, 23 bp, Homo sapiens
ccccaatgcagtgcagtcagcgg

SEQ ID NO: 16405 - DNA, 23 bp, Homo sapiens
agccagcagttggtcatctctgg

SEQ ID NO: 16406 - DNA, 23 bp, Homo sapiens
tcaggttgtgtccaggcatgcgg

SEQ ID NO: 16407 - DNA, 23 bp, Homo sapiens
tgaccttctgtgaagaactgggg

SEQ ID NO: 16408 - DNA, 23 bp, Homo sapiens
cgagatcgaaggattctaggcgg

SEQ ID NO: 16409 - DNA, 23 bp, Homo sapiens
gttggctcatctcactcacgtgg

SEQ ID NO: 16410 - DNA, 23 bp, Homo sapiens
aagaagaagacctctggcggggg

SEQ ID NO: 16411 - DNA, 23 bp, Homo sapiens
aaccaccaaaggccgcaaagagg

SEQ ID NO: 16412 - DNA, 23 bp, Homo sapiens
aggctctggctgcggattagggg

SEQ ID NO: 16413 - DNA, 23 bp, Homo sapiens
ccctcagacgtggacagctaggg

SEQ ID NO: 16414 - DNA, 23 bp, Homo sapiens
tgactcctgctgatggttaaggg

SEQ ID NO: 16415 - DNA, 23 bp, Homo sapiens
aaagctaccgtgaatttactggg

SEQ ID NO: 16416 - DNA, 23 bp, Homo sapiens
gaaacacctggcctgctaggagg

SEQ ID NO: 16417 - DNA, 23 bp, Homo sapiens
gcaggtcctggcccgtagccggg

SEQ ID NO: 16418 - DNA, 23 bp, Homo sapiens
tctgcaagttcaaaaactagagg

SEQ ID NO: 16419 - DNA, 23 bp, Homo sapiens
gcaagcctgacttcatgctcagg

SEQ ID NO: 16420 - DNA, 23 bp, Homo sapiens
gtcagtgaacttgcagacatagg

SEQ ID NO: 16421 - DNA, 23 bp, Homo sapiens
gtctgcaagttcaaggactaggg

SEQ ID NO: 16422 - DNA, 23 bp, Homo sapiens
acaagcacatacggatacatagg

SEQ ID NO: 16423 - DNA, 23 bp, Homo sapiens
cttgattcttgctctatggtcgg

SEQ ID NO: 16424 - DNA, 23 bp, Homo sapiens
agtactaatccaaacagtcatgg

SEQ ID NO: 16425 - DNA, 23 bp, Homo sapiens
agtcagatcagctcctaaggggg

SEQ ID NO: 16426 - DNA, 23 bp, Homo sapiens
tctggcatcgcggggctacgtgg

SEQ ID NO: 16427 - DNA, 23 bp, Homo sapiens
cctgtgaagagagaacgcagtgg

SEQ ID NO: 16428 - DNA, 23 bp, Homo sapiens
tgtctctaccacagggagcaggg

SEQ ID NO: 16429 - DNA, 23 bp, Homo sapiens
acagaagacgaaggtcacttagg

SEQ ID NO: 16430 - DNA, 23 bp, Homo sapiens
gagcaacctggtcatctgagggg

SEQ ID NO: 16431 - DNA, 23 bp, Homo sapiens
gggcggggggcttcagagcacgg

SEQ ID NO: 16432 - DNA, 23 bp, Homo sapiens
ccgcggctcagagcaccgagagg

SEQ ID NO: 16433 - DNA, 23 bp, Homo sapiens
tgggtggcagagggcctcagcgg

SEQ ID NO: 16434 - DNA, 23 bp, Homo sapiens
cctgccgaggcgcggaataaagg

SEQ ID NO: 16435 - DNA, 23 bp, Homo sapiens
tatatcagcattctctgacttgg

SEQ ID NO: 16436 - DNA, 23 bp, Homo sapiens
aagaagcacgatgtctgagacgg

SEQ ID NO: 16437 - DNA, 23 bp, Homo sapiens
gttaacggcaattggcttatagg

SEQ ID NO: 16438 - DNA, 23 bp, Homo sapiens
gggggtcacaacacagtgaccgg

SEQ ID NO: 16439 - DNA, 23 bp, Homo sapiens
gcctcagtcccgcttctagctgg

SEQ ID NO: 16440 - DNA, 23 bp, Homo sapiens
tggtggccacctaccaagtcagg

SEQ ID NO: 16441 - DNA, 23 bp, Homo sapiens
gctcaccaaaatcagtagttagg

SEQ ID NO: 16442 - DNA, 23 bp, Homo sapiens
tcccagtggatctaaatcaatgg

SEQ ID NO: 16443 - DNA, 23 bp, Homo sapiens
atgaggtctcaatcagccacagg

SEQ ID NO: 16444 - DNA, 23 bp, Homo sapiens
tgaagaagcagctcaagggcagg

SEQ ID NO: 16445 - DNA, 23 bp, Homo sapiens
accctcagcggcaaaattaatgg

SEQ ID NO: 16446 - DNA, 23 bp, Homo sapiens
ctcgagccctcccttccacatgg

SEQ ID NO: 16447 - DNA, 23 bp, Homo sapiens
tgctgtcgtgtgcagccctgagg

SEQ ID NO: 16448 - DNA, 23 bp, Homo sapiens
tgctgccacctgacctgacaggg

SEQ ID NO: 16449 - DNA, 23 bp, Homo sapiens
ttcctttcaaatctgctgggagg

SEQ ID NO: 16450 - DNA, 23 bp, Homo sapiens
gctggctcatggctctgccacgg

SEQ ID NO: 16451 - DNA, 23 bp, Homo sapiens
aaaaggagtctctgcctcagtgg

SEQ ID NO: 16452 - DNA, 23 bp, Homo sapiens
aattctttttcttctgtgcccgg

SEQ ID NO: 16453 - DNA, 23 bp, Homo sapiens
aagtttgttgtaaaaccacctgg

SEQ ID NO: 16454 - DNA, 23 bp, Homo sapiens
aaaactggtctaataactgccgg

SEQ ID NO: 16455 - DNA, 23 bp, Homo sapiens
cctggggagccgccatcactcgg

SEQ ID NO: 16456 - DNA, 23 bp, Homo sapiens
ggcgggcaggcgtcatcgcttgg

SEQ ID NO: 16457 - DNA, 23 bp, Homo sapiens
tgataactggcatcaactcacgg

SEQ ID NO: 16458 - DNA, 23 bp, Homo sapiens
gctaggcgtcgtcactgcagtgg

SEQ ID NO: 16459 - DNA, 23 bp, Homo sapiens
ccaggcctgtgttcgtgagtcgg

SEQ ID NO: 16460 - DNA, 23 bp, Homo sapiens
aaggagcccagaaaaggaaaagg

SEQ ID NO: 16461 - DNA, 23 bp, Homo sapiens
agtgaagtctctgctctaactgg

SEQ ID NO: 16462 - DNA, 23 bp, Homo sapiens
agaagctgtgacatattctgagg

SEQ ID NO: 16463 - DNA, 23 bp, Homo sapiens
ttcatggaggatggattggaagg

SEQ ID NO: 16464 - DNA, 23 bp, Homo sapiens
gctgcatcacagttgcacaaagg

SEQ ID NO: 16465 - DNA, 23 bp, Homo sapiens
cagagacctgattgttgcagagg

SEQ ID NO: 16466 - DNA, 23 bp, Homo sapiens
aattactttgaagtctccagtgg

SEQ ID NO: 16467 - DNA, 23 bp, Homo sapiens
ccgatgcaagctctcaggaccgg

SEQ ID NO: 16468 - DNA, 23 bp, Homo sapiens
caaagttcttttctggtctcagg

SEQ ID NO: 16469 - DNA, 23 bp, Homo sapiens
tgggtcagcattcatcagagagg

SEQ ID NO: 16470 - DNA, 23 bp, Homo sapiens
gggtggttggtgtcaccgagagg

SEQ ID NO: 16471 - DNA, 23 bp, Homo sapiens
ttttgcagtgggggcttatttgg

SEQ ID NO: 16472 - DNA, 23 bp, Homo sapiens
ttttggagtgagggcttatttgg

SEQ ID NO: 16473 - DNA, 23 bp, Homo sapiens
ttttgcagtggcggcttatttgg

SEQ ID NO: 16474 - DNA, 23 bp, Homo sapiens
agtgccccagtttcttctgaggg

SEQ ID NO: 16475 - DNA, 23 bp, Homo sapiens
ggaagggctgactttctcatggg

SEQ ID NO: 16476 - DNA, 23 bp, Homo sapiens
tgtcattttgtcagtgcgtctgg

SEQ ID NO: 16477 - DNA, 23 bp, Homo sapiens
ggaagtcagagagcttggtacgg

SEQ ID NO: 16478 - DNA, 23 bp, Homo sapiens
tcaggaagatggagtgactcagg

SEQ ID NO: 16479 - DNA, 23 bp, Homo sapiens
ggtgctagaattggtatgaaggg

SEQ ID NO: 16480 - DNA, 23 bp, Homo sapiens
gatggtccacatctataagtggg

SEQ ID NO: 16481 - DNA, 23 bp, Homo sapiens
ggggaggccaagggcttagctgg

SEQ ID NO: 16482 - DNA, 23 bp, Homo sapiens
ggggctgctagatgccctgcagg

SEQ ID NO: 16483 - DNA, 23 bp, Homo sapiens
actcagccatgaaaatgaattgg

SEQ ID NO: 16484 - DNA, 23 bp, Homo sapiens
ctcagagccaggagggactgtgg

SEQ ID NO: 16485 - DNA, 23 bp, Homo sapiens
tattctttagactgcagtgtagg

SEQ ID NO: 16486 - DNA, 23 bp, Homo sapiens
cggagaggcctctacaggatggg

SEQ ID NO: 16487 - DNA, 23 bp, Homo sapiens
tccccacagacctgtatcatggg

SEQ ID NO: 16488 - DNA, 23 bp, Homo sapiens
ttcatgggaacagcagctggagg

SEQ ID NO: 16489 - DNA, 23 bp, Homo sapiens
ccatcctactgttgaaatgttgg

SEQ ID NO: 16490 - DNA, 23 bp, Homo sapiens
gccctcataaccctaaaagatgg

SEQ ID NO: 16491 - DNA, 23 bp, Homo sapiens
tgcccgctgaccctgagtgaagg

SEQ ID NO: 16492 - DNA, 23 bp, Homo sapiens
ttccaggaacatcaatgtgaggg

SEQ ID NO: 16493 - DNA, 23 bp, Homo sapiens
tttgtcaagatcagcaatgaagg

SEQ ID NO: 16494 - DNA, 23 bp, Homo sapiens
ccactggtccctcccttcagagg

SEQ ID NO: 16495 - DNA, 23 bp, Homo sapiens
gcacgggcactgttctgaggagg

SEQ ID NO: 16496 - DNA, 23 bp, Homo sapiens
aggacagggctgcctcagcttgg

SEQ ID NO: 16497 - DNA, 23 bp, Homo sapiens
gagcccgaaaacccgtaggctgg

SEQ ID NO: 16498 - DNA, 23 bp, Homo sapiens
gggacttttgtgagtcaggcggg

SEQ ID NO: 16499 - DNA, 23 bp, Homo sapiens
ctacgcgtctagcagaacacagg

SEQ ID NO: 16500 - DNA, 23 bp, Homo sapiens
tccttatcgtgtttttgtagggg

SEQ ID NO: 16501 - DNA, 23 bp, Homo sapiens
ccctactcctatgcgggatgagg

SEQ ID NO: 16502 - DNA, 23 bp, Homo sapiens
cagggtgggccagtttcagatgg

SEQ ID NO: 16503 - DNA, 23 bp, Homo sapiens
aaacttgctgcggttgctcaagg

SEQ ID NO: 16504 - DNA, 23 bp, Homo sapiens
gaaaatgcttcccgttcttctgg

SEQ ID NO: 16505 - DNA, 23 bp, Homo sapiens
gaacagaaatcaggagatcttgg

SEQ ID NO: 16506 - DNA, 23 bp, Homo sapiens
gaaaatccttcccgttcttctgg

SEQ ID NO: 16507 - DNA, 23 bp, Homo sapiens
tccagggtggcaggctcacttgg

SEQ ID NO: 16508 - DNA, 23 bp, Homo sapiens
ggctaatagcctaaagtgactgg

SEQ ID NO: 16509 - DNA, 23 bp, Homo sapiens
ttagctgcagtttgagcatcagg

SEQ ID NO: 16510 - DNA, 23 bp, Homo sapiens
gtggagatggggtggcctagtgg

SEQ ID NO: 16511 - DNA, 23 bp, Homo sapiens
aaggtggagggatcagaacctgg

SEQ ID NO: 16512 - DNA, 23 bp, Homo sapiens
ggccagggcagctcagacgaagg

SEQ ID NO: 16513 - DNA, 23 bp, Homo sapiens
ttgtagtcagaaactgttgttgg

SEQ ID NO: 16514 - DNA, 23 bp, Homo sapiens
gactgttgggtagctgtcagagg

SEQ ID NO: 16515 - DNA, 23 bp, Homo sapiens
cgtggagactcaggtgtgtgagg

SEQ ID NO: 16516 - DNA, 23 bp, Homo sapiens
tcatttgttgaaagtactgctgg

SEQ ID NO: 16517 - DNA, 23 bp, Homo sapiens
tacaatcagatgttgccatttgg

SEQ ID NO: 16518 - DNA, 23 bp, Homo sapiens
acagtcctcctccgaggcctagg

SEQ ID NO: 16519 - DNA, 23 bp, Homo sapiens
tcatgtagcatgaggctctgtgg

SEQ ID NO: 16520 - DNA, 23 bp, Homo sapiens
ggacttgcttcagtccttatcgg

SEQ ID NO: 16521 - DNA, 23 bp, Homo sapiens
aaatggctcccttttttgtgagg

SEQ ID NO: 16522 - DNA, 23 bp, Homo sapiens
aagaattctctcctgttctaagg

SEQ ID NO: 16523 - DNA, 23 bp, Homo sapiens
agatgagtcccccgctttagggg

SEQ ID NO: 16524 - DNA, 23 bp, Homo sapiens
tcaccaggacagactctgattgg

SEQ ID NO: 16525 - DNA, 23 bp, Homo sapiens
ggtgagaattaggcacactgagg

SEQ ID NO: 16526 - DNA, 23 bp, Homo sapiens
tacaataacctgctttgatgagg

SEQ ID NO: 16527 - DNA, 23 bp, Homo sapiens
cacaagccatttcaataggatgg

SEQ ID NO: 16528 - DNA, 23 bp, Homo sapiens
tgtgcgctctgagttttatcagg

SEQ ID NO: 16529 - DNA, 23 bp, Homo sapiens
ccaacactccactcgctaagagg

SEQ ID NO: 16530 - DNA, 23 bp, Homo sapiens
ctgcggtaggaacggtcaggagg

SEQ ID NO: 16531 - DNA, 23 bp, Homo sapiens
ccttgctcagtcttactaaacgg

SEQ ID NO: 16532 - DNA, 23 bp, Homo sapiens
ttttcataacaggttagtgctgg

SEQ ID NO: 16533 - DNA, 23 bp, Homo sapiens
ttgtctcatctcaagctaggtgg

SEQ ID NO: 16534 - DNA, 23 bp, Homo sapiens
tttccctgagtttgcttaaaagg

SEQ ID NO: 16535 - DNA, 23 bp, Homo sapiens
aggtctaactgagcctcctctgg

SEQ ID NO: 16536 - DNA, 23 bp, Homo sapiens
atttaggaggcagctctttttgg

SEQ ID NO: 16537 - DNA, 23 bp, Homo sapiens
cagcctgcctctttccttacagg

SEQ ID NO: 16538 - DNA, 23 bp, Homo sapiens
gcgtggcgaagctgagctgacgg

SEQ ID NO: 16539 - DNA, 23 bp, Homo sapiens
atgcagctgcatcccgtccaggg

SEQ ID NO: 16540 - DNA, 23 bp, Homo sapiens
ttgtcaagttatctcgtcttagg

SEQ ID NO: 16541 - DNA, 23 bp, Homo sapiens
agattcgatagccagtgaggtgg

SEQ ID NO: 16542 - DNA, 23 bp, Homo sapiens
ctagaaattctctcagggcatgg

SEQ ID NO: 16543 - DNA, 23 bp, Homo sapiens
actctctgcctgggctagggagg

SEQ ID NO: 16544 - DNA, 23 bp, Homo sapiens
gacgctcagctccactgagctgg

SEQ ID NO: 16545 - DNA, 23 bp, Homo sapiens
ccagcggtcagtgcagcacctgg

SEQ ID NO: 16546 - DNA, 23 bp, Homo sapiens
catccccccaccgccctgaccgg

SEQ ID NO: 16547 - DNA, 23 bp, Homo sapiens
ataggggcaggtcagtttgctgg

SEQ ID NO: 16548 - DNA, 23 bp, Homo sapiens
cttgggcctccagccctcagggg

SEQ ID NO: 16549 - DNA, 23 bp, Homo sapiens
ggtggaggaggcagacactcagg

SEQ ID NO: 16550 - DNA, 23 bp, Homo sapiens
aatatggaaagcacctcatgtgg

SEQ ID NO: 16551 - DNA, 23 bp, Homo sapiens
taaaatccaacagccaaatgagg

SEQ ID NO: 16552 - DNA, 23 bp, Homo sapiens
ctcggtacccttggtaccctagg

SEQ ID NO: 16553 - DNA, 23 bp, Homo sapiens
agacgtgagagctatcacgatgg

SEQ ID NO: 16554 - DNA, 23 bp, Homo sapiens
cctttctctgccactctttgagg

SEQ ID NO: 16555 - DNA, 23 bp, Homo sapiens
cgtttctcacgtacaaatgcagg

SEQ ID NO: 16556 - DNA, 23 bp, Homo sapiens
acaaggcaagtcttcatgctcgg

SEQ ID NO: 16557 - DNA, 23 bp, Homo sapiens
acccaagggctcacatgagatgg

SEQ ID NO: 16558 - DNA, 23 bp, Homo sapiens
atggcagtcagcttttcacaagg

SEQ ID NO: 16559 - DNA, 23 bp, Homo sapiens
gtcctaggcaggtcttaggccgg

SEQ ID NO: 16560 - DNA, 23 bp, Homo sapiens
cagcaaggtttcacaagacaagg

SEQ ID NO: 16561 - DNA, 23 bp, Homo sapiens
ctgccttcttcaggtttcaccgg

SEQ ID NO: 16562 - DNA, 23 bp, Homo sapiens
gaatgatgagcacacaaggcggg

SEQ ID NO: 16563 - DNA, 23 bp, Homo sapiens
actgctgcaaggtgctatgaggg

SEQ ID NO: 16564 - DNA, 23 bp, Homo sapiens
tctccagcagtggcctgaagagg

SEQ ID NO: 16565 - DNA, 23 bp, Homo sapiens
cccatcttcctcctcggctgtgg

SEQ ID NO: 16566 - DNA, 23 bp, Homo sapiens
cgttgcttagtaatgtaacctgg

SEQ ID NO: 16567 - DNA, 23 bp, Homo sapiens
gccttggggatctcagagaatgg

SEQ ID NO: 16568 - DNA, 23 bp, Homo sapiens
cttttgcgtggtgacctgagcgg

SEQ ID NO: 16569 - DNA, 23 bp, Homo sapiens
ctgccctgggtcagagcagcagg

SEQ ID NO: 16570 - DNA, 23 bp, Homo sapiens
ccaagtgccagggtcacaagagg

SEQ ID NO: 16571 - DNA, 23 bp, Homo sapiens
gaagatcttgcactcattgatgg

SEQ ID NO: 16572 - DNA, 23 bp, Homo sapiens
agctgctgttcaattatctgagg

SEQ ID NO: 16573 - DNA, 23 bp, Homo sapiens
aaacagtcttcaatcccttctgg

SEQ ID NO: 16574 - DNA, 23 bp, Homo sapiens
tgctactgtttttgcagttttgg

SEQ ID NO: 16575 - DNA, 23 bp, Homo sapiens
ttgggtaccaggggcctcactgg

SEQ ID NO: 16576 - DNA, 23 bp, Homo sapiens
acagcagtacttcttccaccagg

SEQ ID NO: 16577 - DNA, 23 bp, Homo sapiens
agcagaagaacttcttccagcgg

SEQ ID NO: 16578 - DNA, 23 bp, Homo sapiens
cgactgtgtctacatcgtcgtgg

SEQ ID NO: 16579 - DNA, 23 bp, Homo sapiens
tcacattccccaatgtctaaggg

SEQ ID NO: 16580 - DNA, 23 bp, Homo sapiens
agcacccagggtggccgtgaggg

SEQ ID NO: 16581 - DNA, 23 bp, Homo sapiens
ttctcaactcagacagttcttgg

SEQ ID NO: 16582 - DNA, 23 bp, Homo sapiens
cctccagactcagagacctgagg

SEQ ID NO: 16583 - DNA, 23 bp, Homo sapiens
cactaccacctagaactcactgg

SEQ ID NO: 16584 - DNA, 23 bp, Homo sapiens
gatagacatcctgaacttagcgg

SEQ ID NO: 16585 - DNA, 23 bp, Homo sapiens
aatacaggaagtcgataatgagg

SEQ ID NO: 16586 - DNA, 23 bp, Homo sapiens
aggaagaaccttttcaggatggg

SEQ ID NO: 16587 - DNA, 23 bp, Homo sapiens
gacttcatgtcacttgtacaagg

SEQ ID NO: 16588 - DNA, 23 bp, Homo sapiens
gagtgggacctaatggtgagagg

SEQ ID NO: 16589 - DNA, 23 bp, Homo sapiens
gctgttttcactctaaaccctgg

SEQ ID NO: 16590 - DNA, 23 bp, Homo sapiens
aagagctgccatcctcagtcagg

SEQ ID NO: 16591 - DNA, 23 bp, Homo sapiens
aaggacctgcaccaggatggtgg

SEQ ID NO: 16592 - DNA, 23 bp, Homo sapiens
cttttagtctgtgtcagagctgg

SEQ ID NO: 16593 - DNA, 23 bp, Homo sapiens
tcagcagatgtatcaactatagg

SEQ ID NO: 16594 - DNA, 23 bp, Homo sapiens
acaacggcatcactataagtggg

SEQ ID NO: 16595 - DNA, 23 bp, Homo sapiens
gcacgagaaactaagttgtatgg

SEQ ID NO: 16596 - DNA, 23 bp, Homo sapiens
tagctgcatgtgaatcttgttgg

SEQ ID NO: 16597 - DNA, 23 bp, Homo sapiens
agacccctaagtcaggcctctgg

SEQ ID NO: 16598 - DNA, 23 bp, Homo sapiens
agggaaacaagtcgtcggacagg

SEQ ID NO: 16599 - DNA, 23 bp, Homo sapiens
gccaaggtcacagatgctgcagg

SEQ ID NO: 16600 - DNA, 23 bp, Homo sapiens
aaatgctggcaggaacaaggagg

SEQ ID NO: 16601 - DNA, 23 bp, Homo sapiens
aagaaactgctgaaaaagctggg

SEQ ID NO: 16602 - DNA, 23 bp, Homo sapiens
aatgcgctcaaaggcaaaaaggg

SEQ ID NO: 16603 - DNA, 23 bp, Homo sapiens
aggctctgaacttggcaagcagg

SEQ ID NO: 16604 - DNA, 23 bp, Homo sapiens
caatgcgctcaaaggcaaaaagg

SEQ ID NO: 16605 - DNA, 23 bp, Homo sapiens
ttcctgaaaggctctgaacttgg

SEQ ID NO: 16606 - DNA, 23 bp, Homo sapiens
ggatgcttgctcagtgtccatgg

SEQ ID NO: 16607 - DNA, 23 bp, Homo sapiens
ctggctacaacattaacaacagg

SEQ ID NO: 16608 - DNA, 23 bp, Homo sapiens
agccaatgaaatcaaactactgg

SEQ ID NO: 16609 - DNA, 23 bp, Homo sapiens
agttcactatgatcgaatacagg

SEQ ID NO: 16610 - DNA, 23 bp, Homo sapiens
ccacaagtgccagtgagaagcgg

SEQ ID NO: 16611 - DNA, 23 bp, Homo sapiens
gcggaggccgcgtgtctctacgg

SEQ ID NO: 16612 - DNA, 23 bp, Homo sapiens
tgctatgaacgagagtaagaagg

SEQ ID NO: 16613 - DNA, 23 bp, Homo sapiens
accagcccctcatgctcttaagg

SEQ ID NO: 16614 - DNA, 23 bp, Homo sapiens
gcactaagatcgttctccgcagg

SEQ ID NO: 16615 - DNA, 23 bp, Homo sapiens
agagggaagccgggcagcagagg

SEQ ID NO: 16616 - DNA, 23 bp, Homo sapiens
agtcccgcctgtcttctaggagg

SEQ ID NO: 16617 - DNA, 23 bp, Homo sapiens
gcgccccgggagggcctcacagg

SEQ ID NO: 16618 - DNA, 23 bp, Homo sapiens
gtcccctggtggggtcactttgg

SEQ ID NO: 16619 - DNA, 23 bp, Homo sapiens
cagggaccagtgacaactagggg

SEQ ID NO: 16620 - DNA, 23 bp, Homo sapiens
aggacaaattggcctaatactgg

SEQ ID NO: 16621 - DNA, 23 bp, Homo sapiens
aagacagccaagacgaaaaaagg

SEQ ID NO: 16622 - DNA, 23 bp, Homo sapiens
gacagaagtctatacctgaaagg

SEQ ID NO: 16623 - DNA, 23 bp, Homo sapiens
ttggaagcagccagcttttgggg

SEQ ID NO: 16624 - DNA, 23 bp, Homo sapiens
atcacgttcagaagaatggaagg

SEQ ID NO: 16625 - DNA, 23 bp, Homo sapiens
agaaactaatttagggctagagg

SEQ ID NO: 16626 - DNA, 23 bp, Homo sapiens
aaagcctggtattatccctctgg

SEQ ID NO: 16627 - DNA, 23 bp, Homo sapiens
agcccatccagggttagttctgg

SEQ ID NO: 16628 - DNA, 23 bp, Homo sapiens
gccttacccggaaatacttgtgg

SEQ ID NO: 16629 - DNA, 23 bp, Homo sapiens
agggttggtataatcatagcggg

SEQ ID NO: 16630 - DNA, 23 bp, Homo sapiens
gcggcgaagcaagacctagctgg

SEQ ID NO: 16631 - DNA, 23 bp, Homo sapiens
aatagtttagaatgctgtgctgg

SEQ ID NO: 16632 - DNA, 23 bp, Homo sapiens
aacctgtaattaaaaggctgtgg

SEQ ID NO: 16633 - DNA, 23 bp, Homo sapiens
agagcagtataaagagtttcagg

SEQ ID NO: 16634 - DNA, 23 bp, Homo sapiens
tcttggacggagatcactgaggg

SEQ ID NO: 16635 - DNA, 23 bp, Homo sapiens
tgatttcaacatctgcctcctgg

SEQ ID NO: 16636 - DNA, 23 bp, Homo sapiens
ggatgaagaagagaagtaggagg

SEQ ID NO: 16637 - DNA, 23 bp, Homo sapiens
tgatagcgaagatgaaattgagg

SEQ ID NO: 16638 - DNA, 23 bp, Homo sapiens
ctagcctctgcacactcagcagg

SEQ ID NO: 16639 - DNA, 23 bp, Homo sapiens
gagacagagactgattcatttgg

SEQ ID NO: 16640 - DNA, 23 bp, Homo sapiens
gaatctttcttcttccggaatgg

SEQ ID NO: 16641 - DNA, 23 bp, Homo sapiens
agcctgtggaagaagctcaaagg

SEQ ID NO: 16642 - DNA, 23 bp, Homo sapiens
ttggaagggaagaattctgatgg

SEQ ID NO: 16643 - DNA, 23 bp, Homo sapiens
aaagagtatcatttccaaggggg

SEQ ID NO: 16644 - DNA, 23 bp, Homo sapiens
tggcaggagatgttttcagaagg

SEQ ID NO: 16645 - DNA, 23 bp, Homo sapiens
aagacagatgagctttgtgtagg

SEQ ID NO: 16646 - DNA, 23 bp, Homo sapiens
cgcagagcagtcttagcttctgg

SEQ ID NO: 16647 - DNA, 23 bp, Homo sapiens
gcctaattggttgtaccaaaagg

SEQ ID NO: 16648 - DNA, 23 bp, Homo sapiens
tgcttcacccgagagttccttgg

SEQ ID NO: 16649 - DNA, 23 bp, Homo sapiens
atcttttggtacaaccaacatgg

SEQ ID NO: 16650 - DNA, 23 bp, Homo sapiens
cccagccctcaaactagcaaagg

SEQ ID NO: 16651 - DNA, 23 bp, Homo sapiens
tcttcatcagcatctgcatccgg

SEQ ID NO: 16652 - DNA, 23 bp, Homo sapiens
ctatccagcacacacagaggagg

SEQ ID NO: 16653 - DNA, 23 bp, Homo sapiens
gagaaacagaagcagctgaaggg

SEQ ID NO: 16654 - DNA, 23 bp, Homo sapiens
gcttcctactgttaccaaagagg

SEQ ID NO: 16655 - DNA, 23 bp, Homo sapiens
ccagaaggacctggaagaactgg

SEQ ID NO: 16656 - DNA, 23 bp, Homo sapiens
accttgagaatctaaagaagcgg

SEQ ID NO: 16657 - DNA, 23 bp, Homo sapiens
tggaggtagaagatttacacagg

SEQ ID NO: 16658 - DNA, 23 bp, Homo sapiens
tgtcatcctcattaccatagagg

SEQ ID NO: 16659 - DNA, 23 bp, Homo sapiens
aatatctgtttggcatctcctgg

SEQ ID NO: 16660 - DNA, 23 bp, Homo sapiens
tggagcagaacccggcagatggg

SEQ ID NO: 16661 - DNA, 23 bp, Homo sapiens
tctgtggaggactctacctaagg

SEQ ID NO: 16662 - DNA, 23 bp, Homo sapiens
atgaagcgccagttaccaactgg

SEQ ID NO: 16663 - DNA, 23 bp, Homo sapiens
ctgatgagctggttagtttgtgg

SEQ ID NO: 16664 - DNA, 23 bp, Homo sapiens
ttgaggccagatagtttccttgg

SEQ ID NO: 16665 - DNA, 23 bp, Homo sapiens
ggtatcgctggtctctattcggg

SEQ ID NO: 16666 - DNA, 23 bp, Homo sapiens
gagcttagatgattctatccagg

SEQ ID NO: 16667 - DNA, 23 bp, Homo sapiens
tgctgatacaggagcttagatgg

SEQ ID NO: 16668 - DNA, 23 bp, Homo sapiens
cagagccatcagtatcttagagg

SEQ ID NO: 16669 - DNA, 23 bp, Homo sapiens
caggtgcctgtgcactttgacgg

SEQ ID NO: 16670 - DNA, 23 bp, Homo sapiens
gagcgatcccccctacaagttgg

SEQ ID NO: 16671 - DNA, 23 bp, Homo sapiens
aagccagtctggaaacctaaagg

SEQ ID NO: 16672 - DNA, 23 bp, Homo sapiens
cccacttgttcctgtgcacttgg

SEQ ID NO: 16673 - DNA, 23 bp, Homo sapiens
agaagtttcctcagtgaggatgg

SEQ ID NO: 16674 - DNA, 23 bp, Homo sapiens
cagagaaggagctaaacaatcgg

SEQ ID NO: 16675 - DNA, 23 bp, Homo sapiens
cgcgtagaggcagctgctagagg

SEQ ID NO: 16676 - DNA, 23 bp, Homo sapiens
gacagaaaaggggcaagtgatgg

SEQ ID NO: 16677 - DNA, 23 bp, Homo sapiens
ttggctaaagttgacaagagtgg

SEQ ID NO: 16678 - DNA, 23 bp, Homo sapiens
aagctctggttctcagtcctcgg

SEQ ID NO: 16679 - DNA, 23 bp, Homo sapiens
aaggaatacatggtgcgctaggg

SEQ ID NO: 16680 - DNA, 23 bp, Homo sapiens
tggccagccctgggtgctgatgg

SEQ ID NO: 16681 - DNA, 23 bp, Homo sapiens
aaaacttgggcatcaatgcttgg

SEQ ID NO: 16682 - DNA, 23 bp, Homo sapiens
agctgttccattatgtgaagtgg

SEQ ID NO: 16683 - DNA, 23 bp, Homo sapiens
aagctgcaacctcatgtgagggg

SEQ ID NO: 16684 - DNA, 23 bp, Homo sapiens
agttgctacggacttacgaaagg

SEQ ID NO: 16685 - DNA, 23 bp, Homo sapiens
cctgggccagtagtgtcacttgg

SEQ ID NO: 16686 - DNA, 23 bp, Homo sapiens
agatgggacatcatttgacaagg

SEQ ID NO: 16687 - DNA, 23 bp, Homo sapiens
cacaaaagatggcatctggctgg

SEQ ID NO: 16688 - DNA, 23 bp, Homo sapiens
cctggctcaattagtctcatagg

SEQ ID NO: 16689 - DNA, 23 bp, Homo sapiens
acatggtgtcaactttcacttgg

SEQ ID NO: 16690 - DNA, 23 bp, Homo sapiens
cctggggctgttactcttcctgg

SEQ ID NO: 16691 - DNA, 23 bp, Homo sapiens
ggatgcaattcccattacttagg

SEQ ID NO: 16692 - DNA, 23 bp, Homo sapiens
caaaagcttcaggctgcagaagg

SEQ ID NO: 16693 - DNA, 23 bp, Homo sapiens
caagcacggactctgctcactgg

SEQ ID NO: 16694 - DNA, 23 bp, Homo sapiens
tttagcttcagaaagtccatcgg

SEQ ID NO: 16695 - DNA, 23 bp, Homo sapiens
gtgtccctactgcaaagagaagg

SEQ ID NO: 16696 - DNA, 23 bp, Homo sapiens
atgctcttcatcactattccagg

SEQ ID NO: 16697 - DNA, 23 bp, Homo sapiens
tgggattctattggatgagctgg

SEQ ID NO: 16698 - DNA, 23 bp, Homo sapiens
ctgtgagggctaggcagctgagg

SEQ ID NO: 16699 - DNA, 23 bp, Homo sapiens
tcacatattcaagaagtgaccgg

SEQ ID NO: 16700 - DNA, 23 bp, Homo sapiens
gtgggctcacgagttgcttgtgg

SEQ ID NO: 16701 - DNA, 23 bp, Homo sapiens
cgaacagcagtctcttgattagg

SEQ ID NO: 16702 - DNA, 23 bp, Homo sapiens
gttgcagcctaatggtgaacggg

SEQ ID NO: 16703 - DNA, 23 bp, Homo sapiens
atgttgatttctcctgttctcgg

SEQ ID NO: 16704 - DNA, 23 bp, Homo sapiens
attagcattcaagctagctgtgg

SEQ ID NO: 16705 - DNA, 23 bp, Homo sapiens
atgttcatccttcaccttgatgg

SEQ ID NO: 16706 - DNA, 23 bp, Homo sapiens
ggaaaggctcttcaagttaaagg

SEQ ID NO: 16707 - DNA, 23 bp, Homo sapiens
tggctgtatggcttacatcctgg

SEQ ID NO: 16708 - DNA, 23 bp, Homo sapiens
aagattcttcaacagcagtttgg

SEQ ID NO: 16709 - DNA, 23 bp, Homo sapiens
aatggagtgattcagcacacagg

SEQ ID NO: 16710 - DNA, 23 bp, Homo sapiens
cgacgatatttgggaagatgagg

SEQ ID NO: 16711 - DNA, 23 bp, Homo sapiens
cacttcaaggtcatggcctgtgg

SEQ ID NO: 16712 - DNA, 23 bp, Homo sapiens
aattgagtattggctctggaggg

SEQ ID NO: 16713 - DNA, 23 bp, Homo sapiens
agcatcgcgcttcctctaggtgg

SEQ ID NO: 16714 - DNA, 23 bp, Homo sapiens
tgtgatctggcatcggacacagg

SEQ ID NO: 16715 - DNA, 23 bp, Homo sapiens
acacagagatctttaggttgtgg

SEQ ID NO: 16716 - DNA, 23 bp, Homo sapiens
atcctgttgaatcagcctagagg

SEQ ID NO: 16717 - DNA, 23 bp, Homo sapiens
gttactgtgcactgtccatcagg

SEQ ID NO: 16718 - DNA, 23 bp, Homo sapiens
caggatgtcacacttgcacatgg

SEQ ID NO: 16719 - DNA, 23 bp, Homo sapiens
tgggcacgtgtgctaggagatgg

SEQ ID NO: 16720 - DNA, 23 bp, Homo sapiens
atttcacttcttcacagtcctgg

SEQ ID NO: 16721 - DNA, 23 bp, Homo sapiens
ggccaacataccttgtaaatagg

SEQ ID NO: 16722 - DNA, 23 bp, Homo sapiens
acatagctgagtttggatcgtgg

SEQ ID NO: 16723 - DNA, 23 bp, Homo sapiens
gtgatatcctgtggctgaagagg

SEQ ID NO: 16724 - DNA, 23 bp, Homo sapiens
gctggggctcagacagccaaagg

SEQ ID NO: 16725 - DNA, 23 bp, Homo sapiens
aactgggagccgacagctgaggg

SEQ ID NO: 16726 - DNA, 23 bp, Homo sapiens
gtctctctctgagaactgaaggg

SEQ ID NO: 16727 - DNA, 23 bp, Homo sapiens
gtgtggggggttattagaccagg

SEQ ID NO: 16728 - DNA, 23 bp, Homo sapiens
tttcagagatgcacaaagtaagg

SEQ ID NO: 16729 - DNA, 23 bp, Homo sapiens
acacttcattaggtgctacttgg

SEQ ID NO: 16730 - DNA, 23 bp, Homo sapiens
atatgccgttggtagaaatgggg

SEQ ID NO: 16731 - DNA, 23 bp, Homo sapiens
atcgagaagtgataacccaaagg

SEQ ID NO: 16732 - DNA, 23 bp, Homo sapiens
gtttccatcctttggttctcagg

SEQ ID NO: 16733 - DNA, 23 bp, Homo sapiens
ctattcactagggctggaatagg

SEQ ID NO: 16734 - DNA, 23 bp, Homo sapiens
attaggcagcttatccattctgg

SEQ ID NO: 16735 - DNA, 23 bp, Homo sapiens
tattcagtgaactgggtcattgg

SEQ ID NO: 16736 - DNA, 23 bp, Homo sapiens
tgaaagatggctacagaagcagg

SEQ ID NO: 16737 - DNA, 23 bp, Homo sapiens
tgaaatgcttttctgcagcttgg

SEQ ID NO: 16738 - DNA, 23 bp, Homo sapiens
ggagccatgtacacgtgaggagg

SEQ ID NO: 16739 - DNA, 23 bp, Homo sapiens
ttgcatatcagttaagaaggagg

SEQ ID NO: 16740 - DNA, 23 bp, Homo sapiens
agcagttcctttggggtgtgggg

SEQ ID NO: 16741 - DNA, 23 bp, Homo sapiens
gagcccagcattaggcaatcagg

SEQ ID NO: 16742 - DNA, 23 bp, Homo sapiens
atcagagggcactcaggcaatgg

SEQ ID NO: 16743 - DNA, 23 bp, Homo sapiens
ggatgacagcagactgcagcagg

SEQ ID NO: 16744 - DNA, 23 bp, Homo sapiens
caaccactcacatcagacaatgg

SEQ ID NO: 16745 - DNA, 23 bp, Homo sapiens
ggagaagccagagtatgaagtgg

SEQ ID NO: 16746 - DNA, 23 bp, Homo sapiens
ccactttgctgagtcatgcatgg

SEQ ID NO: 16747 - DNA, 23 bp, Homo sapiens
gctcatttgtgctcctttgtagg

SEQ ID NO: 16748 - DNA, 23 bp, Homo sapiens
cccaagtgtaatgctgcttttgg

SEQ ID NO: 16749 - DNA, 23 bp, Homo sapiens
accggtcccatttgctaagtcgg

SEQ ID NO: 16750 - DNA, 23 bp, Homo sapiens
aggcaggcgctactacatgatgg

SEQ ID NO: 16751 - DNA, 23 bp, Homo sapiens
gttcagttctggaaggcacgggg

SEQ ID NO: 16752 - DNA, 23 bp, Homo sapiens
cacctcacgtcacacagctgcgg

SEQ ID NO: 16753 - DNA, 23 bp, Homo sapiens
ttcctctttgccaatttgaaagg

SEQ ID NO: 16754 - DNA, 23 bp, Homo sapiens
tacccagtgggagagaagcatgg

SEQ ID NO: 16755 - DNA, 23 bp, Homo sapiens
aaacagctgctgtgctgaaatgg

SEQ ID NO: 16756 - DNA, 23 bp, Homo sapiens
tcctccctcgccaagggcaatgg

SEQ ID NO: 16757 - DNA, 23 bp, Homo sapiens
caggtccgtcatttaagagttgg

SEQ ID NO: 16758 - DNA, 23 bp, Homo sapiens
ccagctgggcagctaatcatcgg

SEQ ID NO: 16759 - DNA, 23 bp, Homo sapiens
agccgcggcatcgcttctgatgg

SEQ ID NO: 16760 - DNA, 23 bp, Homo sapiens
agcatatcacttaacaacacagg

SEQ ID NO: 16761 - DNA, 23 bp, Homo sapiens
gatcacggacaggtatgcactgg

SEQ ID NO: 16762 - DNA, 23 bp, Homo sapiens
tttagttgcttttgatgggctgg

SEQ ID NO: 16763 - DNA, 23 bp, Homo sapiens
ctcacaagtagatcctccgcagg

SEQ ID NO: 16764 - DNA, 23 bp, Homo sapiens
ggtgctgctggtgaggaagcagg

SEQ ID NO: 16765 - DNA, 23 bp, Homo sapiens
gggcctctgactgataattaggg

SEQ ID NO: 16766 - DNA, 23 bp, Homo sapiens
aatggccagagttcagacctcgg

SEQ ID NO: 16767 - DNA, 23 bp, Homo sapiens
cggggcgcgaggaggctgtgggg

SEQ ID NO: 16768 - DNA, 23 bp, Homo sapiens
tatacaatgttctctgccccagg

SEQ ID NO: 16769 - DNA, 23 bp, Homo sapiens
atctaaggatggttcctagcagg

SEQ ID NO: 16770 - DNA, 23 bp, Homo sapiens
ggcagggaaggaggcttcagagg

SEQ ID NO: 16771 - DNA, 23 bp, Homo sapiens
ccctcagctacttccgcctgcgg

SEQ ID NO: 16772 - DNA, 23 bp, Homo sapiens
gacccatgtctcggggcacatgg

SEQ ID NO: 16773 - DNA, 23 bp, Homo sapiens
aagaatcttcttctggtagcagg

SEQ ID NO: 16774 - DNA, 23 bp, Homo sapiens
ggagatgggaaaaattaagctgg

SEQ ID NO: 16775 - DNA, 23 bp, Homo sapiens
tcaggacttgaacacgtgcacgg

SEQ ID NO: 16776 - DNA, 23 bp, Homo sapiens
tgatgcttcagaagtgcatcggg

SEQ ID NO: 16777 - DNA, 23 bp, Homo sapiens
gacgagactcagctttccgctgg

SEQ ID NO: 16778 - DNA, 23 bp, Homo sapiens
ggtctggcttggtcaatgtgtgg

SEQ ID NO: 16779 - DNA, 23 bp, Homo sapiens
aaatggggtggtaccgtttgtgg

SEQ ID NO: 16780 - DNA, 23 bp, Homo sapiens
ttcagctgatgtagatacgatgg

SEQ ID NO: 16781 - DNA, 23 bp, Homo sapiens
catgatatttgcgcatggcgtgg

SEQ ID NO: 16782 - DNA, 23 bp, Homo sapiens
actcgaggagctgtgtgaacagg

SEQ ID NO: 16783 - DNA, 23 bp, Homo sapiens
gtgcccagggaggctgagtgagg

SEQ ID NO: 16784 - DNA, 23 bp, Homo sapiens
tcgccatcttcttctttttttgg

SEQ ID NO: 16785 - DNA, 23 bp, Homo sapiens
aacatagcaaacaatgggtaagg

SEQ ID NO: 16786 - DNA, 23 bp, Homo sapiens
gtagcacttcagcttgtatctgg

SEQ ID NO: 16787 - DNA, 23 bp, Homo sapiens
gactgggtggtccaaagaatcgg

SEQ ID NO: 16788 - DNA, 23 bp, Homo sapiens
gattgttctgtttcacccacagg

SEQ ID NO: 16789 - DNA, 23 bp, Homo sapiens
acgacgaattgttctcattaggg

SEQ ID NO: 16790 - DNA, 23 bp, Homo sapiens
ccgtgactccgctgctctgaagg

SEQ ID NO: 16791 - DNA, 23 bp, Homo sapiens
tatttgaaggtgtgatgaagtgg

SEQ ID NO: 16792 - DNA, 23 bp, Homo sapiens
cgcacacttccaggtgtactagg

SEQ ID NO: 16793 - DNA, 23 bp, Homo sapiens
gatgaaagtgcaggtgtgtaagg

SEQ ID NO: 16794 - DNA, 23 bp, Homo sapiens
acaggcaggtcttaggttaaagg

SEQ ID NO: 16795 - DNA, 23 bp, Homo sapiens
tccctgagggtcatctcctgagg

SEQ ID NO: 16796 - DNA, 23 bp, Homo sapiens
cacttctgccctatgtgttctgg

SEQ ID NO: 16797 - DNA, 23 bp, Homo sapiens
ccaatttccaggaagtcagatgg

SEQ ID NO: 16798 - DNA, 23 bp, Homo sapiens
atttccaattccattctcagagg

SEQ ID NO: 16799 - DNA, 23 bp, Homo sapiens
tgctcactgctgtttctcaaagg

SEQ ID NO: 16800 - DNA, 23 bp, Homo sapiens
ccaaaacaagatcctaaggaagg

SEQ ID NO: 16801 - DNA, 23 bp, Homo sapiens
tggcacccaagggcagttagagg

SEQ ID NO: 16802 - DNA, 23 bp, Homo sapiens
cagcagtgccatctctctcaggg

SEQ ID NO: 16803 - DNA, 23 bp, Homo sapiens
tccaactcctcccgataaacagg

SEQ ID NO: 16804 - DNA, 23 bp, Homo sapiens
gaaaagtgacaaaactgagctgg

SEQ ID NO: 16805 - DNA, 23 bp, Homo sapiens
gtacttggaggatatgaaagagg

SEQ ID NO: 16806 - DNA, 23 bp, Homo sapiens
aacagtcaaggacagtttacagg

SEQ ID NO: 16807 - DNA, 23 bp, Homo sapiens
tgccccaacaagggtcatcttgg

SEQ ID NO: 16808 - DNA, 23 bp, Homo sapiens
acggttcaggagtaatctacagg

SEQ ID NO: 16809 - DNA, 23 bp, Homo sapiens
aaatcagtctttccggaaagtgg

SEQ ID NO: 16810 - DNA, 23 bp, Homo sapiens
tttggggcaagctgtcgacttgg

SEQ ID NO: 16811 - DNA, 23 bp, Homo sapiens
tcctgggtgctgtgatcagaagg

SEQ ID NO: 16812 - DNA, 23 bp, Homo sapiens
aggatctatctgaggcctagagg

SEQ ID NO: 16813 - DNA, 23 bp, Homo sapiens
ttggcaaccatggttagcatcgg

SEQ ID NO: 16814 - DNA, 23 bp, Homo sapiens
ccaaaaccccagggttcagctgg

SEQ ID NO: 16815 - DNA, 23 bp, Homo sapiens
ccaaaaccccagggtttggctgg

SEQ ID NO: 16816 - DNA, 23 bp, Homo sapiens
gccaggaagaacggcatgatagg

SEQ ID NO: 16817 - DNA, 23 bp, Homo sapiens
ctaggagacgccaatattcatgg

SEQ ID NO: 16818 - DNA, 23 bp, Homo sapiens
gacttctatttaccgcacgctgg

SEQ ID NO: 16819 - DNA, 23 bp, Homo sapiens
accgcagcggcgacagctgatgg

SEQ ID NO: 16820 - DNA, 23 bp, Homo sapiens
agtccagctggaagcttgagtgg

SEQ ID NO: 16821 - DNA, 23 bp, Homo sapiens
agccagcaatgcaaattgatggg

SEQ ID NO: 16822 - DNA, 23 bp, Homo sapiens
gccaccggctgcaaatgaagggg

SEQ ID NO: 16823 - DNA, 23 bp, Homo sapiens
gtggggctgtccaagtgacctgg

SEQ ID NO: 16824 - DNA, 23 bp, Homo sapiens
ctcacagtggatatggagatggg

SEQ ID NO: 16825 - DNA, 23 bp, Homo sapiens
tatttaaggaggtctcaacttgg

SEQ ID NO: 16826 - DNA, 23 bp, Homo sapiens
gtgggcagggcagacggctttgg

SEQ ID NO: 16827 - DNA, 23 bp, Homo sapiens
gaaagcaaggagacggcatctgg

SEQ ID NO: 16828 - DNA, 23 bp, Homo sapiens
ggttctgactcagagtgacaagg

SEQ ID NO: 16829 - DNA, 23 bp, Homo sapiens
gagaagtgcattgatgtgagagg

SEQ ID NO: 16830 - DNA, 23 bp, Homo sapiens
atccacagatgcagaataactgg

SEQ ID NO: 16831 - DNA, 23 bp, Homo sapiens
tcatgttgcacaatccctaaagg

SEQ ID NO: 16832 - DNA, 23 bp, Homo sapiens
catctatcccactgtggatcggg

SEQ ID NO: 16833 - DNA, 23 bp, Homo sapiens
cttctcatactcgctgatgatgg

SEQ ID NO: 16834 - DNA, 23 bp, Homo sapiens
gatcacagcccaagtatcacagg

SEQ ID NO: 16835 - DNA, 23 bp, Homo sapiens
gtgggaataaaaccaaccacagg

SEQ ID NO: 16836 - DNA, 23 bp, Homo sapiens
tgagtccaagctggctctagagg

SEQ ID NO: 16837 - DNA, 23 bp, Homo sapiens
aaatggggtatcagagacctagg

SEQ ID NO: 16838 - DNA, 23 bp, Homo sapiens
acagctggttctaaatatgatgg

SEQ ID NO: 16839 - DNA, 23 bp, Homo sapiens
gaactcaagaaaagatacggtgg

SEQ ID NO: 16840 - DNA, 23 bp, Homo sapiens
atcattaagtttcacggccttgg

SEQ ID NO: 16841 - DNA, 23 bp, Homo sapiens
cactgtccataaatgtgcagagg

SEQ ID NO: 16842 - DNA, 23 bp, Homo sapiens
ctcagaaacgttctcttgatcgg

SEQ ID NO: 16843 - DNA, 23 bp, Homo sapiens
gcacatttatggacagtgtcagg

SEQ ID NO: 16844 - DNA, 23 bp, Homo sapiens
aacatccctgtcacctttcatgg

SEQ ID NO: 16845 - DNA, 23 bp, Homo sapiens
taataggttgatcacagatctgg

SEQ ID NO: 16846 - DNA, 23 bp, Homo sapiens
ttctacttgtatccatttcccgg

SEQ ID NO: 16847 - DNA, 23 bp, Homo sapiens
tgaagaagcgacctgcagaaagg

SEQ ID NO: 16848 - DNA, 23 bp, Homo sapiens
catcaggttccaaaaagttctgg

SEQ ID NO: 16849 - DNA, 23 bp, Homo sapiens
cttctctctgtatttgttggtgg

SEQ ID NO: 16850 - DNA, 23 bp, Homo sapiens
tgtcctccatgctatttacaagg

SEQ ID NO: 16851 - DNA, 23 bp, Homo sapiens
acagcatgcccgcaagcaggagg

SEQ ID NO: 16852 - DNA, 23 bp, Homo sapiens
gcaatacagagatgacttggagg

SEQ ID NO: 16853 - DNA, 23 bp, Homo sapiens
gcaggccttttactttgagttgg

SEQ ID NO: 16854 - DNA, 23 bp, Homo sapiens
gaaccacgtgtcaagtgattagg

SEQ ID NO: 16855 - DNA, 23 bp, Homo sapiens
ccctccagctgcctgggctgagg

SEQ ID NO: 16856 - DNA, 23 bp, Homo sapiens
tccttgcagggtcaacagaaagg

SEQ ID NO: 16857 - DNA, 23 bp, Homo sapiens
acaactcagccctgctcatgagg

SEQ ID NO: 16858 - DNA, 23 bp, Homo sapiens
tgcggatggacatgataacttgg

SEQ ID NO: 16859 - DNA, 23 bp, Homo sapiens
ggcgggccctgcactcatgaggg

SEQ ID NO: 16860 - DNA, 23 bp, Homo sapiens
aagccccagcgcctatattaagg

SEQ ID NO: 16861 - DNA, 23 bp, Homo sapiens
ggcgggttctgcactcatgaagg

SEQ ID NO: 16862 - DNA, 23 bp, Homo sapiens
gaaacgggaatttatttgccagg

SEQ ID NO: 16863 - DNA, 23 bp, Homo sapiens
ttcctttgtgcttaactggctgg

SEQ ID NO: 16864 - DNA, 23 bp, Homo sapiens
agccaaggaagccgcagaacagg

SEQ ID NO: 16865 - DNA, 23 bp, Homo sapiens
cctcaagacccacggactcctgg

SEQ ID NO: 16866 - DNA, 23 bp, Homo sapiens
atctggcaagaaagcataagtgg

SEQ ID NO: 16867 - DNA, 23 bp, Homo sapiens
tgctcaaacccgggagacagagg

SEQ ID NO: 16868 - DNA, 23 bp, Homo sapiens
acttatattagcggtaacggtgg

SEQ ID NO: 16869 - DNA, 23 bp, Homo sapiens
tgagatgatccttacggaaaagg

SEQ ID NO: 16870 - DNA, 23 bp, Homo sapiens
cccccttcgttagtcgtatatgg

SEQ ID NO: 16871 - DNA, 23 bp, Homo sapiens
agggttagtttttgtagcctcgg

SEQ ID NO: 16872 - DNA, 23 bp, Homo sapiens
gaggcccaacaccttcttctagg

SEQ ID NO: 16873 - DNA, 23 bp, Homo sapiens
aagtgggaggttttatttcttgg

SEQ ID NO: 16874 - DNA, 23 bp, Homo sapiens
cgaagaagaggaggaagacgagg

SEQ ID NO: 16875 - DNA, 23 bp, Homo sapiens
gatggtggtgccactacttcagg

SEQ ID NO: 16876 - DNA, 23 bp, Homo sapiens
tcatgcaatgctgccagcattgg

SEQ ID NO: 16877 - DNA, 23 bp, Homo sapiens
ggctcctgattacgatgctttgg

SEQ ID NO: 16878 - DNA, 23 bp, Homo sapiens
gttggtggaaaacgctaaactgg

SEQ ID NO: 16879 - DNA, 23 bp, Homo sapiens
agaaaccattgagaagatgcagg

SEQ ID NO: 16880 - DNA, 23 bp, Homo sapiens
cgacaagttggaaaagagaaagg

SEQ ID NO: 16881 - DNA, 23 bp, Homo sapiens
agtggttcttccagaaactgcgg

SEQ ID NO: 16882 - DNA, 23 bp, Homo sapiens
ccatgtggcttcaagccaccagg

SEQ ID NO: 16883 - DNA, 23 bp, Homo sapiens
gggcggcttgtggagtgtatggg

SEQ ID NO: 16884 - DNA, 23 bp, Homo sapiens
gcagggggctcaggagctcttgg

SEQ ID NO: 16885 - DNA, 23 bp, Homo sapiens
aaaatcacagctcccagacccgg

SEQ ID NO: 16886 - DNA, 23 bp, Homo sapiens
attcctacaatcaggatttgtgg

SEQ ID NO: 16887 - DNA, 23 bp, Homo sapiens
gtgtcgtggtggtcattaagcgg

SEQ ID NO: 16888 - DNA, 23 bp, Homo sapiens
atctactctgaagcctttgtagg

SEQ ID NO: 16889 - DNA, 23 bp, Homo sapiens
gaccgaattgcaaaggaagaagg

SEQ ID NO: 16890 - DNA, 23 bp, Homo sapiens
agaagcatgccagaacagactgg

SEQ ID NO: 16891 - DNA, 23 bp, Homo sapiens
gctgtccagaaaacgtaatgagg

SEQ ID NO: 16892 - DNA, 23 bp, Homo sapiens
tccaggagggctccctttatggg

SEQ ID NO: 16893 - DNA, 23 bp, Homo sapiens
gcgcagtgaagaaaatgagtagg

SEQ ID NO: 16894 - DNA, 23 bp, Homo sapiens
aatcgttgtgaaagtgttgaagg

SEQ ID NO: 16895 - DNA, 23 bp, Homo sapiens
gtacgcggtcaaggcctgagggg

SEQ ID NO: 16896 - DNA, 23 bp, Homo sapiens
gagtgatgctgtacccctcaagg

SEQ ID NO: 16897 - DNA, 23 bp, Homo sapiens
gggaggggctcagtctttcttgg

SEQ ID NO: 16898 - DNA, 23 bp, Homo sapiens
atatccttacggcaattaactgg

SEQ ID NO: 16899 - DNA, 23 bp, Homo sapiens
taagccgattttccggaaaaagg

SEQ ID NO: 16900 - DNA, 23 bp, Homo sapiens
aagtttagaactggatcacttgg

SEQ ID NO: 16901 - DNA, 23 bp, Homo sapiens
tgctgcaacagctgccctcttgg

SEQ ID NO: 16902 - DNA, 23 bp, Homo sapiens
aagagtagaggagcgtctactgg

SEQ ID NO: 16903 - DNA, 23 bp, Homo sapiens
agttccttcactgccaaaccggg

SEQ ID NO: 16904 - DNA, 23 bp, Homo sapiens
cagtggattcggatgaaaactgg

SEQ ID NO: 16905 - DNA, 23 bp, Homo sapiens
gcattggagaagaaccaagctgg

SEQ ID NO: 16906 - DNA, 23 bp, Homo sapiens
ggagacctcgggagacttgtagg

SEQ ID NO: 16907 - DNA, 23 bp, Homo sapiens
agagaagaaacctactacagagg

SEQ ID NO: 16908 - DNA, 23 bp, Homo sapiens
cccatgttggtcctctgccctgg

SEQ ID NO: 16909 - DNA, 23 bp, Homo sapiens
cttcctcagagctcaggagcggg

SEQ ID NO: 16910 - DNA, 23 bp, Homo sapiens
tctgtgtttgctctgacgaatgg

SEQ ID NO: 16911 - DNA, 23 bp, Homo sapiens
tttttcttcattccacctcgtgg

SEQ ID NO: 16912 - DNA, 23 bp, Homo sapiens
cgccaagctcgaaaaggcaaagg

SEQ ID NO: 16913 - DNA, 23 bp, Homo sapiens
cctgggtctagttcagctgacgg

SEQ ID NO: 16914 - DNA, 23 bp, Homo sapiens
ccggggaaccaagactgtgcagg

SEQ ID NO: 16915 - DNA, 23 bp, Homo sapiens
tgaaaaaggaactgttcagcagg

SEQ ID NO: 16916 - DNA, 23 bp, Homo sapiens
tcggacgaggatatgggatttgg

SEQ ID NO: 16917 - DNA, 23 bp, Homo sapiens
tctgatgatgacatgggctttgg

SEQ ID NO: 16918 - DNA, 23 bp, Homo sapiens
tcagatgatgacatgggatttgg

SEQ ID NO: 16919 - DNA, 23 bp, Homo sapiens
aggatgcgggcaggggctacagg

SEQ ID NO: 16920 - DNA, 23 bp, Homo sapiens
caatcggatgctggcccagcagg

SEQ ID NO: 16921 - DNA, 23 bp, Homo sapiens
tgcagagcagagcagtagattgg

SEQ ID NO: 16922 - DNA, 23 bp, Homo sapiens
tttcaggatttggaagcttctgg

SEQ ID NO: 16923 - DNA, 23 bp, Homo sapiens
agatggggtgaatccatcactgg

SEQ ID NO: 16924 - DNA, 23 bp, Homo sapiens
tctgcattttctcctcaggaagg

SEQ ID NO: 16925 - DNA, 23 bp, Homo sapiens
ggttgcggacgaggatcagacgg

SEQ ID NO: 16926 - DNA, 23 bp, Homo sapiens
gctcagcaggtcttcacgatcgg

SEQ ID NO: 16927 - DNA, 23 bp, Homo sapiens
gaagggtcaaagcctgttcttgg

SEQ ID NO: 16928 - DNA, 23 bp, Homo sapiens
tccaagaaagccaagtgtgaggg

SEQ ID NO: 16929 - DNA, 23 bp, Homo sapiens
aaagcttgctgacggtcggcagg

SEQ ID NO: 16930 - DNA, 23 bp, Homo sapiens
ttggcttcagatggctgttgggg

SEQ ID NO: 16931 - DNA, 23 bp, Homo sapiens
acatctacagtgaagattgatgg

SEQ ID NO: 16932 - DNA, 23 bp, Homo sapiens
tgcagagaaagagcataaattgg

SEQ ID NO: 16933 - DNA, 23 bp, Homo sapiens
ctgttttcaactgactaggatgg

SEQ ID NO: 16934 - DNA, 23 bp, Homo sapiens
cttaaattcaatcgtcgacgtgg

SEQ ID NO: 16935 - DNA, 23 bp, Homo sapiens
tcttccctcccaggtactgatgg

SEQ ID NO: 16936 - DNA, 23 bp, Homo sapiens
ggggcagagggcgggtcagtagg

SEQ ID NO: 16937 - DNA, 23 bp, Homo sapiens
atggcgctcagtacagccccagg

SEQ ID NO: 16938 - DNA, 23 bp, Homo sapiens
ggcggatttggtcgtggacgtgg

SEQ ID NO: 16939 - DNA, 23 bp, Homo sapiens
aagcagttccagaagttctgagg

SEQ ID NO: 16940 - DNA, 23 bp, Homo sapiens
atactcttcaatgacatccttgg

SEQ ID NO: 16941 - DNA, 23 bp, Homo sapiens
acagacaaatttatgcgaccagg

SEQ ID NO: 16942 - DNA, 23 bp, Homo sapiens
tgaggaatcttgttcacagacgg

SEQ ID NO: 16943 - DNA, 23 bp, Homo sapiens
gcttcatccctctcaagtaatgg

SEQ ID NO: 16944 - DNA, 23 bp, Homo sapiens
aatcctgggattctttttctagg

SEQ ID NO: 16945 - DNA, 23 bp, Homo sapiens
ttgagtcacgatgggcttatcgg

SEQ ID NO: 16946 - DNA, 23 bp, Homo sapiens
aaaattcaaacaggtccccgagg

SEQ ID NO: 16947 - DNA, 23 bp, Homo sapiens
tttcttcttggacacacccacgg

SEQ ID NO: 16948 - DNA, 23 bp, Homo sapiens
ggcaatttattaacccagcatgg

SEQ ID NO: 16949 - DNA, 23 bp, Homo sapiens
gttggcagctgccacctgtccgg

SEQ ID NO: 16950 - DNA, 23 bp, Homo sapiens
gcaggaatacttcggcagctagg

SEQ ID NO: 16951 - DNA, 23 bp, Homo sapiens
gcggactcaggctccagctgtgg

SEQ ID NO: 16952 - DNA, 23 bp, Homo sapiens
gttgacttaagcatctgcaatgg

SEQ ID NO: 16953 - DNA, 23 bp, Homo sapiens
ggaggagaatgcagttaaaaagg

SEQ ID NO: 16954 - DNA, 23 bp, Homo sapiens
ctccgattggccaaggccgatgg

SEQ ID NO: 16955 - DNA, 23 bp, Homo sapiens
ggccctatacaaaggcaagaagg

SEQ ID NO: 16956 - DNA, 23 bp, Homo sapiens
gcaaaaagccgaaggagtaaagg

SEQ ID NO: 16957 - DNA, 23 bp, Homo sapiens
ggccatggcagtgacattagtgg

SEQ ID NO: 16958 - DNA, 23 bp, Homo sapiens
gcaaaggccaatgttggtgctgg

SEQ ID NO: 16959 - DNA, 23 bp, Homo sapiens
gctggtgaagatgcatgaatagg

SEQ ID NO: 16960 - DNA, 23 bp, Homo sapiens
ccgatgcgtgcccaaggacaagg

SEQ ID NO: 16961 - DNA, 23 bp, Homo sapiens
gtggtgattttatagcatcctgg

SEQ ID NO: 16962 - DNA, 23 bp, Homo sapiens
ttagtgctgcttcctcctgaagg

SEQ ID NO: 16963 - DNA, 23 bp, Homo sapiens
tcatacagttacttgtcttctgg

SEQ ID NO: 16964 - DNA, 23 bp, Homo sapiens
ggaaaggccagactcacagaagg

SEQ ID NO: 16965 - DNA, 23 bp, Homo sapiens
gccaagctcagcgcaacctccgg

SEQ ID NO: 16966 - DNA, 23 bp, Homo sapiens
attcactttctgcactgtgcagg

SEQ ID NO: 16967 - DNA, 23 bp, Homo sapiens
cgtcagtacgcgaaggatatcgg

SEQ ID NO: 16968 - DNA, 23 bp, Homo sapiens
ccagtccccacagcataacaggg

SEQ ID NO: 16969 - DNA, 23 bp, Homo sapiens
gttatgctgtggggactggctgg

SEQ ID NO: 16970 - DNA, 23 bp, Homo sapiens
gctaaagttgaacgagctgatgg

SEQ ID NO: 16971 - DNA, 23 bp, Homo sapiens
agtcatttgtctgcacctctcgg

SEQ ID NO: 16972 - DNA, 23 bp, Homo sapiens
aaacagagcagtgggtgaaatgg

SEQ ID NO: 16973 - DNA, 23 bp, Homo sapiens
ctggccaccaaacagagcagtgg

SEQ ID NO: 16974 - DNA, 23 bp, Homo sapiens
ctggctgccaaacagagcagtgg

SEQ ID NO: 16975 - DNA, 23 bp, Homo sapiens
gcagcagctgggaaaatcagcgg

SEQ ID NO: 16976 - DNA, 23 bp, Homo sapiens
agaagtagaagctcgcagagagg

SEQ ID NO: 16977 - DNA, 23 bp, Homo sapiens
cgaatgccctggtgcctcacagg

SEQ ID NO: 16978 - DNA, 23 bp, Homo sapiens
cacgtccacgcggctgtagcggg

SEQ ID NO: 16979 - DNA, 23 bp, Homo sapiens
tctcactgaggtcacttcacagg

SEQ ID NO: 16980 - DNA, 23 bp, Homo sapiens
tcacagtggtggggattaggagg

SEQ ID NO: 16981 - DNA, 23 bp, Homo sapiens
atccagtgattttatacctcagg

SEQ ID NO: 16982 - DNA, 23 bp, Homo sapiens
gttctcggactcagtagcttagg

SEQ ID NO: 16983 - DNA, 23 bp, Homo sapiens
aggaacaccacaaatcttacagg

SEQ ID NO: 16984 - DNA, 23 bp, Homo sapiens
cgatcacctcgaagatttattgg

SEQ ID NO: 16985 - DNA, 23 bp, Homo sapiens
tctgtcatagattcatacgcagg

SEQ ID NO: 16986 - DNA, 23 bp, Homo sapiens
ccgtgggcgtccagggcgctagg

SEQ ID NO: 16987 - DNA, 23 bp, Homo sapiens
attttttacccctgtggattggg

SEQ ID NO: 16988 - DNA, 23 bp, Homo sapiens
agcaagctggtggggtaagaggg

SEQ ID NO: 16989 - DNA, 23 bp, Homo sapiens
ctataagaagctcacgggcaagg

SEQ ID NO: 16990 - DNA, 23 bp, Homo sapiens
aaggatttatttgcctttgcggg

SEQ ID NO: 16991 - DNA, 23 bp, Homo sapiens
ggctggagacgacgaggaggagg

SEQ ID NO: 16992 - DNA, 23 bp, Homo sapiens
ggatgttcaccacctgcttgcgg

SEQ ID NO: 16993 - DNA, 23 bp, Homo sapiens
ctggagcgctcagcctgccacgg

SEQ ID NO: 16994 - DNA, 23 bp, Homo sapiens
tttgcctgtctcatctctgatgg

SEQ ID NO: 16995 - DNA, 23 bp, Homo sapiens
tggagaagcgtgtcagatagcgg

SEQ ID NO: 16996 - DNA, 23 bp, Homo sapiens
ccccacggctctcagctgtccgg

SEQ ID NO: 16997 - DNA, 23 bp, Homo sapiens
gagcggcttcagcagcactttgg

SEQ ID NO: 16998 - DNA, 23 bp, Homo sapiens
atgactggcaaaaggactgaggg

SEQ ID NO: 16999 - DNA, 23 bp, Homo sapiens
agagggaggactattgtaagcgg

SEQ ID NO: 17000 - DNA, 23 bp, Homo sapiens
gtctgaggagggcttcatccagg

SEQ ID NO: 17001 - DNA, 23 bp, Homo sapiens
tggggcttgttgttctcagctgg

SEQ ID NO: 17002 - DNA, 23 bp, Homo sapiens
aacaatgaagccaagtgtctggg

SEQ ID NO: 17003 - DNA, 23 bp, Homo sapiens
ccacgacctctcggttctctagg

SEQ ID NO: 17004 - DNA, 23 bp, Homo sapiens
ttggcaatattcaacgcataagg

SEQ ID NO: 17005 - DNA, 23 bp, Homo sapiens
cgcatgagaagacactgctttgg

SEQ ID NO: 17006 - DNA, 23 bp, Homo sapiens
acgctgggattcagactagatgg

SEQ ID NO: 17007 - DNA, 23 bp, Homo sapiens
gacccctagagtgctgctgtagg

SEQ ID NO: 17008 - DNA, 23 bp, Homo sapiens
ttctctcttgcctgggctacagg

SEQ ID NO: 17009 - DNA, 23 bp, Homo sapiens
ttgtctttttctttccgtgttgg

SEQ ID NO: 17010 - DNA, 23 bp, Homo sapiens
caaagaggaaactcagacagagg

SEQ ID NO: 17011 - DNA, 23 bp, Homo sapiens
cgcctcccagctcgtggggatgg

SEQ ID NO: 17012 - DNA, 23 bp, Homo sapiens
tctcaaaacccattggcttctgg

SEQ ID NO: 17013 - DNA, 23 bp, Homo sapiens
tgtctgatgtgtggatcctgagg

SEQ ID NO: 17014 - DNA, 23 bp, Homo sapiens
catttagaagtcagcatccaagg

SEQ ID NO: 17015 - DNA, 23 bp, Homo sapiens
cacagataacgtcttcaccttgg

SEQ ID NO: 17016 - DNA, 23 bp, Homo sapiens
tcacaaatttctgccgtcagagg

SEQ ID NO: 17017 - DNA, 23 bp, Homo sapiens
gggtcaggctctttctgttctgg

SEQ ID NO: 17018 - DNA, 23 bp, Homo sapiens
agatgggcaggagctcagcatgg

SEQ ID NO: 17019 - DNA, 23 bp, Homo sapiens
aagaaacgcagggagtgatgtgg

SEQ ID NO: 17020 - DNA, 23 bp, Homo sapiens
agaaaggatcgtcgaccctgagg

SEQ ID NO: 17021 - DNA, 23 bp, Homo sapiens
tcagagtcacttgcagattctgg

SEQ ID NO: 17022 - DNA, 23 bp, Homo sapiens
agggctatggatttcttctgagg

SEQ ID NO: 17023 - DNA, 23 bp, Homo sapiens
gacgaaatgcaggcaaggacagg

SEQ ID NO: 17024 - DNA, 23 bp, Homo sapiens
gcggctctcacagctcagtacgg

SEQ ID NO: 17025 - DNA, 23 bp, Homo sapiens
agccatgtctctacaagcgcagg

SEQ ID NO: 17026 - DNA, 23 bp, Homo sapiens
gagtgtcaggaaccagcagctgg

SEQ ID NO: 17027 - DNA, 23 bp, Homo sapiens
agcgcccaggaggaaagaggagg

SEQ ID NO: 17028 - DNA, 23 bp, Homo sapiens
tgccatccggatggagctgctgg

SEQ ID NO: 17029 - DNA, 23 bp, Homo sapiens
gaacatttttgtcatcctcctgg

SEQ ID NO: 17030 - DNA, 23 bp, Homo sapiens
ctgaagctggattggtagagcgg

SEQ ID NO: 17031 - DNA, 23 bp, Homo sapiens
atgtacatatcacacagaagtgg

SEQ ID NO: 17032 - DNA, 23 bp, Homo sapiens
tcaactagacttagatttccagg

SEQ ID NO: 17033 - DNA, 23 bp, Homo sapiens
ccactttcccacagtcatgtagg

SEQ ID NO: 17034 - DNA, 23 bp, Homo sapiens
ggcaggagcaccagaagaggagg

SEQ ID NO: 17035 - DNA, 23 bp, Homo sapiens
caaccactcgtgactcattcagg

SEQ ID NO: 17036 - DNA, 23 bp, Homo sapiens
atcactgactttaggtcgactgg

SEQ ID NO: 17037 - DNA, 23 bp, Homo sapiens
gttacaagaggatgtggacatgg

SEQ ID NO: 17038 - DNA, 23 bp, Homo sapiens
ggctcacttcatcttagtcctgg

SEQ ID NO: 17039 - DNA, 23 bp, Homo sapiens
tttcttcttcttgctggtgatgg

SEQ ID NO: 17040 - DNA, 23 bp, Homo sapiens
tttgaactcgatgacactgatgg

SEQ ID NO: 17041 - DNA, 23 bp, Homo sapiens
gaggaagaattgtcataggaggg

SEQ ID NO: 17042 - DNA, 23 bp, Homo sapiens
atctgaggaagatgaagatgagg

SEQ ID NO: 17043 - DNA, 23 bp, Homo sapiens
ggagcatatgccttctccaatgg

SEQ ID NO: 17044 - DNA, 23 bp, Homo sapiens
ggcgaggagacagatgactgagg

SEQ ID NO: 17045 - DNA, 23 bp, Homo sapiens
ctgtttaaaaacatccaggctgg

SEQ ID NO: 17046 - DNA, 23 bp, Homo sapiens
ttgcccttcatgctatagaatgg

SEQ ID NO: 17047 - DNA, 23 bp, Homo sapiens
gctggacagtgtccctaggcagg

SEQ ID NO: 17048 - DNA, 23 bp, Homo sapiens
taccggatctcttgttttattgg

SEQ ID NO: 17049 - DNA, 23 bp, Homo sapiens
agtcagcactgtacactagaggg

SEQ ID NO: 17050 - DNA, 23 bp, Homo sapiens
gagccggcggtcagggctgcagg

SEQ ID NO: 17051 - DNA, 23 bp, Homo sapiens
tggacacactggcagtaatacgg

SEQ ID NO: 17052 - DNA, 23 bp, Homo sapiens
ttctttacgacacaatgggcagg

SEQ ID NO: 17053 - DNA, 23 bp, Homo sapiens
atgtatattacttaggccacagg

SEQ ID NO: 17054 - DNA, 23 bp, Homo sapiens
cacatcttcaatgcgaggaatgg

SEQ ID NO: 17055 - DNA, 23 bp, Homo sapiens
aaaaaagtccatatggactgtgg

SEQ ID NO: 17056 - DNA, 23 bp, Homo sapiens
ctggcagccaagaacagataagg

SEQ ID NO: 17057 - DNA, 23 bp, Homo sapiens
cagggccacgcgtccgctagggg

SEQ ID NO: 17058 - DNA, 23 bp, Homo sapiens
gtaggaggttgggctagggaagg

SEQ ID NO: 17059 - DNA, 23 bp, Homo sapiens
gatttgtcatcccaattccttgg

SEQ ID NO: 17060 - DNA, 23 bp, Homo sapiens
agaccaattgctgtgatcaaagg

SEQ ID NO: 17061 - DNA, 23 bp, Homo sapiens
gcaggctgggcacatcctagagg

SEQ ID NO: 17062 - DNA, 23 bp, Homo sapiens
gggcctccgtgggcactcactgg

SEQ ID NO: 17063 - DNA, 23 bp, Homo sapiens
aagactacaaaaaacgacgaggg

SEQ ID NO: 17064 - DNA, 23 bp, Homo sapiens
gtgcgggcttcagaagcagtagg

SEQ ID NO: 17065 - DNA, 23 bp, Homo sapiens
tgtgcttttgggagccaagttgg

SEQ ID NO: 17066 - DNA, 23 bp, Homo sapiens
agcacctttctctctcacactgg

SEQ ID NO: 17067 - DNA, 23 bp, Homo sapiens
ggaccctagatcatggctgcagg

SEQ ID NO: 17068 - DNA, 23 bp, Homo sapiens
tgatactgatgtggtgaatgtgg

SEQ ID NO: 17069 - DNA, 23 bp, Homo sapiens
cagggaggcgtcttcagtcgagg

SEQ ID NO: 17070 - DNA, 23 bp, Homo sapiens
ctgggctgtgttcagaacccagg

SEQ ID NO: 17071 - DNA, 23 bp, Homo sapiens
atccaggcctgccagtaaggggg

SEQ ID NO: 17072 - DNA, 23 bp, Homo sapiens
ctttcctggtctcctcttactgg

SEQ ID NO: 17073 - DNA, 23 bp, Homo sapiens
ccagcactcaaactcgaattcgg

SEQ ID NO: 17074 - DNA, 23 bp, Homo sapiens
attcttaaagattccgtgctcgg

SEQ ID NO: 17075 - DNA, 23 bp, Homo sapiens
cttaagccctggcagctatgtgg

SEQ ID NO: 17076 - DNA, 23 bp, Homo sapiens
cgcatctcaccaacagactgtgg

SEQ ID NO: 17077 - DNA, 23 bp, Homo sapiens
gaggacgaggacttctaggccgg

SEQ ID NO: 17078 - DNA, 23 bp, Homo sapiens
aacctcttgtgttcttgcctagg

SEQ ID NO: 17079 - DNA, 23 bp, Homo sapiens
ttccatggagttttacttgttgg

SEQ ID NO: 17080 - DNA, 23 bp, Homo sapiens
ctaaaatcccaggcgctaagagg

SEQ ID NO: 17081 - DNA, 23 bp, Homo sapiens
gcagagacaccgttctcattcgg

SEQ ID NO: 17082 - DNA, 23 bp, Homo sapiens
ccctggaatcgccaaaaaaaagg

SEQ ID NO: 17083 - DNA, 23 bp, Homo sapiens
cgtcgttacttgtactatgaagg

SEQ ID NO: 17084 - DNA, 23 bp, Homo sapiens
tgcttgatactgagggttaaagg

SEQ ID NO: 17085 - DNA, 23 bp, Homo sapiens
tcagctttgcgcttcaatccagg

SEQ ID NO: 17086 - DNA, 23 bp, Homo sapiens
gtggaaagaggacacgcacgagg

SEQ ID NO: 17087 - DNA, 23 bp, Homo sapiens
tgtgtccgctgggggtcagcagg

SEQ ID NO: 17088 - DNA, 23 bp, Homo sapiens
ctgacgccctgggtcctcagcgg

SEQ ID NO: 17089 - DNA, 23 bp, Homo sapiens
gatctcagcaccgcagtcagagg

SEQ ID NO: 17090 - DNA, 23 bp, Homo sapiens
cccaaccacggaatcttatacgg

SEQ ID NO: 17091 - DNA, 23 bp, Homo sapiens
tcagtcctgccttcttttagtgg

SEQ ID NO: 17092 - DNA, 23 bp, Homo sapiens
tgtcattctcattgttatcgtgg

SEQ ID NO: 17093 - DNA, 23 bp, Homo sapiens
ataaagacacagatgttcagtgg

SEQ ID NO: 17094 - DNA, 23 bp, Homo sapiens
tcggggcgtcacacttgctgcgg

SEQ ID NO: 17095 - DNA, 23 bp, Homo sapiens
atggcactcaggaagaattaagg

SEQ ID NO: 17096 - DNA, 23 bp, Homo sapiens
ctgcacgtgctttcttcaggtgg

SEQ ID NO: 17097 - DNA, 23 bp, Homo sapiens
ggggcatcatgttgctgcagagg

SEQ ID NO: 17098 - DNA, 23 bp, Homo sapiens
cagtctttttcacagtactcagg

SEQ ID NO: 17099 - DNA, 23 bp, Homo sapiens
cctgaggacggacgttcaggagg

SEQ ID NO: 17100 - DNA, 23 bp, Homo sapiens
cacgcaggaccagtacaagctgg

SEQ ID NO: 17101 - DNA, 23 bp, Homo sapiens
ctgaatgagcagtgcatgacagg

SEQ ID NO: 17102 - DNA, 23 bp, Homo sapiens
ggaagagaagactaatcagatgg

SEQ ID NO: 17103 - DNA, 23 bp, Homo sapiens
actgatcccaaaacatcattagg

SEQ ID NO: 17104 - DNA, 23 bp, Homo sapiens
cttggcctccagtcttatgatgg

SEQ ID NO: 17105 - DNA, 23 bp, Homo sapiens
ttggtcttggtcaggtgacctgg

SEQ ID NO: 17106 - DNA, 23 bp, Homo sapiens
gttagggcactctcatcaaaagg

SEQ ID NO: 17107 - DNA, 23 bp, Homo sapiens
gaagctcagagccaaattagtgg

SEQ ID NO: 17108 - DNA, 23 bp, Homo sapiens
tgcccatgctgttcctcagctgg

SEQ ID NO: 17109 - DNA, 23 bp, Homo sapiens
tttcaggatggagttaggcctgg

SEQ ID NO: 17110 - DNA, 23 bp, Homo sapiens
acagcaccctggagatgttaagg

SEQ ID NO: 17111 - DNA, 23 bp, Homo sapiens
gccaggcctggcgcctcagtagg

SEQ ID NO: 17112 - DNA, 23 bp, Homo sapiens
ttctgagttcacgtctagcgagg

SEQ ID NO: 17113 - DNA, 23 bp, Homo sapiens
actgctgaggaatttcaatatgg

SEQ ID NO: 17114 - DNA, 23 bp, Homo sapiens
agtccaccagggcggtcagtagg

SEQ ID NO: 17115 - DNA, 23 bp, Homo sapiens
ggtcccagggctacagaacaagg

SEQ ID NO: 17116 - DNA, 23 bp, Homo sapiens
cctggaagcagccaaaactgagg

SEQ ID NO: 17117 - DNA, 23 bp, Homo sapiens
aagcatgttcattgagtcatggg

SEQ ID NO: 17118 - DNA, 23 bp, Homo sapiens
acttcatgtacttatcctgctgg

SEQ ID NO: 17119 - DNA, 23 bp, Homo sapiens
attttagcaagcaagttggccgg

SEQ ID NO: 17120 - DNA, 23 bp, Homo sapiens
accatggacacctcctgagttgg

SEQ ID NO: 17121 - DNA, 23 bp, Homo sapiens
agagtgactcagctgactaatgg

SEQ ID NO: 17122 - DNA, 23 bp, Homo sapiens
ctcatggtgactatggattaagg

SEQ ID NO: 17123 - DNA, 23 bp, Homo sapiens
cagatgttctttggtgtagaagg

SEQ ID NO: 17124 - DNA, 23 bp, Homo sapiens
aaagtagatgtggactcaagtgg

SEQ ID NO: 17125 - DNA, 23 bp, Homo sapiens
ctccgaatttgtacttgctctgg

SEQ ID NO: 17126 - DNA, 23 bp, Homo sapiens
tttaactttttggcaccttgagg

SEQ ID NO: 17127 - DNA, 23 bp, Homo sapiens
tttaagcaaaactggctctaagg

SEQ ID NO: 17128 - DNA, 23 bp, Homo sapiens
tttcagagtcagtcatgaatagg

SEQ ID NO: 17129 - DNA, 23 bp, Homo sapiens
ctcctcttccctgaaacttgggg

SEQ ID NO: 17130 - DNA, 23 bp, Homo sapiens
ggcctgaggcctgcgtcagtagg

SEQ ID NO: 17131 - DNA, 23 bp, Homo sapiens
acctggacagagggacacccggg

SEQ ID NO: 17132 - DNA, 23 bp, Homo sapiens
ggcgccgcaccaaatgacttagg

SEQ ID NO: 17133 - DNA, 23 bp, Homo sapiens
tctgagctcaggccagttgatgg

SEQ ID NO: 17134 - DNA, 23 bp, Homo sapiens
ggggctcaggtgatctgcagcgg

SEQ ID NO: 17135 - DNA, 23 bp, Homo sapiens
actgctgacatgtcgccctttgg

SEQ ID NO: 17136 - DNA, 23 bp, Homo sapiens
attggagaggagtcagacgtagg

SEQ ID NO: 17137 - DNA, 23 bp, Homo sapiens
tgggggtgtgtcagctaagctgg

SEQ ID NO: 17138 - DNA, 23 bp, Homo sapiens
gggtctgagtttaatttagctgg

SEQ ID NO: 17139 - DNA, 23 bp, Homo sapiens
ttgtttacgaaagcagtcaccgg

SEQ ID NO: 17140 - DNA, 23 bp, Homo sapiens
ggcctgtaacaatttcttctggg

SEQ ID NO: 17141 - DNA, 23 bp, Homo sapiens
gaagcagaagggaaagaagtagg

SEQ ID NO: 17142 - DNA, 23 bp, Homo sapiens
ccttcccagaagcggacctgagg

SEQ ID NO: 17143 - DNA, 23 bp, Homo sapiens
ttaccacacccacaaagagtagg

SEQ ID NO: 17144 - DNA, 23 bp, Homo sapiens
agaagaaagacctgaagatcagg

SEQ ID NO: 17145 - DNA, 23 bp, Homo sapiens
gagggagttctcagtgcccccgg

SEQ ID NO: 17146 - DNA, 23 bp, Homo sapiens
tgctctgctgctcctgctcatgg

SEQ ID NO: 17147 - DNA, 23 bp, Homo sapiens
caagagttctgcttcagggtcgg

SEQ ID NO: 17148 - DNA, 23 bp, Homo sapiens
ccccctggagcagaggctactgg

SEQ ID NO: 17149 - DNA, 23 bp, Homo sapiens
gaggagttttcatttcttcctgg

SEQ ID NO: 17150 - DNA, 23 bp, Homo sapiens
ctagaggacaacaagtgaccagg

SEQ ID NO: 17151 - DNA, 23 bp, Homo sapiens
atctacaatgaagccctcaaggg

SEQ ID NO: 17152 - DNA, 23 bp, Homo sapiens
cattggtggggctgggtcactgg

SEQ ID NO: 17153 - DNA, 23 bp, Homo sapiens
gtgaccctgtggaagtgagaagg

SEQ ID NO: 17154 - DNA, 23 bp, Homo sapiens
cctgggtagggtgggatcactgg

SEQ ID NO: 17155 - DNA, 23 bp, Homo sapiens
agtaactcagctactctttgtgg

SEQ ID NO: 17156 - DNA, 23 bp, Homo sapiens
cttggccactgtggtcttagggg

SEQ ID NO: 17157 - DNA, 23 bp, Homo sapiens
actcatgttcaaagaactcgtgg

SEQ ID NO: 17158 - DNA, 23 bp, Homo sapiens
gaactggacaagaatggagatgg

SEQ ID NO: 17159 - DNA, 23 bp, Homo sapiens
cacaagtactttgagaaggcagg

SEQ ID NO: 17160 - DNA, 23 bp, Homo sapiens
aattaactgtacgagaagtctgg

SEQ ID NO: 17161 - DNA, 23 bp, Homo sapiens
taatgaattcgtggtcatggtgg

SEQ ID NO: 17162 - DNA, 23 bp, Homo sapiens
ccagagaccattatgtcttctgg

SEQ ID NO: 17163 - DNA, 23 bp, Homo sapiens
agggcaacacggtggtctgaggg

SEQ ID NO: 17164 - DNA, 23 bp, Homo sapiens
agaacgcagcacttcagaatggg

SEQ ID NO: 17165 - DNA, 23 bp, Homo sapiens
acttcagatgctccgcacgctgg

SEQ ID NO: 17166 - DNA, 23 bp, Homo sapiens
cgagggtgtcagtctgcagccgg

SEQ ID NO: 17167 - DNA, 23 bp, Homo sapiens
gaggaagctcagtatttctcagg

SEQ ID NO: 17168 - DNA, 23 bp, Homo sapiens
aaggggacctgggggtgcctggg

SEQ ID NO: 17169 - DNA, 23 bp, Homo sapiens
caggaagctcagtatttcttagg

SEQ ID NO: 17170 - DNA, 23 bp, Homo sapiens
taagtctgaaccttcaaacttgg

SEQ ID NO: 17171 - DNA, 23 bp, Homo sapiens
cctgggtccccagcctgaggagg

SEQ ID NO: 17172 - DNA, 23 bp, Homo sapiens
cttttctttctggaccagtctgg

SEQ ID NO: 17173 - DNA, 23 bp, Homo sapiens
tgaggttgctatgagggtgatgg

SEQ ID NO: 17174 - DNA, 23 bp, Homo sapiens
cctgtccccttccttcatgaagg

SEQ ID NO: 17175 - DNA, 23 bp, Homo sapiens
tgccaaatcttgagttcacttgg

SEQ ID NO: 17176 - DNA, 23 bp, Homo sapiens
tttggcacaggaaattgtgaagg

SEQ ID NO: 17177 - DNA, 23 bp, Homo sapiens
ggattccaagtactcagtagcgg

SEQ ID NO: 17178 - DNA, 23 bp, Homo sapiens
cagcgagtgggacttagtagcgg

SEQ ID NO: 17179 - DNA, 23 bp, Homo sapiens
atgcaggagaagctgaggagggg

SEQ ID NO: 17180 - DNA, 23 bp, Homo sapiens
tgtgcttaacttttctgagatgg

SEQ ID NO: 17181 - DNA, 23 bp, Homo sapiens
ccgcttcgtggaggacagcaagg

SEQ ID NO: 17182 - DNA, 23 bp, Homo sapiens
gtacagaaaaacaggctcatggg

SEQ ID NO: 17183 - DNA, 23 bp, Homo sapiens
ttgctacttcttgtctatgatgg

SEQ ID NO: 17184 - DNA, 23 bp, Homo sapiens
atcgaggataacaaggagattgg

SEQ ID NO: 17185 - DNA, 23 bp, Homo sapiens
acaagattgcggtcagctaaggg

SEQ ID NO: 17186 - DNA, 23 bp, Homo sapiens
gatgaccccgatggcttcttagg

SEQ ID NO: 17187 - DNA, 23 bp, Homo sapiens
cagctaggacattttcccgaagg

SEQ ID NO: 17188 - DNA, 23 bp, Homo sapiens
ccttcccagcctctgtgttgagg

SEQ ID NO: 17189 - DNA, 23 bp, Homo sapiens
attaggacagacaggagtcaggg

SEQ ID NO: 17190 - DNA, 23 bp, Homo sapiens
cttcttctcgcaccttcagctgg

SEQ ID NO: 17191 - DNA, 23 bp, Homo sapiens
tttaaatgctttgtctgcagagg

SEQ ID NO: 17192 - DNA, 23 bp, Homo sapiens
aggaggccaagaagagctagggg

SEQ ID NO: 17193 - DNA, 23 bp, Homo sapiens
taccttgcactgaaccatagggg

SEQ ID NO: 17194 - DNA, 23 bp, Homo sapiens
ttggcatgctattaagtgagtgg

SEQ ID NO: 17195 - DNA, 23 bp, Homo sapiens
tctcgtcttcagcttctagatgg

SEQ ID NO: 17196 - DNA, 23 bp, Homo sapiens
caaaacctccaccatctgacggg

SEQ ID NO: 17197 - DNA, 23 bp, Homo sapiens
ccgtcgagggatctctgctgagg

SEQ ID NO: 17198 - DNA, 23 bp, Homo sapiens
tagcggctctgtgatgacttcgg

SEQ ID NO: 17199 - DNA, 23 bp, Homo sapiens
attcctaaaggaattgagcgagg

SEQ ID NO: 17200 - DNA, 23 bp, Homo sapiens
agagtaggagagcaaggatttgg

SEQ ID NO: 17201 - DNA, 23 bp, Homo sapiens
ttagtgcttctatgcgtattagg

SEQ ID NO: 17202 - DNA, 23 bp, Homo sapiens
ataagcaagtgggcctccaatgg

SEQ ID NO: 17203 - DNA, 23 bp, Homo sapiens
acttctatatcatatgccagagg

SEQ ID NO: 17204 - DNA, 23 bp, Homo sapiens
ctgactacagacattcacattgg

SEQ ID NO: 17205 - DNA, 23 bp, Homo sapiens
cctgtaggggtgtcggctacagg

SEQ ID NO: 17206 - DNA, 23 bp, Homo sapiens
ggaatgcgtgttcagtcacttgg

SEQ ID NO: 17207 - DNA, 23 bp, Homo sapiens
agtgtccaaattgaagcgaaagg

SEQ ID NO: 17208 - DNA, 23 bp, Homo sapiens
tatggtctcatgcgccctgaagg

SEQ ID NO: 17209 - DNA, 23 bp, Homo sapiens
cctgagaaggctatggacaatgg

SEQ ID NO: 17210 - DNA, 23 bp, Homo sapiens
ggttgatagtggtgttcactagg

SEQ ID NO: 17211 - DNA, 23 bp, Homo sapiens
tggcccctcaggtcactgcttgg

SEQ ID NO: 17212 - DNA, 23 bp, Homo sapiens
ggtggcaagcagcttgagtgagg

SEQ ID NO: 17213 - DNA, 23 bp, Homo sapiens
gtgagaggagggtttagacacgg

SEQ ID NO: 17214 - DNA, 23 bp, Homo sapiens
ggcccacaaggactagatgaagg

SEQ ID NO: 17215 - DNA, 23 bp, Homo sapiens
caatatactgggagagccagcgg

SEQ ID NO: 17216 - DNA, 23 bp, Homo sapiens
caatgtactgtgccatccagcgg

SEQ ID NO: 17217 - DNA, 23 bp, Homo sapiens
ctttctactttatcgtctcctgg

SEQ ID NO: 17218 - DNA, 23 bp, Homo sapiens
gggtgaagggaatctactgaggg

SEQ ID NO: 17219 - DNA, 23 bp, Homo sapiens
gaactggggactggttaggttgg

SEQ ID NO: 17220 - DNA, 23 bp, Homo sapiens
ggaaaagagcagagcgctttggg

SEQ ID NO: 17221 - DNA, 23 bp, Homo sapiens
aaacaggctgcagaacatggagg

SEQ ID NO: 17222 - DNA, 23 bp, Homo sapiens
gtgggttcttagcttacagcagg

SEQ ID NO: 17223 - DNA, 23 bp, Homo sapiens
ggcgggagggcgctgtcacttgg

SEQ ID NO: 17224 - DNA, 23 bp, Homo sapiens
ctgtttctgagaaagtgaacggg

SEQ ID NO: 17225 - DNA, 23 bp, Homo sapiens
ggccctgaggccatgtagccagg

SEQ ID NO: 17226 - DNA, 23 bp, Homo sapiens
ctggccggggcaccttgaggtgg

SEQ ID NO: 17227 - DNA, 23 bp, Homo sapiens
taactgtttggtaactgcccagg

SEQ ID NO: 17228 - DNA, 23 bp, Homo sapiens
aaaatggcaacagaggagtgagg

SEQ ID NO: 17229 - DNA, 23 bp, Homo sapiens
gaggcaacgagaaagttggcagg

SEQ ID NO: 17230 - DNA, 23 bp, Homo sapiens
gaagaagagctgtcagtggaagg

SEQ ID NO: 17231 - DNA, 23 bp, Homo sapiens
tatctctggtcaatttcggcagg

SEQ ID NO: 17232 - DNA, 23 bp, Homo sapiens
gcagttacattgagttgtgatgg

SEQ ID NO: 17233 - DNA, 23 bp, Homo sapiens
cagtggtatgcccaacaacatgg

SEQ ID NO: 17234 - DNA, 23 bp, Homo sapiens
aaaccccaaccagagggagttgg

SEQ ID NO: 17235 - DNA, 23 bp, Homo sapiens
caagattattcctgcagtgaagg

SEQ ID NO: 17236 - DNA, 23 bp, Homo sapiens
gcttgcatggaacataatagagg

SEQ ID NO: 17237 - DNA, 23 bp, Homo sapiens
gagacccctggcagggagatagg

SEQ ID NO: 17238 - DNA, 23 bp, Homo sapiens
aactaaaggcaaaggttctttgg

SEQ ID NO: 17239 - DNA, 23 bp, Homo sapiens
gggaggctcaggcgtccgacagg

SEQ ID NO: 17240 - DNA, 23 bp, Homo sapiens
aggcatcagagatacaactctgg

SEQ ID NO: 17241 - DNA, 23 bp, Homo sapiens
gactcagacgcagatctcgatgg

SEQ ID NO: 17242 - DNA, 23 bp, Homo sapiens
gagcggtggaagaggaggctggg

SEQ ID NO: 17243 - DNA, 23 bp, Homo sapiens
gatgggggagctccctgaccagg

SEQ ID NO: 17244 - DNA, 23 bp, Homo sapiens
tcttcatgcgttgctcaagttgg

SEQ ID NO: 17245 - DNA, 23 bp, Homo sapiens
cgcctaaaggcgtgtcagagagg

SEQ ID NO: 17246 - DNA, 23 bp, Homo sapiens
gccaacatcatgccctaaactgg

SEQ ID NO: 17247 - DNA, 23 bp, Homo sapiens
gaacagctggacaagaacactgg

SEQ ID NO: 17248 - DNA, 23 bp, Homo sapiens
cgcagcagccattcaggaaatgg

SEQ ID NO: 17249 - DNA, 23 bp, Homo sapiens
gctggccagggctctcagagagg

SEQ ID NO: 17250 - DNA, 23 bp, Homo sapiens
ggggagccaaaagaaaactctgg

SEQ ID NO: 17251 - DNA, 23 bp, Homo sapiens
acaaattccagtctctaacgagg

SEQ ID NO: 17252 - DNA, 23 bp, Homo sapiens
tagaaagcacagaaactgagggg

SEQ ID NO: 17253 - DNA, 23 bp, Homo sapiens
cacgtttcgaacatccagaatgg

SEQ ID NO: 17254 - DNA, 23 bp, Homo sapiens
gcagctcagaatgctttcaaggg

SEQ ID NO: 17255 - DNA, 23 bp, Homo sapiens
gagaggaggactaattcccctgg

SEQ ID NO: 17256 - DNA, 23 bp, Homo sapiens
gcatcccagtcaggggtcacggg

SEQ ID NO: 17257 - DNA, 23 bp, Homo sapiens
ggcccctcgccgcatcgttgggg

SEQ ID NO: 17258 - DNA, 23 bp, Homo sapiens
gtggctggttcacatctcattgg

SEQ ID NO: 17259 - DNA, 23 bp, Homo sapiens
tgtgcgcatcactggctgagcgg

SEQ ID NO: 17260 - DNA, 23 bp, Homo sapiens
gccctctgtgctggagaagctgg

SEQ ID NO: 17261 - DNA, 23 bp, Homo sapiens
aaactgtcgagcttcttcccagg

SEQ ID NO: 17262 - DNA, 23 bp, Homo sapiens
agccagagcttctactgaggagg

SEQ ID NO: 17263 - DNA, 23 bp, Homo sapiens
cgcaatgtcaccatcctacgagg

SEQ ID NO: 17264 - DNA, 23 bp, Homo sapiens
gtgtctgttgcatgtcacgctgg

SEQ ID NO: 17265 - DNA, 23 bp, Homo sapiens
cagctgggaggctcaggctgtgg

SEQ ID NO: 17266 - DNA, 23 bp, Homo sapiens
gctgcaggaagcaaaactgtagg

SEQ ID NO: 17267 - DNA, 23 bp, Homo sapiens
gcaatgtttaggttcgaatgagg

SEQ ID NO: 17268 - DNA, 23 bp, Homo sapiens
attcaaggtcatcagggttctgg

SEQ ID NO: 17269 - DNA, 23 bp, Homo sapiens
cgcgcacctccagcctagctcgg

SEQ ID NO: 17270 - DNA, 23 bp, Homo sapiens
gacgagccacagcctgctacagg

SEQ ID NO: 17271 - DNA, 23 bp, Homo sapiens
attgacagactcaacaaacacgg

SEQ ID NO: 17272 - DNA, 23 bp, Homo sapiens
ggagatggaaactacaagagtgg

SEQ ID NO: 17273 - DNA, 23 bp, Homo sapiens
agcactgctgtctccagtcctgg

SEQ ID NO: 17274 - DNA, 23 bp, Homo sapiens
tgtccctggaggtattctgaagg

SEQ ID NO: 17275 - DNA, 23 bp, Homo sapiens
tacaagcgggtgatagtatttgg

SEQ ID NO: 17276 - DNA, 23 bp, Homo sapiens
attgtttttgtggtgggaggagg

SEQ ID NO: 17277 - DNA, 23 bp, Homo sapiens
tagcggatgctcagaagccaagg

SEQ ID NO: 17278 - DNA, 23 bp, Homo sapiens
gcatattgctaagagagcaatgg

SEQ ID NO: 17279 - DNA, 23 bp, Homo sapiens
gctgctataaatgcgcttgatgg

SEQ ID NO: 17280 - DNA, 23 bp, Homo sapiens
ctagcatcttctctttactctgg

SEQ ID NO: 17281 - DNA, 23 bp, Homo sapiens
gctaattacacagtgagctttgg

SEQ ID NO: 17282 - DNA, 23 bp, Homo sapiens
cagtcaggacggtgcctaagtgg

SEQ ID NO: 17283 - DNA, 23 bp, Homo sapiens
gaagaaatgcgtggatacgatgg

SEQ ID NO: 17284 - DNA, 23 bp, Homo sapiens
aagcctcattgcggaagtcctgg

SEQ ID NO: 17285 - DNA, 23 bp, Homo sapiens
gactctcattgaaaaagtcctgg

SEQ ID NO: 17286 - DNA, 23 bp, Homo sapiens
atacagtgtacgacagcatttgg

SEQ ID NO: 17287 - DNA, 23 bp, Homo sapiens
tgaaactctgagcaatgttgagg

SEQ ID NO: 17288 - DNA, 23 bp, Homo sapiens
gcaggggtcctcagatcagaagg

SEQ ID NO: 17289 - DNA, 23 bp, Homo sapiens
cggctcagccaaacactgtcagg

SEQ ID NO: 17290 - DNA, 23 bp, Homo sapiens
tgaagctgtgaagaaactgctgg

SEQ ID NO: 17291 - DNA, 23 bp, Homo sapiens
gcaaagcagtctgggattatggg

SEQ ID NO: 17292 - DNA, 23 bp, Homo sapiens
atggcttcttttcactttgcagg

SEQ ID NO: 17293 - DNA, 23 bp, Homo sapiens
cggaggctgaggtaggagaatgg

SEQ ID NO: 17294 - DNA, 23 bp, Homo sapiens
acatcgtcatagtcatcttcagg

SEQ ID NO: 17295 - DNA, 23 bp, Homo sapiens
gattccagcaagtggtaaattgg

SEQ ID NO: 17296 - DNA, 23 bp, Homo sapiens
gcaggagaatggcacgaatccgg

SEQ ID NO: 17297 - DNA, 23 bp, Homo sapiens
agcagcctccctgatgaatctgg

SEQ ID NO: 17298 - DNA, 23 bp, Homo sapiens
tgggcagctgaaatattaccagg

SEQ ID NO: 17299 - DNA, 23 bp, Homo sapiens
ggcggccccagtgctaggcctgg

SEQ ID NO: 17300 - DNA, 23 bp, Homo sapiens
agctctcctaccacattgaccgg

SEQ ID NO: 17301 - DNA, 23 bp, Homo sapiens
tacattgaccgacttaaacaagg

SEQ ID NO: 17302 - DNA, 23 bp, Homo sapiens
tagtaacacagctttaatgctgg

SEQ ID NO: 17303 - DNA, 23 bp, Homo sapiens
cttgcttcagtttgtcaatgtgg

SEQ ID NO: 17304 - DNA, 23 bp, Homo sapiens
gtatggagctgattgcccctggg

SEQ ID NO: 17305 - DNA, 23 bp, Homo sapiens
aggtgagggctcagtcacagtgg

SEQ ID NO: 17306 - DNA, 23 bp, Homo sapiens
ggcaaagatgaaaaagccaaagg

SEQ ID NO: 17307 - DNA, 23 bp, Homo sapiens
ccgatgtgtttctcggggtgtgg

SEQ ID NO: 17308 - DNA, 23 bp, Homo sapiens
gaactgcacgggcgtccaggtgg

SEQ ID NO: 17309 - DNA, 23 bp, Homo sapiens
agacaaagggaaagatatcaggg

SEQ ID NO: 17310 - DNA, 23 bp, Homo sapiens
ggatgatggcgccaagtagtggg

SEQ ID NO: 17311 - DNA, 23 bp, Homo sapiens
ttctcaaacttttccttgtctgg

SEQ ID NO: 17312 - DNA, 23 bp, Homo sapiens
ctcctgttctattcctccactgg

SEQ ID NO: 17313 - DNA, 23 bp, Homo sapiens
caaggagtctcttgtctagcagg

SEQ ID NO: 17314 - DNA, 23 bp, Homo sapiens
gctggccaccctggtcttgaggg

SEQ ID NO: 17315 - DNA, 23 bp, Homo sapiens
agcagggctcacacttttgaagg

SEQ ID NO: 17316 - DNA, 23 bp, Homo sapiens
ccaggccgaggctcacacgatgg

SEQ ID NO: 17317 - DNA, 23 bp, Homo sapiens
gtggtaagtggtattagatctgg

SEQ ID NO: 17318 - DNA, 23 bp, Homo sapiens
tcagagaatccaagtgttagagg

SEQ ID NO: 17319 - DNA, 23 bp, Homo sapiens
agacaaagggaaagacagcaagg

SEQ ID NO: 17320 - DNA, 23 bp, Homo sapiens
gggaaaagggtatcagtccaagg

SEQ ID NO: 17321 - DNA, 23 bp, Homo sapiens
cctctgggggggccctgagaggg

SEQ ID NO: 17322 - DNA, 23 bp, Homo sapiens
tgggcaggggcagggttagatgg

SEQ ID NO: 17323 - DNA, 23 bp, Homo sapiens
gccccagccccttgagactctgg

SEQ ID NO: 17324 - DNA, 23 bp, Homo sapiens
cagatgctggatgagctctgagg

SEQ ID NO: 17325 - DNA, 23 bp, Homo sapiens
ggctagctcttttttctgtatgg

SEQ ID NO: 17326 - DNA, 23 bp, Homo sapiens
agactgcagtggctcaagacagg

SEQ ID NO: 17327 - DNA, 23 bp, Homo sapiens
tgcaagagtagatgcagttaagg

SEQ ID NO: 17328 - DNA, 23 bp, Homo sapiens
cttcagagcttagcgttgcctgg

SEQ ID NO: 17329 - DNA, 23 bp, Homo sapiens
tatcaggaaatttcaagagcagg

SEQ ID NO: 17330 - DNA, 23 bp, Homo sapiens
ttttaccagtcattaaagccagg

SEQ ID NO: 17331 - DNA, 23 bp, Homo sapiens
ggaaagggttttcaaagactggg

SEQ ID NO: 17332 - DNA, 23 bp, Homo sapiens
gtgactcagcaagaataggatgg

SEQ ID NO: 17333 - DNA, 23 bp, Homo sapiens
ggaatcacgaaagagatctttgg

SEQ ID NO: 17334 - DNA, 23 bp, Homo sapiens
gaggtgcctgctcctctaggagg

SEQ ID NO: 17335 - DNA, 23 bp, Homo sapiens
tttctatgactgtgttgacacgg

SEQ ID NO: 17336 - DNA, 23 bp, Homo sapiens
aggtatcccccagggagtagggg

SEQ ID NO: 17337 - DNA, 23 bp, Homo sapiens
atgaagcttacgcataagcctgg

SEQ ID NO: 17338 - DNA, 23 bp, Homo sapiens
tcaaaacaagcatcttgatgtgg

SEQ ID NO: 17339 - DNA, 23 bp, Homo sapiens
agccctgtgcaggcctagggcgg

SEQ ID NO: 17340 - DNA, 23 bp, Homo sapiens
ggcgaggcggaaggctcagctgg

SEQ ID NO: 17341 - DNA, 23 bp, Homo sapiens
gagggggttccttcctcatctgg

SEQ ID NO: 17342 - DNA, 23 bp, Homo sapiens
caggaccagcatcatctgagagg

SEQ ID NO: 17343 - DNA, 23 bp, Homo sapiens
ctgcggccctacaaataaccggg

SEQ ID NO: 17344 - DNA, 23 bp, Homo sapiens
cgtgggctgagtcatttgtaagg

SEQ ID NO: 17345 - DNA, 23 bp, Homo sapiens
agcctagggttactatttgtagg

SEQ ID NO: 17346 - DNA, 23 bp, Homo sapiens
gacagcgattcgcagttaggagg

SEQ ID NO: 17347 - DNA, 23 bp, Homo sapiens
ccacggttcagtccagcttccgg

SEQ ID NO: 17348 - DNA, 23 bp, Homo sapiens
attgctagctgaactgctattgg

SEQ ID NO: 17349 - DNA, 23 bp, Homo sapiens
tgaactgggaagataataactgg

SEQ ID NO: 17350 - DNA, 23 bp, Homo sapiens
ttccttccgagaaaaacagttgg

SEQ ID NO: 17351 - DNA, 23 bp, Homo sapiens
gaggaattctatgcctgacgcgg

SEQ ID NO: 17352 - DNA, 23 bp, Homo sapiens
tacgcataaaactccttagtagg

SEQ ID NO: 17353 - DNA, 23 bp, Homo sapiens
aggaggagttctatgcctagtgg

SEQ ID NO: 17354 - DNA, 23 bp, Homo sapiens
gcttcacgcgtagaactcattgg

SEQ ID NO: 17355 - DNA, 23 bp, Homo sapiens
tgccgtgaattttaaacctcagg

SEQ ID NO: 17356 - DNA, 23 bp, Homo sapiens
ctgcagtggcttcaggcatctgg

SEQ ID NO: 17357 - DNA, 23 bp, Homo sapiens
gacgaggaggaagactcttgagg

SEQ ID NO: 17358 - DNA, 23 bp, Homo sapiens
ccacaatctgattgctgacctgg

SEQ ID NO: 17359 - DNA, 23 bp, Homo sapiens
tatttgccaagcctttgaaaggg

SEQ ID NO: 17360 - DNA, 23 bp, Homo sapiens
tctagattcacagctctgcatgg

SEQ ID NO: 17361 - DNA, 23 bp, Homo sapiens
gagttcatcgtgacctgcagagg

SEQ ID NO: 17362 - DNA, 23 bp, Homo sapiens
agcgcgttgtactcgttcatggg

SEQ ID NO: 17363 - DNA, 23 bp, Homo sapiens
ctacgcgcgcagcgtgcacgagg

SEQ ID NO: 17364 - DNA, 23 bp, Homo sapiens
ccacatcttgtctcatcagtagg

SEQ ID NO: 17365 - DNA, 23 bp, Homo sapiens
ccgccccgacggacggtgacagg

SEQ ID NO: 17366 - DNA, 23 bp, Homo sapiens
ccgtggagcacagctcaacgtgg

SEQ ID NO: 17367 - DNA, 23 bp, Homo sapiens
aagaagccacaaaacccaatagg

SEQ ID NO: 17368 - DNA, 23 bp, Homo sapiens
tatggagattgggaacgaaaagg

SEQ ID NO: 17369 - DNA, 23 bp, Homo sapiens
tgaagctttcttctccttatagg

SEQ ID NO: 17370 - DNA, 23 bp, Homo sapiens
gggagcctcctttcttcacatgg

SEQ ID NO: 17371 - DNA, 23 bp, Homo sapiens
aaataaggagaacttttcccagg

SEQ ID NO: 17372 - DNA, 23 bp, Homo sapiens
cccctgtaatgccagctacttgg

SEQ ID NO: 17373 - DNA, 23 bp, Homo sapiens
aggtcagagcttccacagcatgg

SEQ ID NO: 17374 - DNA, 23 bp, Homo sapiens
gcggcgctttgctcacacgaagg

SEQ ID NO: 17375 - DNA, 23 bp, Homo sapiens
gggtcagcgtcctggtagcatgg

SEQ ID NO: 17376 - DNA, 23 bp, Homo sapiens
ggctcccgggctcccatagcagg

SEQ ID NO: 17377 - DNA, 23 bp, Homo sapiens
ggcatccttcatgcaatggatgg

SEQ ID NO: 17378 - DNA, 23 bp, Homo sapiens
gtcacagacttagtgaatagtgg

SEQ ID NO: 17379 - DNA, 23 bp, Homo sapiens
aaggaaattgtagcctaagtagg

SEQ ID NO: 17380 - DNA, 23 bp, Homo sapiens
ctgtgattctgtcactgtgaagg

SEQ ID NO: 17381 - DNA, 23 bp, Homo sapiens
ccagcggacagtgtctaaactgg

SEQ ID NO: 17382 - DNA, 23 bp, Homo sapiens
gtaaggggtccgtcctcacttgg

SEQ ID NO: 17383 - DNA, 23 bp, Homo sapiens
ccacctgggccaggtctgagggg

SEQ ID NO: 17384 - DNA, 23 bp, Homo sapiens
cttggccattgtcgtcaatgtgg

SEQ ID NO: 17385 - DNA, 23 bp, Homo sapiens
agaacagttcagtggaggacagg

SEQ ID NO: 17386 - DNA, 23 bp, Homo sapiens
agtagatactggtctgtgattgg

SEQ ID NO: 17387 - DNA, 23 bp, Homo sapiens
tttgctgggtttattcgtgctgg

SEQ ID NO: 17388 - DNA, 23 bp, Homo sapiens
tatgctcttttggctgtaatggg

SEQ ID NO: 17389 - DNA, 23 bp, Homo sapiens
cttgtcactgctcgttctgctgg

SEQ ID NO: 17390 - DNA, 23 bp, Homo sapiens
tgctctagagcaatcatgtctgg

SEQ ID NO: 17391 - DNA, 23 bp, Homo sapiens
gcaggcagcgcggcactacctgg

SEQ ID NO: 17392 - DNA, 23 bp, Homo sapiens
tggagatcatggagctggagtgg

SEQ ID NO: 17393 - DNA, 23 bp, Homo sapiens
ataggagaaggtgttatttcggg

SEQ ID NO: 17394 - DNA, 23 bp, Homo sapiens
cctcttcctccatggatttttgg

SEQ ID NO: 17395 - DNA, 23 bp, Homo sapiens
ggagctcacccctgtctaggtgg

SEQ ID NO: 17396 - DNA, 23 bp, Homo sapiens
agcctcacctgcctccaggctgg

SEQ ID NO: 17397 - DNA, 23 bp, Homo sapiens
ggctggggtcttcactgtgttgg

SEQ ID NO: 17398 - DNA, 23 bp, Homo sapiens
tccctggtctccagatagccggg

SEQ ID NO: 17399 - DNA, 23 bp, Homo sapiens
ggagaagatggagaaattctagg

SEQ ID NO: 17400 - DNA, 23 bp, Homo sapiens
tgatgcgtttagaatgaaccagg

SEQ ID NO: 17401 - DNA, 23 bp, Homo sapiens
gaagcacctggtgctgaactagg

SEQ ID NO: 17402 - DNA, 23 bp, Homo sapiens
acgtgtgtttattctcagcatgg

SEQ ID NO: 17403 - DNA, 23 bp, Homo sapiens
atggtgtcagacatcataatcgg

SEQ ID NO: 17404 - DNA, 23 bp, Homo sapiens
tagtgtatgtccgattctggtgg

SEQ ID NO: 17405 - DNA, 23 bp, Homo sapiens
cagtctgactgtggagtatgagg

SEQ ID NO: 17406 - DNA, 23 bp, Homo sapiens
tcaggggtggctggctcacgagg

SEQ ID NO: 17407 - DNA, 23 bp, Homo sapiens
attagcacttcaagcagcactgg

SEQ ID NO: 17408 - DNA, 23 bp, Homo sapiens
ggttgtatcctcagcttaacagg

SEQ ID NO: 17409 - DNA, 23 bp, Homo sapiens
aactgaagtttgatcaatgctgg

SEQ ID NO: 17410 - DNA, 23 bp, Homo sapiens
cctctcactgtattatctcatgg

SEQ ID NO: 17411 - DNA, 23 bp, Homo sapiens
cttgttgctgtatatgcaacagg

SEQ ID NO: 17412 - DNA, 23 bp, Homo sapiens
aagaaaatgcagcctctgtccgg

SEQ ID NO: 17413 - DNA, 23 bp, Homo sapiens
gtcatatgcacaaggagattcgg

SEQ ID NO: 17414 - DNA, 23 bp, Homo sapiens
tttcctttgttgtgttcacaagg

SEQ ID NO: 17415 - DNA, 23 bp, Homo sapiens
caataagctgggtgtctaaaagg

SEQ ID NO: 17416 - DNA, 23 bp, Homo sapiens
catcatcgctcataagctgctgg

SEQ ID NO: 17417 - DNA, 23 bp, Homo sapiens
ggagacgggctcagaagagcagg

SEQ ID NO: 17418 - DNA, 23 bp, Homo sapiens
caggccgaagttggtgggatggg

SEQ ID NO: 17419 - DNA, 23 bp, Homo sapiens
ttaagaaggtggaagggagaagg

SEQ ID NO: 17420 - DNA, 23 bp, Homo sapiens
agaagactcataaccaatactgg

SEQ ID NO: 17421 - DNA, 23 bp, Homo sapiens
attgccatggcaacagcaatagg

SEQ ID NO: 17422 - DNA, 23 bp, Homo sapiens
gatgaggaagaggaaaatgatgg

SEQ ID NO: 17423 - DNA, 23 bp, Homo sapiens
tagctttgaggaagaagaggagg

SEQ ID NO: 17424 - DNA, 23 bp, Homo sapiens
ttgagaggttgaagcctccaagg

SEQ ID NO: 17425 - DNA, 23 bp, Homo sapiens
gttgagcgagctgcagttgctgg

SEQ ID NO: 17426 - DNA, 23 bp, Homo sapiens
tctgccttgcaggcggctatggg

SEQ ID NO: 17427 - DNA, 23 bp, Homo sapiens
atcccttacctgagaatgaaggg

SEQ ID NO: 17428 - DNA, 23 bp, Homo sapiens
tcattaaatggatcttctgctgg

SEQ ID NO: 17429 - DNA, 23 bp, Homo sapiens
gcagcagccaccacagtaatagg

SEQ ID NO: 17430 - DNA, 23 bp, Homo sapiens
tctaatagcccacatggttttgg

SEQ ID NO: 17431 - DNA, 23 bp, Homo sapiens
tgtgatccgcatcctacccatgg

SEQ ID NO: 17432 - DNA, 23 bp, Homo sapiens
gagtgcacagttcacccacgtgg

SEQ ID NO: 17433 - DNA, 23 bp, Homo sapiens
aaaggatgtaagaaggcttttgg

SEQ ID NO: 17434 - DNA, 23 bp, Homo sapiens
gcgattgtagctctgacatctgg

SEQ ID NO: 17435 - DNA, 23 bp, Homo sapiens
ggagctattcttgaagtttgtgg

SEQ ID NO: 17436 - DNA, 23 bp, Homo sapiens
cggcggggagggaatggaggagg

SEQ ID NO: 17437 - DNA, 23 bp, Homo sapiens
aaaccaaactcagattgactagg

SEQ ID NO: 17438 - DNA, 23 bp, Homo sapiens
cctccaatggctggtggatgagg

SEQ ID NO: 17439 - DNA, 23 bp, Homo sapiens
cgccgcgcccccggacctacagg

SEQ ID NO: 17440 - DNA, 23 bp, Homo sapiens
ctggatgaccagtcctgctgagg

SEQ ID NO: 17441 - DNA, 23 bp, Homo sapiens
cacagttctgctgcccagagcgg

SEQ ID NO: 17442 - DNA, 23 bp, Homo sapiens
tcttgtaaatcttcacttgctgg

SEQ ID NO: 17443 - DNA, 23 bp, Homo sapiens
ggcccgtcatctggcggatgagg

SEQ ID NO: 17444 - DNA, 23 bp, Homo sapiens
ataggtggtgctatgatcgatgg

SEQ ID NO: 17445 - DNA, 23 bp, Homo sapiens
gaacttcgcgctggacaagaggg

SEQ ID NO: 17446 - DNA, 23 bp, Homo sapiens
gatgggtgggtttctgattgtgg

SEQ ID NO: 17447 - DNA, 23 bp, Homo sapiens
tcaccaagggcgatttaatatgg

SEQ ID NO: 17448 - DNA, 23 bp, Homo sapiens
gcatttgacccgagtccttaagg

SEQ ID NO: 17449 - DNA, 23 bp, Homo sapiens
cagatggcagagtgagctaaggg

SEQ ID NO: 17450 - DNA, 23 bp, Homo sapiens
ttgggatgatgacaatgtagagg

SEQ ID NO: 17451 - DNA, 23 bp, Homo sapiens
tgctagcaagttctttctgctgg

SEQ ID NO: 17452 - DNA, 23 bp, Homo sapiens
taatgcagctcagacactcctgg

SEQ ID NO: 17453 - DNA, 23 bp, Homo sapiens
ggccgcgcagcgcaacgcactgg

SEQ ID NO: 17454 - DNA, 23 bp, Homo sapiens
gtcggaaaagtagaaacaggagg

SEQ ID NO: 17455 - DNA, 23 bp, Homo sapiens
aactacgtggctacagctctagg

SEQ ID NO: 17456 - DNA, 23 bp, Homo sapiens
cacacgctggactcctgatgggg

SEQ ID NO: 17457 - DNA, 23 bp, Homo sapiens
caccaccctccggacacatgagg

SEQ ID NO: 17458 - DNA, 23 bp, Homo sapiens
gaggtggaggccacgtagaaggg

SEQ ID NO: 17459 - DNA, 23 bp, Homo sapiens
caacaactgcctaggcactgagg

SEQ ID NO: 17460 - DNA, 23 bp, Homo sapiens
ctcggagatccgtgactctgtgg

SEQ ID NO: 17461 - DNA, 23 bp, Homo sapiens
tggaactggacttgctcacatgg

SEQ ID NO: 17462 - DNA, 23 bp, Homo sapiens
cgaggagtcatcagtatgagggg

SEQ ID NO: 17463 - DNA, 23 bp, Homo sapiens
tcagacgcagatggagactgagg

SEQ ID NO: 17464 - DNA, 23 bp, Homo sapiens
gactccttcctggtggctacagg

SEQ ID NO: 17465 - DNA, 23 bp, Homo sapiens
gtcatttgcccagctctagatgg

SEQ ID NO: 17466 - DNA, 23 bp, Homo sapiens
aaggaagcacacgcagctcgtgg

SEQ ID NO: 17467 - DNA, 23 bp, Homo sapiens
catactcttgagaatgaccaagg

SEQ ID NO: 17468 - DNA, 23 bp, Homo sapiens
acttcaacccacatctcactggg

SEQ ID NO: 17469 - DNA, 23 bp, Homo sapiens
aggacggcggtatcagctgttgg

SEQ ID NO: 17470 - DNA, 23 bp, Homo sapiens
ggattatgtacacgcatcattgg

SEQ ID NO: 17471 - DNA, 23 bp, Homo sapiens
gcgccccccgtgccctaggccgg

SEQ ID NO: 17472 - DNA, 23 bp, Homo sapiens
cggccgtttcaacttttaaaggg

SEQ ID NO: 17473 - DNA, 23 bp, Homo sapiens
agcctacaaccatgcaaagtagg

SEQ ID NO: 17474 - DNA, 23 bp, Homo sapiens
aggtgatgaggacattcatgtgg

SEQ ID NO: 17475 - DNA, 23 bp, Homo sapiens
ttgttcagtggtctgacagatgg

SEQ ID NO: 17476 - DNA, 23 bp, Homo sapiens
ccagcctcgggaggccctagtgg

SEQ ID NO: 17477 - DNA, 23 bp, Homo sapiens
agatgacagtgatcgtcatttgg

SEQ ID NO: 17478 - DNA, 23 bp, Homo sapiens
caacagggctatgtagatattgg

SEQ ID NO: 17479 - DNA, 23 bp, Homo sapiens
acagtcttcacaagagttttcgg

SEQ ID NO: 17480 - DNA, 23 bp, Homo sapiens
ctcacagcaactgctgatgaagg

SEQ ID NO: 17481 - DNA, 23 bp, Homo sapiens
acttcgtcggcagatctacaagg

SEQ ID NO: 17482 - DNA, 23 bp, Homo sapiens
ctgagtttcagtccatgagccgg

SEQ ID NO: 17483 - DNA, 23 bp, Homo sapiens
acagaagcacctttaggcgaagg

SEQ ID NO: 17484 - DNA, 23 bp, Homo sapiens
gacctgcactgtctaaatgaagg

SEQ ID NO: 17485 - DNA, 23 bp, Homo sapiens
acttcatttacagcaacagaagg

SEQ ID NO: 17486 - DNA, 23 bp, Homo sapiens
tctaaggttcacaaaccttcagg

SEQ ID NO: 17487 - DNA, 23 bp, Homo sapiens
tagctactttttagcaagtgtgg

SEQ ID NO: 17488 - DNA, 23 bp, Homo sapiens
tttctgtctagattaagaggtgg

SEQ ID NO: 17489 - DNA, 23 bp, Homo sapiens
gttctttcatctcacgagctagg

SEQ ID NO: 17490 - DNA, 23 bp, Homo sapiens
catgtcatgaagaagcatcctgg

SEQ ID NO: 17491 - DNA, 23 bp, Homo sapiens
cgggcggggcgtggcctcagagg

SEQ ID NO: 17492 - DNA, 23 bp, Homo sapiens
acttgtagtatcattcactctgg

SEQ ID NO: 17493 - DNA, 23 bp, Homo sapiens
caagcttcattctctcttcttgg

SEQ ID NO: 17494 - DNA, 23 bp, Homo sapiens
caaggaccgtaagaagtaagagg

SEQ ID NO: 17495 - DNA, 23 bp, Homo sapiens
cagcaacctgaggaaggacaagg

SEQ ID NO: 17496 - DNA, 23 bp, Homo sapiens
ccagcaaaccaagaaagacaagg

SEQ ID NO: 17497 - DNA, 23 bp, Homo sapiens
actcatcatcagaatcgtcatgg

SEQ ID NO: 17498 - DNA, 23 bp, Homo sapiens
cagctgagtctgcagtgcttcgg

SEQ ID NO: 17499 - DNA, 23 bp, Homo sapiens
gctctcgggcaccacgtgtaagg

SEQ ID NO: 17500 - DNA, 23 bp, Homo sapiens
cacagagaagtggtcgtcatggg

SEQ ID NO: 17501 - DNA, 23 bp, Homo sapiens
cctgccccactgctgaatgaagg

SEQ ID NO: 17502 - DNA, 23 bp, Homo sapiens
gcttatccgagagaaagatgagg

SEQ ID NO: 17503 - DNA, 23 bp, Homo sapiens
aacctgtgaccacctgctagtgg

SEQ ID NO: 17504 - DNA, 23 bp, Homo sapiens
gtgtccgcggcgagcgtcactgg

SEQ ID NO: 17505 - DNA, 23 bp, Homo sapiens
cctgataagcttctcagtctcgg

SEQ ID NO: 17506 - DNA, 23 bp, Homo sapiens
tactattcagtacacagccatgg

SEQ ID NO: 17507 - DNA, 23 bp, Homo sapiens
tcccagggctcccaggctggagg

SEQ ID NO: 17508 - DNA, 23 bp, Homo sapiens
cgaggatgagaaagcaaactggg

SEQ ID NO: 17509 - DNA, 23 bp, Homo sapiens
acagtgtcactattccctgacgg

SEQ ID NO: 17510 - DNA, 23 bp, Homo sapiens
gcagcccctgaggaaggacaagg

SEQ ID NO: 17511 - DNA, 23 bp, Homo sapiens
tgttggagctgctgcctcagagg

SEQ ID NO: 17512 - DNA, 23 bp, Homo sapiens
cagggtggcgtctacatctccgg

SEQ ID NO: 17513 - DNA, 23 bp, Homo sapiens
agcacaactgttagttttcaagg

SEQ ID NO: 17514 - DNA, 23 bp, Homo sapiens
attcccagctctggcttaactgg

SEQ ID NO: 17515 - DNA, 23 bp, Homo sapiens
gatcatgcaagaaaagcagaagg

SEQ ID NO: 17516 - DNA, 23 bp, Homo sapiens
ggacttttgctgttggatttagg

SEQ ID NO: 17517 - DNA, 23 bp, Homo sapiens
ggccactcccgggggtgaggggg

SEQ ID NO: 17518 - DNA, 23 bp, Homo sapiens
tctgactggtccagaaatggggg

SEQ ID NO: 17519 - DNA, 23 bp, Homo sapiens
tccaggcccagagctacagctgg

SEQ ID NO: 17520 - DNA, 23 bp, Homo sapiens
tcacgatttgtaagaacaagtgg

SEQ ID NO: 17521 - DNA, 23 bp, Homo sapiens
cgcaaccgcgacttcagctgagg

SEQ ID NO: 17522 - DNA, 23 bp, Homo sapiens
ggttcagctgaagtcccgactgg

SEQ ID NO: 17523 - DNA, 23 bp, Homo sapiens
tttgtgaaaaggacttagactgg

SEQ ID NO: 17524 - DNA, 23 bp, Homo sapiens
atcatcacacagagaactcccgg

SEQ ID NO: 17525 - DNA, 23 bp, Homo sapiens
tgatgatgaccgtcaccaactgg

SEQ ID NO: 17526 - DNA, 23 bp, Homo sapiens
gtctgtaggaccctggttattgg

SEQ ID NO: 17527 - DNA, 23 bp, Homo sapiens
gtggccctctgaacgatcactgg

SEQ ID NO: 17528 - DNA, 23 bp, Homo sapiens
gagcgagaggcagttatttttgg

SEQ ID NO: 17529 - DNA, 23 bp, Homo sapiens
ttatgcgtgtcctgaattatagg

SEQ ID NO: 17530 - DNA, 23 bp, Homo sapiens
aagttgtcaacccagttgcaggg

SEQ ID NO: 17531 - DNA, 23 bp, Homo sapiens
tagggttaacaatctttcccagg

SEQ ID NO: 17532 - DNA, 23 bp, Homo sapiens
gaatcccacccaaaaataactgg

SEQ ID NO: 17533 - DNA, 23 bp, Homo sapiens
tggcaagctctaggcttgcttgg

SEQ ID NO: 17534 - DNA, 23 bp, Homo sapiens
ctgggagggctatggtttcgtgg

SEQ ID NO: 17535 - DNA, 23 bp, Homo sapiens
aaagtgaaccgcccctgaggtgg

SEQ ID NO: 17536 - DNA, 23 bp, Homo sapiens
gggtgggtggtctcttacactgg

SEQ ID NO: 17537 - DNA, 23 bp, Homo sapiens
aacccaacggaagcgtagttggg

SEQ ID NO: 17538 - DNA, 23 bp, Homo sapiens
aatcccactaaatcctaggtggg

SEQ ID NO: 17539 - DNA, 23 bp, Homo sapiens
tacagtctctttcttctaagggg

SEQ ID NO: 17540 - DNA, 23 bp, Homo sapiens
gagagatatgcaggatttagggg

SEQ ID NO: 17541 - DNA, 23 bp, Homo sapiens
aaccccatctgattagggagagg

SEQ ID NO: 17542 - DNA, 23 bp, Homo sapiens
agggtctgctctccttaaaaggg

SEQ ID NO: 17543 - DNA, 23 bp, Homo sapiens
tccaacagcatcctcttcttcgg

SEQ ID NO: 17544 - DNA, 23 bp, Homo sapiens
gcacgcttagttttagggtgagg

SEQ ID NO: 17545 - DNA, 23 bp, Homo sapiens
gacagactaattgcatctacggg

SEQ ID NO: 17546 - DNA, 23 bp, Homo sapiens
acagactaattgcatctatgggg

SEQ ID NO: 17547 - DNA, 23 bp, Homo sapiens
agcacggatcctgcagcacaagg

SEQ ID NO: 17548 - DNA, 23 bp, Homo sapiens
ggccgcttttcctctccgtgagg

SEQ ID NO: 17549 - DNA, 23 bp, Homo sapiens
acccattcctatttgttatcagg

SEQ ID NO: 17550 - DNA, 23 bp, Homo sapiens
aggttctcttctccgtaaagagg

SEQ ID NO: 17551 - DNA, 23 bp, Homo sapiens
gctggaggagagttatgacttgg

SEQ ID NO: 17552 - DNA, 23 bp, Homo sapiens
tctgcttcccgatgacaacacgg

SEQ ID NO: 17553 - DNA, 23 bp, Homo sapiens
tgacaacacggacctcgccgtgg

SEQ ID NO: 17554 - DNA, 23 bp, Homo sapiens
caggttctcatcgccataaaggg

SEQ ID NO: 17555 - DNA, 23 bp, Homo sapiens
caaggccaacaggcctttcctgg

SEQ ID NO: 17556 - DNA, 23 bp, Homo sapiens
ccaaccccagcaggtcctagagg

SEQ ID NO: 17557 - DNA, 23 bp, Homo sapiens
agggtcagggttccatcacttgg

SEQ ID NO: 17558 - DNA, 23 bp, Homo sapiens
ttcatccgacataatcctacagg

SEQ ID NO: 17559 - DNA, 23 bp, Homo sapiens
gcttatttttgaggggatagtgg

SEQ ID NO: 17560 - DNA, 23 bp, Homo sapiens
actgggatattaggggcccctgg

SEQ ID NO: 17561 - DNA, 23 bp, Homo sapiens
gtttggcagccccaagtgagggg

SEQ ID NO: 17562 - DNA, 23 bp, Homo sapiens
atcctgcaggtctcaggccctgg

SEQ ID NO: 17563 - DNA, 23 bp, Homo sapiens
aagatgcgagacgagttataggg

SEQ ID NO: 17564 - DNA, 23 bp, Homo sapiens
cctgaaacaatgaacacaagtgg

SEQ ID NO: 17565 - DNA, 23 bp, Homo sapiens
cctgacacccaggagataaaagg

SEQ ID NO: 17566 - DNA, 23 bp, Homo sapiens
agcacgagggctcagcgccctgg

SEQ ID NO: 17567 - DNA, 23 bp, Homo sapiens
acatcatggaggtgcttgttggg

SEQ ID NO: 17568 - DNA, 23 bp, Homo sapiens
acatcatggaaatcattctgggg

SEQ ID NO: 17569 - DNA, 23 bp, Homo sapiens
aacaaactgtgctgcagcaaagg

SEQ ID NO: 17570 - DNA, 23 bp, Homo sapiens
gattcctatgtgatgcagctagg

SEQ ID NO: 17571 - DNA, 23 bp, Homo sapiens
ttttcaaacctttcatcctgagg

SEQ ID NO: 17572 - DNA, 23 bp, Homo sapiens
aaaggcatcaggtcatatagcgg

SEQ ID NO: 17573 - DNA, 23 bp, Homo sapiens
tcaggagtcaggtcatgtagcgg

SEQ ID NO: 17574 - DNA, 23 bp, Homo sapiens
tcaggtcaaatgccgagttatgg

SEQ ID NO: 17575 - DNA, 23 bp, Homo sapiens
tggtagctattagctctctgtgg

SEQ ID NO: 17576 - DNA, 23 bp, Homo sapiens
agcgaggtccttccctagggcgg

SEQ ID NO: 17577 - DNA, 23 bp, Homo sapiens
tcacagtgaacctgcagtctggg

SEQ ID NO: 17578 - DNA, 23 bp, Homo sapiens
cggggctccctaaactgaggtgg

SEQ ID NO: 17579 - DNA, 23 bp, Homo sapiens
ctggtgccggggcctagttgagg

SEQ ID NO: 17580 - DNA, 23 bp, Homo sapiens
ctctaattcagtgtcctctttgg

SEQ ID NO: 17581 - DNA, 23 bp, Homo sapiens
agacagcactgctggagttaagg

SEQ ID NO: 17582 - DNA, 23 bp, Homo sapiens
gaatggagggtcttaggcagagg

SEQ ID NO: 17583 - DNA, 23 bp, Homo sapiens
aagctgtttgcaaactgtgcagg

SEQ ID NO: 17584 - DNA, 23 bp, Homo sapiens
gtgtttatgtctcaagaggttgg

SEQ ID NO: 17585 - DNA, 23 bp, Homo sapiens
actcagacgggactttcctaggg

SEQ ID NO: 17586 - DNA, 23 bp, Homo sapiens
caagccttacaggttcgctatgg

SEQ ID NO: 17587 - DNA, 23 bp, Homo sapiens
cgtgtgactgttcactctgctgg

SEQ ID NO: 17588 - DNA, 23 bp, Homo sapiens
ggccacccagcaaaagtgaaagg

SEQ ID NO: 17589 - DNA, 23 bp, Homo sapiens
tcattatgagcatcagtccttgg

SEQ ID NO: 17590 - DNA, 23 bp, Homo sapiens
gcacttagggacatcaatcaagg

SEQ ID NO: 17591 - DNA, 23 bp, Homo sapiens
aatggtaagaaggcatcatgggg

SEQ ID NO: 17592 - DNA, 23 bp, Homo sapiens
cctacagctatgacaaacaaagg

SEQ ID NO: 17593 - DNA, 23 bp, Homo sapiens
gcagaggacgtcttctttagagg

SEQ ID NO: 17594 - DNA, 23 bp, Homo sapiens
ctctacaattttggaggcagagg

SEQ ID NO: 17595 - DNA, 23 bp, Homo sapiens
ggaaatcttctgccaatgtgggg

SEQ ID NO: 17596 - DNA, 23 bp, Homo sapiens
aaacttatgtaactaggcagagg

SEQ ID NO: 17597 - DNA, 23 bp, Homo sapiens
tttgccaacgagaaataagttgg

SEQ ID NO: 17598 - DNA, 23 bp, Homo sapiens
gaggaaggagaggaggatgaagg

SEQ ID NO: 17599 - DNA, 23 bp, Homo sapiens
caagaggacactggagcaggagg

SEQ ID NO: 17600 - DNA, 23 bp, Homo sapiens
tatgaagtctccatctaggtggg

SEQ ID NO: 17601 - DNA, 23 bp, Homo sapiens
tattctctcgtctcctgcaaagg

SEQ ID NO: 17602 - DNA, 23 bp, Homo sapiens
gatagaaacctcatactctctgg

SEQ ID NO: 17603 - DNA, 23 bp, Homo sapiens
ctgtagtcttggggttcagatgg

SEQ ID NO: 17604 - DNA, 23 bp, Homo sapiens
ccctggtggacaggatggttcgg

SEQ ID NO: 17605 - DNA, 23 bp, Homo sapiens
ctgcctggaagggtcaccaatgg

SEQ ID NO: 17606 - DNA, 23 bp, Homo sapiens
atcatggtgacaaagttagaagg

SEQ ID NO: 17607 - DNA, 23 bp, Homo sapiens
aaacaagtctagttctgtggtgg

SEQ ID NO: 17608 - DNA, 23 bp, Homo sapiens
ccctcaaggagagaggcgggagg

SEQ ID NO: 17609 - DNA, 23 bp, Homo sapiens
ggagggagcagcttctcagttgg

SEQ ID NO: 17610 - DNA, 23 bp, Homo sapiens
tacgaggatctgaaaagacaagg

SEQ ID NO: 17611 - DNA, 23 bp, Homo sapiens
aatgtgctatgagagcgtcctgg

SEQ ID NO: 17612 - DNA, 23 bp, Homo sapiens
cgtcttgatccttttgcagatgg

SEQ ID NO: 17613 - DNA, 23 bp, Homo sapiens
tgggggcagcaagaaatataagg

SEQ ID NO: 17614 - DNA, 23 bp, Homo sapiens
ccgggaaaggagggctcagaagg

SEQ ID NO: 17615 - DNA, 23 bp, Homo sapiens
atgtgaatttactgagggagagg

SEQ ID NO: 17616 - DNA, 23 bp, Homo sapiens
ggcagagtctcagttctcctcgg

SEQ ID NO: 17617 - DNA, 23 bp, Homo sapiens
aagcttctcaaggagaaatatgg

SEQ ID NO: 17618 - DNA, 23 bp, Homo sapiens
tggtgcgaacacgctagcacagg

SEQ ID NO: 17619 - DNA, 23 bp, Homo sapiens
gagcagtttgccaactgagaagg

SEQ ID NO: 17620 - DNA, 23 bp, Homo sapiens
ctcccgagggcagactcagttgg

SEQ ID NO: 17621 - DNA, 23 bp, Homo sapiens
tggcgggcaacactcagctctgg

SEQ ID NO: 17622 - DNA, 23 bp, Homo sapiens
agagggagagaagagtacgaagg

SEQ ID NO: 17623 - DNA, 23 bp, Homo sapiens
actcaattgatagaccactatgg

SEQ ID NO: 17624 - DNA, 23 bp, Homo sapiens
ccgggagaatcacttaaacacgg

SEQ ID NO: 17625 - DNA, 23 bp, Homo sapiens
gggactagcactgcagcttgcgg

SEQ ID NO: 17626 - DNA, 23 bp, Homo sapiens
tagttagctcacactcttttcgg

SEQ ID NO: 17627 - DNA, 23 bp, Homo sapiens
caaggaggagtgcccttcagtgg

SEQ ID NO: 17628 - DNA, 23 bp, Homo sapiens
caaaccagcgcttcctgagacgg

SEQ ID NO: 17629 - DNA, 23 bp, Homo sapiens
tgtcgtacatcccatatgcaagg

SEQ ID NO: 17630 - DNA, 23 bp, Homo sapiens
tttccttcataccatttgcaagg

SEQ ID NO: 17631 - DNA, 23 bp, Homo sapiens
gagggcgcgaggtcctcacacgg

SEQ ID NO: 17632 - DNA, 23 bp, Homo sapiens
gtcatgtgttgcagacaacatgg

SEQ ID NO: 17633 - DNA, 23 bp, Homo sapiens
acaaagcaggagttcatccgagg

SEQ ID NO: 17634 - DNA, 23 bp, Homo sapiens
cacagaatttatacagcagctgg

SEQ ID NO: 17635 - DNA, 23 bp, Homo sapiens
ggtgtgggagatgtgccaagtgg

SEQ ID NO: 17636 - DNA, 23 bp, Homo sapiens
gaccatctgtgagttctgagagg

SEQ ID NO: 17637 - DNA, 23 bp, Homo sapiens
gacagctgagttctcatcaaagg

SEQ ID NO: 17638 - DNA, 23 bp, Homo sapiens
ggtgccgctctactacatctagg

SEQ ID NO: 17639 - DNA, 23 bp, Homo sapiens
ttgtggagaaaagcgtcttgtgg

SEQ ID NO: 17640 - DNA, 23 bp, Homo sapiens
cgacgcgtgtacttcaataaggg

SEQ ID NO: 17641 - DNA, 23 bp, Homo sapiens
agcccctggcatgggttagcagg

SEQ ID NO: 17642 - DNA, 23 bp, Homo sapiens
ttggatcttagcttgcaactcgg

SEQ ID NO: 17643 - DNA, 23 bp, Homo sapiens
aggctcaagttctccatacttgg

SEQ ID NO: 17644 - DNA, 23 bp, Homo sapiens
tacaacaaggggctttgaggagg

SEQ ID NO: 17645 - DNA, 23 bp, Homo sapiens
cttttatcacagaggggtgtagg

SEQ ID NO: 17646 - DNA, 23 bp, Homo sapiens
ggacagtggtgtacaacaagggg

SEQ ID NO: 17647 - DNA, 23 bp, Homo sapiens
aggaggggctgtctccagagtgg

SEQ ID NO: 17648 - DNA, 23 bp, Homo sapiens
gggctatctccggctctaattgg

SEQ ID NO: 17649 - DNA, 23 bp, Homo sapiens
ggtacggggagctggaggaaggg

SEQ ID NO: 17650 - DNA, 23 bp, Homo sapiens
gtcagtgctggtccagaatgagg

SEQ ID NO: 17651 - DNA, 23 bp, Homo sapiens
tttaatgagtgtttccacagggg

SEQ ID NO: 17652 - DNA, 23 bp, Homo sapiens
actccgaggtcaaccagttatgg

SEQ ID NO: 17653 - DNA, 23 bp, Homo sapiens
cactatggatagtctttcagagg

SEQ ID NO: 17654 - DNA, 23 bp, Homo sapiens
attccccaacagcagactacagg

SEQ ID NO: 17655 - DNA, 23 bp, Homo sapiens
agaggacgcaggcagctcagagg

SEQ ID NO: 17656 - DNA, 23 bp, Homo sapiens
atcagtcacttcagctccacagg

SEQ ID NO: 17657 - DNA, 23 bp, Homo sapiens
caggcggcatcactttttcttgg

SEQ ID NO: 17658 - DNA, 23 bp, Homo sapiens
atcaagaaaaggtttgctgcagg

SEQ ID NO: 17659 - DNA, 23 bp, Homo sapiens
caagccctaacagggttcagagg

SEQ ID NO: 17660 - DNA, 23 bp, Homo sapiens
gccagaggatgatgacatcttgg

SEQ ID NO: 17661 - DNA, 23 bp, Homo sapiens
gaggcagatgatgcattcgttgg

SEQ ID NO: 17662 - DNA, 23 bp, Homo sapiens
tacagtagagaggctcaagcagg

SEQ ID NO: 17663 - DNA, 23 bp, Homo sapiens
gttatgtgtcattcaccagccgg

SEQ ID NO: 17664 - DNA, 23 bp, Homo sapiens
gacaatgagaaatcgacctgagg

SEQ ID NO: 17665 - DNA, 23 bp, Homo sapiens
cacagccagcgtgaactataagg

SEQ ID NO: 17666 - DNA, 23 bp, Homo sapiens
ttgaaacccacatctgcttgagg

SEQ ID NO: 17667 - DNA, 23 bp, Homo sapiens
aacggacaagcagaagaagaagg

SEQ ID NO: 17668 - DNA, 23 bp, Homo sapiens
tagaaagggtccaagttcagtgg

SEQ ID NO: 17669 - DNA, 23 bp, Homo sapiens
tcggtatattacctatggaatgg

SEQ ID NO: 17670 - DNA, 23 bp, Homo sapiens
ccgatgcttcacaggtttctggg

SEQ ID NO: 17671 - DNA, 23 bp, Homo sapiens
agaggtgaagtaagctgctcagg

SEQ ID NO: 17672 - DNA, 23 bp, Homo sapiens
gggatggtcacagctcattgtgg

SEQ ID NO: 17673 - DNA, 23 bp, Homo sapiens
gggcagctcctgtgtgctgaggg

SEQ ID NO: 17674 - DNA, 23 bp, Homo sapiens
tctgattgagaacaagtgagggg

SEQ ID NO: 17675 - DNA, 23 bp, Homo sapiens
aaagcatcacttcttacacgtgg

SEQ ID NO: 17676 - DNA, 23 bp, Homo sapiens
ctcatagagaacaagtgagctgg

SEQ ID NO: 17677 - DNA, 23 bp, Homo sapiens
aggttctgcccttccttgagtgg

SEQ ID NO: 17678 - DNA, 23 bp, Homo sapiens
tcttcagctgggatgtggacggg

SEQ ID NO: 17679 - DNA, 23 bp, Homo sapiens
cgccagcaacgacgaccagcagg

SEQ ID NO: 17680 - DNA, 23 bp, Homo sapiens
tgctgctgaatgatctgctccgg

SEQ ID NO: 17681 - DNA, 23 bp, Homo sapiens
acacagtcactcgctccgaaggg

SEQ ID NO: 17682 - DNA, 23 bp, Homo sapiens
agggggctggggtgggtcatggg

SEQ ID NO: 17683 - DNA, 23 bp, Homo sapiens
ggtggggttggctcacacgaagg

SEQ ID NO: 17684 - DNA, 23 bp, Homo sapiens
cggcgccgcgggctagtagaagg

SEQ ID NO: 17685 - DNA, 23 bp, Homo sapiens
gaattcctcactggtcagagagg

SEQ ID NO: 17686 - DNA, 23 bp, Homo sapiens
tttttcttcatggggctttcagg

SEQ ID NO: 17687 - DNA, 23 bp, Homo sapiens
gaacagtaacagcgattatgtgg

SEQ ID NO: 17688 - DNA, 23 bp, Homo sapiens
ccttgggcctcctcagtaggcgg

SEQ ID NO: 17689 - DNA, 23 bp, Homo sapiens
aagggtgtctgcgctctcagcgg

SEQ ID NO: 17690 - DNA, 23 bp, Homo sapiens
tccctggggtcacagctcgctgg

SEQ ID NO: 17691 - DNA, 23 bp, Homo sapiens
gctgtcactcaaacagctccagg

SEQ ID NO: 17692 - DNA, 23 bp, Homo sapiens
tcaaacaacagatggtagtctgg

SEQ ID NO: 17693 - DNA, 23 bp, Homo sapiens
gctgcagggcctgggctaagagg

SEQ ID NO: 17694 - DNA, 23 bp, Homo sapiens
cacatctacttgtgggcctaggg

SEQ ID NO: 17695 - DNA, 23 bp, Homo sapiens
acaggaagcacaaattctgaggg

SEQ ID NO: 17696 - DNA, 23 bp, Homo sapiens
tggagaagacgaagattcctagg

SEQ ID NO: 17697 - DNA, 23 bp, Homo sapiens
gacagccccacctggttcaaagg

SEQ ID NO: 17698 - DNA, 23 bp, Homo sapiens
gaaaccacggttggcatcaaagg

SEQ ID NO: 17699 - DNA, 23 bp, Homo sapiens
ctgtctacccccagcatgagcgg

SEQ ID NO: 17700 - DNA, 23 bp, Homo sapiens
cgacatgttttttgtaaggctgg

SEQ ID NO: 17701 - DNA, 23 bp, Homo sapiens
tgcctcagagaccaactgagtgg

SEQ ID NO: 17702 - DNA, 23 bp, Homo sapiens
gctacactgggcctaggtgatgg

SEQ ID NO: 17703 - DNA, 23 bp, Homo sapiens
gacgacttcgtgatttgaatggg

SEQ ID NO: 17704 - DNA, 23 bp, Homo sapiens
cagtgctcaaagggaagagatgg

SEQ ID NO: 17705 - DNA, 23 bp, Homo sapiens
aaccctggcccctcggctacagg

SEQ ID NO: 17706 - DNA, 23 bp, Homo sapiens
agtttctacagatcagctagagg

SEQ ID NO: 17707 - DNA, 23 bp, Homo sapiens
ttcccaggcccaccctcagtagg

SEQ ID NO: 17708 - DNA, 23 bp, Homo sapiens
gggacacgggtgagtcactgcgg

SEQ ID NO: 17709 - DNA, 23 bp, Homo sapiens
cagccagcataacatcctaatgg

SEQ ID NO: 17710 - DNA, 23 bp, Homo sapiens
attcttccccattaattacgtgg

SEQ ID NO: 17711 - DNA, 23 bp, Homo sapiens
ccagaaaaccaaggagaattagg

SEQ ID NO: 17712 - DNA, 23 bp, Homo sapiens
agcagttctaagtaggtaattgg

SEQ ID NO: 17713 - DNA, 23 bp, Homo sapiens
ctagctgagcagttccaagtagg

SEQ ID NO: 17714 - DNA, 23 bp, Homo sapiens
ttggaactgctcagctaggcagg

SEQ ID NO: 17715 - DNA, 23 bp, Homo sapiens
aagagaagaaaatccggcttcgg

SEQ ID NO: 17716 - DNA, 23 bp, Homo sapiens
tctgctagttctttttctcaagg

SEQ ID NO: 17717 - DNA, 23 bp, Homo sapiens
acgtggttctcacatctccatgg

SEQ ID NO: 17718 - DNA, 23 bp, Homo sapiens
cggcttctttctgagatagttgg

SEQ ID NO: 17719 - DNA, 23 bp, Homo sapiens
agctttgtggaaaacatatgagg

SEQ ID NO: 17720 - DNA, 23 bp, Homo sapiens
ccacccgtaggttcatttgctgg

SEQ ID NO: 17721 - DNA, 23 bp, Homo sapiens
aagctctcgacgaagctgcccgg

SEQ ID NO: 17722 - DNA, 23 bp, Homo sapiens
cttggatgctgtcctcagcgagg

SEQ ID NO: 17723 - DNA, 23 bp, Homo sapiens
gacaggacagctttcctcagagg

SEQ ID NO: 17724 - DNA, 23 bp, Homo sapiens
ttcatggttacgtagttggctgg

SEQ ID NO: 17725 - DNA, 23 bp, Homo sapiens
aattcttcctggagaggtgatgg

SEQ ID NO: 17726 - DNA, 23 bp, Homo sapiens
aaacagctgctggacagataagg

SEQ ID NO: 17727 - DNA, 23 bp, Homo sapiens
cgcgcgctcaggcagctggacgg

SEQ ID NO: 17728 - DNA, 23 bp, Homo sapiens
gctaggtggaagctgcagcaagg

SEQ ID NO: 17729 - DNA, 23 bp, Homo sapiens
ggcaggtctggtccgctcacagg

SEQ ID NO: 17730 - DNA, 23 bp, Homo sapiens
gttcttaggtggagctttaatgg

SEQ ID NO: 17731 - DNA, 23 bp, Homo sapiens
tccacctctttttgcctgaatgg

SEQ ID NO: 17732 - DNA, 23 bp, Homo sapiens
gtctacagcaacctgtggagcgg

SEQ ID NO: 17733 - DNA, 23 bp, Homo sapiens
cctgcgtggcgtggtctcacggg

SEQ ID NO: 17734 - DNA, 23 bp, Homo sapiens
gtggagaggaagcagtgacctgg

SEQ ID NO: 17735 - DNA, 23 bp, Homo sapiens
ttgttggaatgcaaaagtgctgg

SEQ ID NO: 17736 - DNA, 23 bp, Homo sapiens
tggaatgggaaaggtagttttgg

SEQ ID NO: 17737 - DNA, 23 bp, Homo sapiens
gatagaagcaaacgtcaaggggg

SEQ ID NO: 17738 - DNA, 23 bp, Homo sapiens
gggccgagggtcactgtcagggg

SEQ ID NO: 17739 - DNA, 23 bp, Homo sapiens
tagtgaagcttgctgtgcactgg

SEQ ID NO: 17740 - DNA, 23 bp, Homo sapiens
gcttcatgtgcatgaatccctgg

SEQ ID NO: 17741 - DNA, 23 bp, Homo sapiens
ggcttcacatctaaagagtccgg

SEQ ID NO: 17742 - DNA, 23 bp, Homo sapiens
tggtctcactgttgcgcaccagg

SEQ ID NO: 17743 - DNA, 23 bp, Homo sapiens
attgtgatacacgttttgacagg

SEQ ID NO: 17744 - DNA, 23 bp, Homo sapiens
cccggccccccggcttcagctgg

SEQ ID NO: 17745 - DNA, 23 bp, Homo sapiens
ctcggttatacagtcaccgctgg

SEQ ID NO: 17746 - DNA, 23 bp, Homo sapiens
catggcctgggcgtgtcaactgg

SEQ ID NO: 17747 - DNA, 23 bp, Homo sapiens
ccctcttacccgggagcctgagg

SEQ ID NO: 17748 - DNA, 23 bp, Homo sapiens
agaggccagggaatgctcagagg

SEQ ID NO: 17749 - DNA, 23 bp, Homo sapiens
atgttgtgtgtgtgcgtgagtgg

SEQ ID NO: 17750 - DNA, 23 bp, Homo sapiens
gggaagagaactgagtgtgctgg

SEQ ID NO: 17751 - DNA, 23 bp, Homo sapiens
gaccgaagtgaccgtgtgaccgg

SEQ ID NO: 17752 - DNA, 23 bp, Homo sapiens
aagaacgaggtgactgtctgagg

SEQ ID NO: 17753 - DNA, 23 bp, Homo sapiens
accgaggtcaccgtgtgaagcgg

SEQ ID NO: 17754 - DNA, 23 bp, Homo sapiens
agtcacttctgttttgctgttgg

SEQ ID NO: 17755 - DNA, 23 bp, Homo sapiens
tccgtgcactcagactgtccagg

SEQ ID NO: 17756 - DNA, 23 bp, Homo sapiens
tggcagctgcgttgttcaaaagg

SEQ ID NO: 17757 - DNA, 23 bp, Homo sapiens
ctggcctgcctgacttctaaagg

SEQ ID NO: 17758 - DNA, 23 bp, Homo sapiens
ctggttttgatgagcattgaagg

SEQ ID NO: 17759 - DNA, 23 bp, Homo sapiens
agcagatttatatcagaccatgg

SEQ ID NO: 17760 - DNA, 23 bp, Homo sapiens
gcgcggcgggtcagagccccagg

SEQ ID NO: 17761 - DNA, 23 bp, Homo sapiens
tcgcccgggctggagtataatgg

SEQ ID NO: 17762 - DNA, 23 bp, Homo sapiens
ggcgttggcgtcacagacccagg

SEQ ID NO: 17763 - DNA, 23 bp, Homo sapiens
ttgctgtctaagattccttctgg

SEQ ID NO: 17764 - DNA, 23 bp, Homo sapiens
atagggagggtgcaccgaattgg

SEQ ID NO: 17765 - DNA, 23 bp, Homo sapiens
ttcaagctcttcagtttctttgg

SEQ ID NO: 17766 - DNA, 23 bp, Homo sapiens
agcaatattcaggagagagacgg

SEQ ID NO: 17767 - DNA, 23 bp, Homo sapiens
tctccacctataactatgtaagg

SEQ ID NO: 17768 - DNA, 23 bp, Homo sapiens
ggtctcttatttgcccctttcgg

SEQ ID NO: 17769 - DNA, 23 bp, Homo sapiens
tagaagaggttaaagtggagagg

SEQ ID NO: 17770 - DNA, 23 bp, Homo sapiens
attagaaattgctgggccccagg

SEQ ID NO: 17771 - DNA, 23 bp, Homo sapiens
ctggtttatggatcagcagttgg

SEQ ID NO: 17772 - DNA, 23 bp, Homo sapiens
ggaaggatgcacaagttccaagg

SEQ ID NO: 17773 - DNA, 23 bp, Homo sapiens
tttcctgcatccaatgctactgg

SEQ ID NO: 17774 - DNA, 23 bp, Homo sapiens
ttctagagtaacattgtgtgtgg

SEQ ID NO: 17775 - DNA, 23 bp, Homo sapiens
gcaacattgctctgatgtccagg

SEQ ID NO: 17776 - DNA, 23 bp, Homo sapiens
ttgattgccatttcaacacatgg

SEQ ID NO: 17777 - DNA, 23 bp, Homo sapiens
tttgcagataatgggaaccttgg

SEQ ID NO: 17778 - DNA, 23 bp, Homo sapiens
ccctcagaagctgaaatgtgagg

SEQ ID NO: 17779 - DNA, 23 bp, Homo sapiens
atgttggaggttcagaagacagg

SEQ ID NO: 17780 - DNA, 23 bp, Homo sapiens
caagatctatgtcttctagcagg

SEQ ID NO: 17781 - DNA, 23 bp, Homo sapiens
tgggagctacatatcatccttgg

SEQ ID NO: 17782 - DNA, 23 bp, Homo sapiens
gcaacaccactggtcagcccagg

SEQ ID NO: 17783 - DNA, 23 bp, Homo sapiens
aaagcctaagagaccctcattgg

SEQ ID NO: 17784 - DNA, 23 bp, Homo sapiens
gggatggttccaaagtgaagagg

SEQ ID NO: 17785 - DNA, 23 bp, Homo sapiens
agtctctgcagtttctcacttgg

SEQ ID NO: 17786 - DNA, 23 bp, Homo sapiens
tgagcgggaggggctcagccagg

SEQ ID NO: 17787 - DNA, 23 bp, Homo sapiens
gccaccatgtgctcaccgtgagg

SEQ ID NO: 17788 - DNA, 23 bp, Homo sapiens
ggaggctgcagacgctgtcacgg

SEQ ID NO: 17789 - DNA, 23 bp, Homo sapiens
gagatcaagacaagcaagtgagg

SEQ ID NO: 17790 - DNA, 23 bp, Homo sapiens
gagatggggccagcctcagcagg

SEQ ID NO: 17791 - DNA, 23 bp, Homo sapiens
gatttctgagtactcagtgtcgg

SEQ ID NO: 17792 - DNA, 23 bp, Homo sapiens
ggtctgaaactatgcctgtctgg

SEQ ID NO: 17793 - DNA, 23 bp, Homo sapiens
agcctctgcattttcttacttgg

SEQ ID NO: 17794 - DNA, 23 bp, Homo sapiens
cagctctctgtgaacgtgacagg

SEQ ID NO: 17795 - DNA, 23 bp, Homo sapiens
ccctccagcaaagaagtcagagg

SEQ ID NO: 17796 - DNA, 23 bp, Homo sapiens
tctctgcagtttctcatctgtgg

SEQ ID NO: 17797 - DNA, 23 bp, Homo sapiens
tggttcttcctcatctgtgtggg

SEQ ID NO: 17798 - DNA, 23 bp, Homo sapiens
gcatgttccacaggcttagctgg

SEQ ID NO: 17799 - DNA, 23 bp, Homo sapiens
ccgtgtactaccgtctcccctgg

SEQ ID NO: 17800 - DNA, 23 bp, Homo sapiens
ccttgaccagccaggcctgaagg

SEQ ID NO: 17801 - DNA, 23 bp, Homo sapiens
cttcaggcctggctggtcaaggg

SEQ ID NO: 17802 - DNA, 23 bp, Homo sapiens
tccacagctgttgcctcaccagg

SEQ ID NO: 17803 - DNA, 23 bp, Homo sapiens
cgtttgtcctggtgcagtgaggg

SEQ ID NO: 17804 - DNA, 23 bp, Homo sapiens
tgtgctgagactaattcaccagg

SEQ ID NO: 17805 - DNA, 23 bp, Homo sapiens
tccttcagcatggagcaggcagg

SEQ ID NO: 17806 - DNA, 23 bp, Homo sapiens
agttcagttatttgatggcttgg

SEQ ID NO: 17807 - DNA, 23 bp, Homo sapiens
ttgctgaaggagctgagatgagg

SEQ ID NO: 17808 - DNA, 23 bp, Homo sapiens
agcaaaacatcagcttccgttgg

SEQ ID NO: 17809 - DNA, 23 bp, Homo sapiens
cctctttctgcttctaagtaggg

SEQ ID NO: 17810 - DNA, 23 bp, Homo sapiens
gccagcgggtcacctcccgttgg

SEQ ID NO: 17811 - DNA, 23 bp, Homo sapiens
agggctggagcggctcctgaggg

SEQ ID NO: 17812 - DNA, 23 bp, Homo sapiens
tgctctggctttgcagttaaggg

SEQ ID NO: 17813 - DNA, 23 bp, Homo sapiens
catgagggcgggtcagggcgagg

SEQ ID NO: 17814 - DNA, 23 bp, Homo sapiens
tgcccatctccactcaggagtgg

SEQ ID NO: 17815 - DNA, 23 bp, Homo sapiens
ggttccagacggctcaggccagg

SEQ ID NO: 17816 - DNA, 23 bp, Homo sapiens
aacaccatagacatgagctaggg

SEQ ID NO: 17817 - DNA, 23 bp, Homo sapiens
tggctaagattttttgtcgatgg

SEQ ID NO: 17818 - DNA, 23 bp, Homo sapiens
gagaagaaggagctctgaggtgg

SEQ ID NO: 17819 - DNA, 23 bp, Homo sapiens
caggtcccgaggaagtgaatggg

SEQ ID NO: 17820 - DNA, 23 bp, Homo sapiens
ctacatctgctggaaacagaagg

SEQ ID NO: 17821 - DNA, 23 bp, Homo sapiens
ctatgtctactggaagcagaagg

SEQ ID NO: 17822 - DNA, 23 bp, Homo sapiens
gagcaagggtcaagagtgagggg

SEQ ID NO: 17823 - DNA, 23 bp, Homo sapiens
ctccggctgctgggactcacagg

SEQ ID NO: 17824 - DNA, 23 bp, Homo sapiens
agtcaggtcttctgcttccaggg

SEQ ID NO: 17825 - DNA, 23 bp, Homo sapiens
tgaagctatatctgtgaaacagg

SEQ ID NO: 17826 - DNA, 23 bp, Homo sapiens
ctgggagatgcagctgtcactgg

SEQ ID NO: 17827 - DNA, 23 bp, Homo sapiens
ctggtcgcattcacccagccagg

SEQ ID NO: 17828 - DNA, 23 bp, Homo sapiens
gcttgatggaccagacaaatagg

SEQ ID NO: 17829 - DNA, 23 bp, Homo sapiens
atatcaggctgtggtcagcatgg

SEQ ID NO: 17830 - DNA, 23 bp, Homo sapiens
gaatctgttcgtagctggggtgg

SEQ ID NO: 17831 - DNA, 23 bp, Homo sapiens
tttcattttcatgacaggcaagg

SEQ ID NO: 17832 - DNA, 23 bp, Homo sapiens
acgttgacgaggtcatgacccgg

SEQ ID NO: 17833 - DNA, 23 bp, Homo sapiens
aaggcggtccccagctgaccagg

SEQ ID NO: 17834 - DNA, 23 bp, Homo sapiens
gctgcacaaaacgcacaaaaagg

SEQ ID NO: 17835 - DNA, 23 bp, Homo sapiens
cagcctgcagccagctgagatgg

SEQ ID NO: 17836 - DNA, 23 bp, Homo sapiens
tgtgccatgttcgagacctgagg

SEQ ID NO: 17837 - DNA, 23 bp, Homo sapiens
gtggacttggggtcctaagtggg

SEQ ID NO: 17838 - DNA, 23 bp, Homo sapiens
caaatgggttctaggagcccagg

SEQ ID NO: 17839 - DNA, 23 bp, Homo sapiens
ctcggtaacctccagcgactcgg

SEQ ID NO: 17840 - DNA, 23 bp, Homo sapiens
cttgcatatcttcatccagctgg

SEQ ID NO: 17841 - DNA, 23 bp, Homo sapiens
cacactgggtcacagttccaagg

SEQ ID NO: 17842 - DNA, 23 bp, Homo sapiens
gatgtcgcactcgctgtcgctgg

SEQ ID NO: 17843 - DNA, 23 bp, Homo sapiens
ctatcagaggtccgagggggagg

SEQ ID NO: 17844 - DNA, 23 bp, Homo sapiens
caactgaaagcattacctccagg

SEQ ID NO: 17845 - DNA, 23 bp, Homo sapiens
actacagaagcaaacagacctgg

SEQ ID NO: 17846 - DNA, 23 bp, Homo sapiens
ggattacattcaatacaggctgg

SEQ ID NO: 17847 - DNA, 23 bp, Homo sapiens
tctgtgttggatagatccactgg

SEQ ID NO: 17848 - DNA, 23 bp, Homo sapiens
tttctttgttgctgacatctcgg

SEQ ID NO: 17849 - DNA, 23 bp, Homo sapiens
tctcaccactgcctttgaagtgg

SEQ ID NO: 17850 - DNA, 23 bp, Homo sapiens
ggtgcctaaagcctacataatgg

SEQ ID NO: 17851 - DNA, 23 bp, Homo sapiens
cagcgagggcgctgcggagctgg

SEQ ID NO: 17852 - DNA, 23 bp, Homo sapiens
ttccacctagtcacaaattcagg

SEQ ID NO: 17853 - DNA, 23 bp, Homo sapiens
agatgaactcagacaggaacggg

SEQ ID NO: 17854 - DNA, 23 bp, Homo sapiens
tttttacatggggcattcactgg

SEQ ID NO: 17855 - DNA, 23 bp, Homo sapiens
ttagctgactctacaagtagagg

SEQ ID NO: 17856 - DNA, 23 bp, Homo sapiens
gggcaacagcggtggcttgaagg

SEQ ID NO: 17857 - DNA, 23 bp, Homo sapiens
atgcttctggaggagatttttgg

SEQ ID NO: 17858 - DNA, 23 bp, Homo sapiens
ttgatcaggaaagaaaagcttgg

SEQ ID NO: 17859 - DNA, 23 bp, Homo sapiens
aaaactgtgtgctacctacctgg

SEQ ID NO: 17860 - DNA, 23 bp, Homo sapiens
ttcacttctcttcacaccactgg

SEQ ID NO: 17861 - DNA, 23 bp, Homo sapiens
tacagattactctgacatgttgg

SEQ ID NO: 17862 - DNA, 23 bp, Homo sapiens
tgggcttttgcagtgtcagtcgg

SEQ ID NO: 17863 - DNA, 23 bp, Homo sapiens
ctcatcaccaccttactttgagg

SEQ ID NO: 17864 - DNA, 23 bp, Homo sapiens
ttgcagatgggtgccctgaatgg

SEQ ID NO: 17865 - DNA, 23 bp, Homo sapiens
ctgtggcagcttcagaaaacagg

SEQ ID NO: 17866 - DNA, 23 bp, Homo sapiens
tgtctctttggatgatgcctagg

SEQ ID NO: 17867 - DNA, 23 bp, Homo sapiens
agggatggaaattggagagatgg

SEQ ID NO: 17868 - DNA, 23 bp, Homo sapiens
aaagatgacagttggaaagatgg

SEQ ID NO: 17869 - DNA, 23 bp, Homo sapiens
cacactagcatagactgtgatgg

SEQ ID NO: 17870 - DNA, 23 bp, Homo sapiens
ggtctctggtgtcagctctctgg

SEQ ID NO: 17871 - DNA, 23 bp, Homo sapiens
caacttacacgacattgtcaagg

SEQ ID NO: 17872 - DNA, 23 bp, Homo sapiens
ttctcataggcaaatagccttgg

SEQ ID NO: 17873 - DNA, 23 bp, Homo sapiens
ttgtgcaggatctgccataaagg

SEQ ID NO: 17874 - DNA, 23 bp, Homo sapiens
attgctcatcttcttgctcttgg

SEQ ID NO: 17875 - DNA, 23 bp, Homo sapiens
ttcccaaggagcagtcaggcagg

SEQ ID NO: 17876 - DNA, 23 bp, Homo sapiens
cagatgaaagtgtcctaatgagg

SEQ ID NO: 17877 - DNA, 23 bp, Homo sapiens
gccagggggcagttagctcatgg

SEQ ID NO: 17878 - DNA, 23 bp, Homo sapiens
gggaagggctaggctgtgcaagg

SEQ ID NO: 17879 - DNA, 23 bp, Homo sapiens
cttgatgtctacttttcgtcagg

SEQ ID NO: 17880 - DNA, 23 bp, Homo sapiens
agcctgttcccagttccctgagg

SEQ ID NO: 17881 - DNA, 23 bp, Homo sapiens
catttagagagaagtctgagcgg

SEQ ID NO: 17882 - DNA, 23 bp, Homo sapiens
tttacagtagccatgtgttctgg

SEQ ID NO: 17883 - DNA, 23 bp, Homo sapiens
atcacttcatgtgaatagcaggg

SEQ ID NO: 17884 - DNA, 23 bp, Homo sapiens
caaggcagttggtggaaatgagg

SEQ ID NO: 17885 - DNA, 23 bp, Homo sapiens
cacctcctttgttatactgtcgg

SEQ ID NO: 17886 - DNA, 23 bp, Homo sapiens
cttgaataatccagaaggcttgg

SEQ ID NO: 17887 - DNA, 23 bp, Homo sapiens
tattgttgcaacagcaatgtagg

SEQ ID NO: 17888 - DNA, 23 bp, Homo sapiens
ttcagcctttggaagttttttgg

SEQ ID NO: 17889 - DNA, 23 bp, Homo sapiens
gaaaggggagacctctggctagg

SEQ ID NO: 17890 - DNA, 23 bp, Homo sapiens
agtgttatttaacgtagccacgg

SEQ ID NO: 17891 - DNA, 23 bp, Homo sapiens
cacaagtgagtcagcgtccatgg

SEQ ID NO: 17892 - DNA, 23 bp, Homo sapiens
ccacctgtcttactagttagagg

SEQ ID NO: 17893 - DNA, 23 bp, Homo sapiens
caccaatcctcctagttcgtggg

SEQ ID NO: 17894 - DNA, 23 bp, Homo sapiens
atgtcaaagcctggagttactgg

SEQ ID NO: 17895 - DNA, 23 bp, Homo sapiens
acactgggctcaggagtagatgg

SEQ ID NO: 17896 - DNA, 23 bp, Homo sapiens
tcctggttctcaggagtagatgg

SEQ ID NO: 17897 - DNA, 23 bp, Homo sapiens
gtcctacttgtccggggtggtgg

SEQ ID NO: 17898 - DNA, 23 bp, Homo sapiens
tgttgggcattaggagtagatgg

SEQ ID NO: 17899 - DNA, 23 bp, Homo sapiens
cagcactgcatctagtagtgagg

SEQ ID NO: 17900 - DNA, 23 bp, Homo sapiens
cgctattaccctggggattcagg

SEQ ID NO: 17901 - DNA, 23 bp, Homo sapiens
cggggcatctgtttcacggcagg

SEQ ID NO: 17902 - DNA, 23 bp, Homo sapiens
ggggcatcacagatcagtgcagg

SEQ ID NO: 17903 - DNA, 23 bp, Homo sapiens
atggtctcattactcatagcagg

SEQ ID NO: 17904 - DNA, 23 bp, Homo sapiens
accacaccaagcccctaggctgg

SEQ ID NO: 17905 - DNA, 23 bp, Homo sapiens
agtcctccagggggactcagagg

SEQ ID NO: 17906 - DNA, 23 bp, Homo sapiens
cacttacccagcatgggcgaggg

SEQ ID NO: 17907 - DNA, 23 bp, Homo sapiens
tgtgacacatattgagacttagg

SEQ ID NO: 17908 - DNA, 23 bp, Homo sapiens
aatggggcttgttctcacaaagg

SEQ ID NO: 17909 - DNA, 23 bp, Homo sapiens
ggaaacttaggagacatcgtagg

SEQ ID NO: 17910 - DNA, 23 bp, Homo sapiens
attcacagaaacagatgtgaagg

SEQ ID NO: 17911 - DNA, 23 bp, Homo sapiens
tcatcagagttttgtcttcttgg

SEQ ID NO: 17912 - DNA, 23 bp, Homo sapiens
agcagggacaggggctgaacagg

SEQ ID NO: 17913 - DNA, 23 bp, Homo sapiens
tggcgtgcccaccagcaggaggg

SEQ ID NO: 17914 - DNA, 23 bp, Homo sapiens
agactcaaacacagtttcatagg

SEQ ID NO: 17915 - DNA, 23 bp, Homo sapiens
tcagccccatggattcagactgg

SEQ ID NO: 17916 - DNA, 23 bp, Homo sapiens
tctctgctgtcaagttcatctgg

SEQ ID NO: 17917 - DNA, 23 bp, Homo sapiens
tcaacaagtggtgtccagagtgg

SEQ ID NO: 17918 - DNA, 23 bp, Homo sapiens
tcaaggcctttggtcatgtgagg

SEQ ID NO: 17919 - DNA, 23 bp, Homo sapiens
acccaaggaggggctggaagagg

SEQ ID NO: 17920 - DNA, 23 bp, Homo sapiens
tccagaagaaaatacatggatgg

SEQ ID NO: 17921 - DNA, 23 bp, Homo sapiens
tggcaagaaaggcattagattgg

SEQ ID NO: 17922 - DNA, 23 bp, Homo sapiens
cccggaaacaagtgtctgagtgg

SEQ ID NO: 17923 - DNA, 23 bp, Homo sapiens
ttgtaccattggccgaaagatgg

SEQ ID NO: 17924 - DNA, 23 bp, Homo sapiens
gtcaaacagggcactcaggtagg

SEQ ID NO: 17925 - DNA, 23 bp, Homo sapiens
tgtaagaaagtgtgtcataccgg

SEQ ID NO: 17926 - DNA, 23 bp, Homo sapiens
gctcaagggttcagattctctgg

SEQ ID NO: 17927 - DNA, 23 bp, Homo sapiens
caccctgagttatacagactcgg

SEQ ID NO: 17928 - DNA, 23 bp, Homo sapiens
tacaagaaagttgttggagctgg

SEQ ID NO: 17929 - DNA, 23 bp, Homo sapiens
tacagcagaaattcaggactggg

SEQ ID NO: 17930 - DNA, 23 bp, Homo sapiens
attgaacatcttcaagtggcagg

SEQ ID NO: 17931 - DNA, 23 bp, Homo sapiens
ttgtaactttatgtcctcagagg

SEQ ID NO: 17932 - DNA, 23 bp, Homo sapiens
ttctctctttagcccattcttgg

SEQ ID NO: 17933 - DNA, 23 bp, Homo sapiens
acatctctcggtttgctcagagg

SEQ ID NO: 17934 - DNA, 23 bp, Homo sapiens
accatggacacagacactgaagg

SEQ ID NO: 17935 - DNA, 23 bp, Homo sapiens
acaagactcacatagctataagg

SEQ ID NO: 17936 - DNA, 23 bp, Homo sapiens
aggcacatggtcagtagtcccgg

SEQ ID NO: 17937 - DNA, 23 bp, Homo sapiens
agaagtttctctcttcattctgg

SEQ ID NO: 17938 - DNA, 23 bp, Homo sapiens
gctgtggggttgggagctagagg

SEQ ID NO: 17939 - DNA, 23 bp, Homo sapiens
ccttctgctgctactcctcatgg

SEQ ID NO: 17940 - DNA, 23 bp, Homo sapiens
tctgggggaggacagtgatgagg

SEQ ID NO: 17941 - DNA, 23 bp, Homo sapiens
aatatccagtcatatccgatagg

SEQ ID NO: 17942 - DNA, 23 bp, Homo sapiens
aggagtggggatgctagctgcgg

SEQ ID NO: 17943 - DNA, 23 bp, Homo sapiens
ccatcggactaggtttcattagg

SEQ ID NO: 17944 - DNA, 23 bp, Homo sapiens
caggggcgcccgagagtcactgg

SEQ ID NO: 17945 - DNA, 23 bp, Homo sapiens
tgaggacccgcaggtcaggatgg

SEQ ID NO: 17946 - DNA, 23 bp, Homo sapiens
cataacactgactgcaccactgg

SEQ ID NO: 17947 - DNA, 23 bp, Homo sapiens
atgatattactctcttcctctgg

SEQ ID NO: 17948 - DNA, 23 bp, Homo sapiens
acccagacctcacagttctaggg

SEQ ID NO: 17949 - DNA, 23 bp, Homo sapiens
ccttggaaacgtgagaaataagg

SEQ ID NO: 17950 - DNA, 23 bp, Homo sapiens
ttcatctgataatattccccggg

SEQ ID NO: 17951 - DNA, 23 bp, Homo sapiens
catcttggtttcactgtcgatgg

SEQ ID NO: 17952 - DNA, 23 bp, Homo sapiens
aaggagtcggttctgtgatgggg

SEQ ID NO: 17953 - DNA, 23 bp, Homo sapiens
tgccacggtcgcctctgagaagg

SEQ ID NO: 17954 - DNA, 23 bp, Homo sapiens
ggctggtgggcatcattatctgg

SEQ ID NO: 17955 - DNA, 23 bp, Homo sapiens
caacgagagtgctatgtgagggg

SEQ ID NO: 17956 - DNA, 23 bp, Homo sapiens
agctccgcaggctcagacattgg

SEQ ID NO: 17957 - DNA, 23 bp, Homo sapiens
ccaaagggtcctggctgaatggg

SEQ ID NO: 17958 - DNA, 23 bp, Homo sapiens
cgttcaagtggagcaggatgagg

SEQ ID NO: 17959 - DNA, 23 bp, Homo sapiens
tcaaacagcttcacattctgagg

SEQ ID NO: 17960 - DNA, 23 bp, Homo sapiens
agacaaatcacacatatggaagg

SEQ ID NO: 17961 - DNA, 23 bp, Homo sapiens
acatctctctcaggtgcccgagg

SEQ ID NO: 17962 - DNA, 23 bp, Homo sapiens
tgaaggacgccgagaaccttggg

SEQ ID NO: 17963 - DNA, 23 bp, Homo sapiens
gcctgacaccatcaaggatgtgg

SEQ ID NO: 17964 - DNA, 23 bp, Homo sapiens
caggcacaatttctagagcgagg

SEQ ID NO: 17965 - DNA, 23 bp, Homo sapiens
cccaggaggctaaaactgtgtgg

SEQ ID NO: 17966 - DNA, 23 bp, Homo sapiens
gaagtatgtgctgctcacaaagg

SEQ ID NO: 17967 - DNA, 23 bp, Homo sapiens
acatcatctgatgatgtctgagg

SEQ ID NO: 17968 - DNA, 23 bp, Homo sapiens
agggagtgagagtgaggaagagg

SEQ ID NO: 17969 - DNA, 23 bp, Homo sapiens
acccccagggattctggtcttgg

SEQ ID NO: 17970 - DNA, 23 bp, Homo sapiens
ggtactcagaggccgctcagagg

SEQ ID NO: 17971 - DNA, 23 bp, Homo sapiens
tgtgtctgggcagcggtcaccgg

SEQ ID NO: 17972 - DNA, 23 bp, Homo sapiens
tgctgcagagagcagaactgcgg

SEQ ID NO: 17973 - DNA, 23 bp, Homo sapiens
ggtctctcttcttagttcaatgg

SEQ ID NO: 17974 - DNA, 23 bp, Homo sapiens
caagagaggactttcagctctgg

SEQ ID NO: 17975 - DNA, 23 bp, Homo sapiens
ggcatgaaggccatgtagcccgg

SEQ ID NO: 17976 - DNA, 23 bp, Homo sapiens
tcctgctcatgctgctctactgg

SEQ ID NO: 17977 - DNA, 23 bp, Homo sapiens
tcctaacaccatccaggatgtgg

SEQ ID NO: 17978 - DNA, 23 bp, Homo sapiens
tgcttctcaggtgacacaatagg

SEQ ID NO: 17979 - DNA, 23 bp, Homo sapiens
tcagaggagctctgtgctatagg

SEQ ID NO: 17980 - DNA, 23 bp, Homo sapiens
gtctttgtcgggggcctcaaagg

SEQ ID NO: 17981 - DNA, 23 bp, Homo sapiens
caggcaggactagtgctgctcgg

SEQ ID NO: 17982 - DNA, 23 bp, Homo sapiens
ggagacagaagaaaatcccaagg

SEQ ID NO: 17983 - DNA, 23 bp, Homo sapiens
ttactggaagcgatgttagaagg

SEQ ID NO: 17984 - DNA, 23 bp, Homo sapiens
caagagaagaatggactctgagg

SEQ ID NO: 17985 - DNA, 23 bp, Homo sapiens
aagcaggtccagaactaagtggg

SEQ ID NO: 17986 - DNA, 23 bp, Homo sapiens
ggggttccgttgtcctcagctgg

SEQ ID NO: 17987 - DNA, 23 bp, Homo sapiens
gtggaagtgacgcagttttaagg

SEQ ID NO: 17988 - DNA, 23 bp, Homo sapiens
ggaagtcatttttcagaccttgg

SEQ ID NO: 17989 - DNA, 23 bp, Homo sapiens
gcacagcaaaggctatcccgtgg

SEQ ID NO: 17990 - DNA, 23 bp, Homo sapiens
gtaggcgttctggtcatttctgg

SEQ ID NO: 17991 - DNA, 23 bp, Homo sapiens
agcatggtgctattcactaatgg

SEQ ID NO: 17992 - DNA, 23 bp, Homo sapiens
tgactgattcagacagatacagg

SEQ ID NO: 17993 - DNA, 23 bp, Homo sapiens
atgccccgtctccatctagcagg

SEQ ID NO: 17994 - DNA, 23 bp, Homo sapiens
gtgggcacccggcggctcagtgg

SEQ ID NO: 17995 - DNA, 23 bp, Homo sapiens
ctcagcgctaatcgtcttcccgg

SEQ ID NO: 17996 - DNA, 23 bp, Homo sapiens
aataaaataaggggctgtggagg

SEQ ID NO: 17997 - DNA, 23 bp, Homo sapiens
gctcaacaaagtgtggaagacgg

SEQ ID NO: 17998 - DNA, 23 bp, Homo sapiens
attcccacggctggtcaggatgg

SEQ ID NO: 17999 - DNA, 23 bp, Homo sapiens
cgaagtgcagagctagcacttgg

SEQ ID NO: 18000 - DNA, 23 bp, Homo sapiens
ctcttcctcagtggctgaagcgg

SEQ ID NO: 18001 - DNA, 23 bp, Homo sapiens
acagttgtctcatcactgagtgg

SEQ ID NO: 18002 - DNA, 23 bp, Homo sapiens
cccagggctgatcttcctatggg

SEQ ID NO: 18003 - DNA, 23 bp, Homo sapiens
ttacatacgagcagctaaagagg

SEQ ID NO: 18004 - DNA, 23 bp, Homo sapiens
cacttcagtatgcttccaactgg

SEQ ID NO: 18005 - DNA, 23 bp, Homo sapiens
attcgaaaaggactctatcgtgg

SEQ ID NO: 18006 - DNA, 23 bp, Homo sapiens
ctgtattccctctcaagcagtgg

SEQ ID NO: 18007 - DNA, 23 bp, Homo sapiens
tacaggcacttttcaaattccgg

SEQ ID NO: 18008 - DNA, 23 bp, Homo sapiens
atgggaaggcgtctcagtgttgg

SEQ ID NO: 18009 - DNA, 23 bp, Homo sapiens
ggggtctattttattgggattgg

SEQ ID NO: 18010 - DNA, 23 bp, Homo sapiens
gtccttcctgcactcagcgctgg

SEQ ID NO: 18011 - DNA, 23 bp, Homo sapiens
ttgtggcctacgaatacagcagg

SEQ ID NO: 18012 - DNA, 23 bp, Homo sapiens
tgggccacccccaacttgtgagg

SEQ ID NO: 18013 - DNA, 23 bp, Homo sapiens
attcatggcttcaagagaactgg

SEQ ID NO: 18014 - DNA, 23 bp, Homo sapiens
gttctcttgaagccatgaatagg

SEQ ID NO: 18015 - DNA, 23 bp, Homo sapiens
gcgggtgctgggctcaggcctgg

SEQ ID NO: 18016 - DNA, 23 bp, Homo sapiens
cgggctccgggtccctcacctgg

SEQ ID NO: 18017 - DNA, 23 bp, Homo sapiens
tgctgtaggcatcagttatgtgg

SEQ ID NO: 18018 - DNA, 23 bp, Homo sapiens
ggcgtgcagtcgcggtgacgggg

SEQ ID NO: 18019 - DNA, 23 bp, Homo sapiens
cacagcttgctgttggaagttgg

SEQ ID NO: 18020 - DNA, 23 bp, Homo sapiens
aatgctgtgcggggtctcattgg

SEQ ID NO: 18021 - DNA, 23 bp, Homo sapiens
attcaggctgttcaaggtgaagg

SEQ ID NO: 18022 - DNA, 23 bp, Homo sapiens
ccccttggtcaatggtgttctgg

SEQ ID NO: 18023 - DNA, 23 bp, Homo sapiens
aggcaagaagagtggagggctgg

SEQ ID NO: 18024 - DNA, 23 bp, Homo sapiens
ctgtggagtctatcagacgtggg

SEQ ID NO: 18025 - DNA, 23 bp, Homo sapiens
gagggcggggtgagcgtcacagg

SEQ ID NO: 18026 - DNA, 23 bp, Homo sapiens
agtctctgaagaagaagcttggg

SEQ ID NO: 18027 - DNA, 23 bp, Homo sapiens
atacgagcagttgaagaaattgg

SEQ ID NO: 18028 - DNA, 23 bp, Homo sapiens
gatattggtggtaggtaatcggg

SEQ ID NO: 18029 - DNA, 23 bp, Homo sapiens
tagaagacgtatgatgatgcagg

SEQ ID NO: 18030 - DNA, 23 bp, Homo sapiens
agcctgctgtattacctttgtgg

SEQ ID NO: 18031 - DNA, 23 bp, Homo sapiens
agaagaccgtactcagtaacagg

SEQ ID NO: 18032 - DNA, 23 bp, Homo sapiens
gctgggcgggcccagcacaaggg

SEQ ID NO: 18033 - DNA, 23 bp, Homo sapiens
acgggcgggtatctcatgactgg

SEQ ID NO: 18034 - DNA, 23 bp, Homo sapiens
atttagtgtctgtgtagtagagg

SEQ ID NO: 18035 - DNA, 23 bp, Homo sapiens
ttggtggtttacctactcaatgg

SEQ ID NO: 18036 - DNA, 23 bp, Homo sapiens
aaaatcgagctccatactaaagg

SEQ ID NO: 18037 - DNA, 23 bp, Homo sapiens
cctctcttggtcaggacttcagg

SEQ ID NO: 18038 - DNA, 23 bp, Homo sapiens
cggcttctgggcggctgaaaggg

SEQ ID NO: 18039 - DNA, 23 bp, Homo sapiens
catgggcggtgcttttgtattgg

SEQ ID NO: 18040 - DNA, 23 bp, Homo sapiens
tccagaaacaaaatgttcgaagg

SEQ ID NO: 18041 - DNA, 23 bp, Homo sapiens
gaagaaaaccctgggcatatagg

SEQ ID NO: 18042 - DNA, 23 bp, Homo sapiens
gaccctcatcaaccccatggagg

SEQ ID NO: 18043 - DNA, 23 bp, Homo sapiens
tgcggcacctgcagagctagggg

SEQ ID NO: 18044 - DNA, 23 bp, Homo sapiens
agagttggttttttaggcttcgg

SEQ ID NO: 18045 - DNA, 23 bp, Homo sapiens
agctggtggactcgagacactgg

SEQ ID NO: 18046 - DNA, 23 bp, Homo sapiens
gaatatctcctccgctggtgggg

SEQ ID NO: 18047 - DNA, 23 bp, Homo sapiens
aggcaggaggaaggagtgtttgg

SEQ ID NO: 18048 - DNA, 23 bp, Homo sapiens
ccggggtctgctcacatagccgg

SEQ ID NO: 18049 - DNA, 23 bp, Homo sapiens
ccggcttgctttctcagctaggg

SEQ ID NO: 18050 - DNA, 23 bp, Homo sapiens
cttatgggctcgtcactgcgtgg

SEQ ID NO: 18051 - DNA, 23 bp, Homo sapiens
gggcttcacatgcagagatgagg

SEQ ID NO: 18052 - DNA, 23 bp, Homo sapiens
aatgttctcagaggcatgggtgg

SEQ ID NO: 18053 - DNA, 23 bp, Homo sapiens
catcggtccctcatctcttgggg

SEQ ID NO: 18054 - DNA, 23 bp, Homo sapiens
gtcagtcttcagctctttcctgg

SEQ ID NO: 18055 - DNA, 23 bp, Homo sapiens
agctcaagaaggtgatctaaggg

SEQ ID NO: 18056 - DNA, 23 bp, Homo sapiens
accgatgcccatctgtagcaggg

SEQ ID NO: 18057 - DNA, 23 bp, Homo sapiens
gcaggaacttctggaagaggagg

SEQ ID NO: 18058 - DNA, 23 bp, Homo sapiens
gcactgggctgcggcaagtgagg

SEQ ID NO: 18059 - DNA, 23 bp, Homo sapiens
gccctgctcaaggcataatgggg

SEQ ID NO: 18060 - DNA, 23 bp, Homo sapiens
actactaagactcagaccattgg

SEQ ID NO: 18061 - DNA, 23 bp, Homo sapiens
attacgtaatcgggtatatgagg

SEQ ID NO: 18062 - DNA, 23 bp, Homo sapiens
agaacttgatgtccaggatgagg

SEQ ID NO: 18063 - DNA, 23 bp, Homo sapiens
gaggtcctcatctatgcctcagg

SEQ ID NO: 18064 - DNA, 23 bp, Homo sapiens
ccagaagatggagaccgtagggg

SEQ ID NO: 18065 - DNA, 23 bp, Homo sapiens
ttggagtgaaaactctggcaggg

SEQ ID NO: 18066 - DNA, 23 bp, Homo sapiens
gatgtagcatgttcagagtctgg

SEQ ID NO: 18067 - DNA, 23 bp, Homo sapiens
aagggtctcagacttcactgtgg

SEQ ID NO: 18068 - DNA, 23 bp, Homo sapiens
caaccacccaatcctcagagcgg

SEQ ID NO: 18069 - DNA, 23 bp, Homo sapiens
caacagcaatgaagatgtctagg

SEQ ID NO: 18070 - DNA, 23 bp, Homo sapiens
aggactggctgagccctcacagg

SEQ ID NO: 18071 - DNA, 23 bp, Homo sapiens
gtcaggctgtcacggacataggg

SEQ ID NO: 18072 - DNA, 23 bp, Homo sapiens
cagtagaggaacagcttcagagg

SEQ ID NO: 18073 - DNA, 23 bp, Homo sapiens
ctgggaatattcagagtttcagg

SEQ ID NO: 18074 - DNA, 23 bp, Homo sapiens
gtggaagttctcagattcgaagg

SEQ ID NO: 18075 - DNA, 23 bp, Homo sapiens
cagccgcatccaggcaggcgagg

SEQ ID NO: 18076 - DNA, 23 bp, Homo sapiens
gccaggtgatcagagcctccagg

SEQ ID NO: 18077 - DNA, 23 bp, Homo sapiens
gtcttatgttctactgaccaggg

SEQ ID NO: 18078 - DNA, 23 bp, Homo sapiens
cagtaggatcatttaaggccagg

SEQ ID NO: 18079 - DNA, 23 bp, Homo sapiens
cacacgatctgtgcacagtgagg

SEQ ID NO: 18080 - DNA, 23 bp, Homo sapiens
cctgccgagtcccagccctgagg

SEQ ID NO: 18081 - DNA, 23 bp, Homo sapiens
ctttttgtctcacactgtccagg

SEQ ID NO: 18082 - DNA, 23 bp, Homo sapiens
aacaataccgtctgtgcctaagg

SEQ ID NO: 18083 - DNA, 23 bp, Homo sapiens
catcgacctttaactgcaatggg

SEQ ID NO: 18084 - DNA, 23 bp, Homo sapiens
tcctttgtcacacaattgcccgg

SEQ ID NO: 18085 - DNA, 23 bp, Homo sapiens
ctgctctttgccgtttctaatgg

SEQ ID NO: 18086 - DNA, 23 bp, Homo sapiens
ttcaaggcgctgctctgaagtgg

SEQ ID NO: 18087 - DNA, 23 bp, Homo sapiens
ctggtgcacctcatctagaaggg

SEQ ID NO: 18088 - DNA, 23 bp, Homo sapiens
ggctggagtatgccaggtgaagg

SEQ ID NO: 18089 - DNA, 23 bp, Homo sapiens
agtgggcggggctggctcagagg

SEQ ID NO: 18090 - DNA, 23 bp, Homo sapiens
gatctggggcgactcacacttgg

SEQ ID NO: 18091 - DNA, 23 bp, Homo sapiens
aggcagacggattcctcaggagg

SEQ ID NO: 18092 - DNA, 23 bp, Homo sapiens
cctcctgcattcctcatttaagg

SEQ ID NO: 18093 - DNA, 23 bp, Homo sapiens
gggactagagttctgttgactgg

SEQ ID NO: 18094 - DNA, 23 bp, Homo sapiens
agctttctccagagacctaatgg

SEQ ID NO: 18095 - DNA, 23 bp, Homo sapiens
tgacaatgatgcttctgatgtgg

SEQ ID NO: 18096 - DNA, 23 bp, Homo sapiens
aggaggcatgacttagacattgg

SEQ ID NO: 18097 - DNA, 23 bp, Homo sapiens
acacagtctctgtagctcctagg

SEQ ID NO: 18098 - DNA, 23 bp, Homo sapiens
aggaggcacgacttagacattgg

SEQ ID NO: 18099 - DNA, 23 bp, Homo sapiens
gccagatgagaacgactgagggg

SEQ ID NO: 18100 - DNA, 23 bp, Homo sapiens
gaacgagccggacttagtccagg

SEQ ID NO: 18101 - DNA, 23 bp, Homo sapiens
agagcttccacctgtcacttcgg

SEQ ID NO: 18102 - DNA, 23 bp, Homo sapiens
ctgtcccgagccaacatagcagg

SEQ ID NO: 18103 - DNA, 23 bp, Homo sapiens
gagaaggtccttcttgcgctagg

SEQ ID NO: 18104 - DNA, 23 bp, Homo sapiens
taaaaggaagtttccttggcagg

SEQ ID NO: 18105 - DNA, 23 bp, Homo sapiens
ggacacagaacaaagtgaaaagg

SEQ ID NO: 18106 - DNA, 23 bp, Homo sapiens
aaatcacagcccattttgagggg

SEQ ID NO: 18107 - DNA, 23 bp, Homo sapiens
atcgactcagctgtcactgatgg

SEQ ID NO: 18108 - DNA, 23 bp, Homo sapiens
aagactcacaaagatgattcagg

SEQ ID NO: 18109 - DNA, 23 bp, Homo sapiens
gcgttctgttgacataacattgg

SEQ ID NO: 18110 - DNA, 23 bp, Homo sapiens
ctggctgagcagtcagtctgagg

SEQ ID NO: 18111 - DNA, 23 bp, Homo sapiens
gcagggccatggctcaggcttgg

SEQ ID NO: 18112 - DNA, 23 bp, Homo sapiens
gacggtgcagtgagctatgatgg

SEQ ID NO: 18113 - DNA, 23 bp, Homo sapiens
tcagagttacaggcaagaagtgg

SEQ ID NO: 18114 - DNA, 23 bp, Homo sapiens
aatgatcctaggaaactagtggg

SEQ ID NO: 18115 - DNA, 23 bp, Homo sapiens
tcactctttgtggaccactaagg

SEQ ID NO: 18116 - DNA, 23 bp, Homo sapiens
tccatgaaatactgcaaagatgg

SEQ ID NO: 18117 - DNA, 23 bp, Homo sapiens
gttagagtctatcatggtcttgg

SEQ ID NO: 18118 - DNA, 23 bp, Homo sapiens
cacctgatgctgatgctaggtgg

SEQ ID NO: 18119 - DNA, 23 bp, Homo sapiens
ggtgtgactgagctagtcacagg

SEQ ID NO: 18120 - DNA, 23 bp, Homo sapiens
tgaagttcgacatgtagatttgg

SEQ ID NO: 18121 - DNA, 23 bp, Homo sapiens
gccatagagtttgatgtcaatgg

SEQ ID NO: 18122 - DNA, 23 bp, Homo sapiens
acttctcagcacagcttagctgg

SEQ ID NO: 18123 - DNA, 23 bp, Homo sapiens
cgaaccaacgcggaggactaggg

SEQ ID NO: 18124 - DNA, 23 bp, Homo sapiens
catcttcgtggaaatgcaaaagg

SEQ ID NO: 18125 - DNA, 23 bp, Homo sapiens
gtggccggcagggagctcagggg

SEQ ID NO: 18126 - DNA, 23 bp, Homo sapiens
agtctgggcccacagcctagagg

SEQ ID NO: 18127 - DNA, 23 bp, Homo sapiens
aatctggggcgtcccctacaagg

SEQ ID NO: 18128 - DNA, 23 bp, Homo sapiens
ggcctcccagcagttgtgacggg

SEQ ID NO: 18129 - DNA, 23 bp, Homo sapiens
gcttcaaaggagagagttattgg

SEQ ID NO: 18130 - DNA, 23 bp, Homo sapiens
ccctaatactgatcagagtttgg

SEQ ID NO: 18131 - DNA, 23 bp, Homo sapiens
agtcagtgctggtgaagtgaggg

SEQ ID NO: 18132 - DNA, 23 bp, Homo sapiens
cggctaggaacccttcaccttgg

SEQ ID NO: 18133 - DNA, 23 bp, Homo sapiens
ctccagaagtctcagtgacctgg

SEQ ID NO: 18134 - DNA, 23 bp, Homo sapiens
agtagctgttattacaaggatgg

SEQ ID NO: 18135 - DNA, 23 bp, Homo sapiens
gctttagtgggatttcctgcagg

SEQ ID NO: 18136 - DNA, 23 bp, Homo sapiens
tggaagttgtcagggactagcgg

SEQ ID NO: 18137 - DNA, 23 bp, Homo sapiens
gaaaggatccgagatctaagtgg

SEQ ID NO: 18138 - DNA, 23 bp, Homo sapiens
ttcatctgactcatcactcttgg

SEQ ID NO: 18139 - DNA, 23 bp, Homo sapiens
ggtagtctctctcttcctagtgg

SEQ ID NO: 18140 - DNA, 23 bp, Homo sapiens
ctcctgtgcagaaggtttgaggg

SEQ ID NO: 18141 - DNA, 23 bp, Homo sapiens
agcaagaaagtcaaggacgctgg

SEQ ID NO: 18142 - DNA, 23 bp, Homo sapiens
aaggacagcaagaagaactgagg

SEQ ID NO: 18143 - DNA, 23 bp, Homo sapiens
ctgtggtgctcacacccccatgg

SEQ ID NO: 18144 - DNA, 23 bp, Homo sapiens
tggctggtcactgctgcccctgg

SEQ ID NO: 18145 - DNA, 23 bp, Homo sapiens
aagctggacattaaggggaaagg

SEQ ID NO: 18146 - DNA, 23 bp, Homo sapiens
gggtgaagaaaacatctgtttgg

SEQ ID NO: 18147 - DNA, 23 bp, Homo sapiens
gagttacccagtccttgagaagg

SEQ ID NO: 18148 - DNA, 23 bp, Homo sapiens
ttggactctacacatcatagcgg

SEQ ID NO: 18149 - DNA, 23 bp, Homo sapiens
agataaacatccgcatttactgg

SEQ ID NO: 18150 - DNA, 23 bp, Homo sapiens
atgcttcctgcgtcctgagtagg

SEQ ID NO: 18151 - DNA, 23 bp, Homo sapiens
ctgctctcagggatgctgcctgg

SEQ ID NO: 18152 - DNA, 23 bp, Homo sapiens
ctggcacaacgtccttaattggg

SEQ ID NO: 18153 - DNA, 23 bp, Homo sapiens
cagaggactgcagaagtctgagg

SEQ ID NO: 18154 - DNA, 23 bp, Homo sapiens
caggtctcaaagacccttgctgg

SEQ ID NO: 18155 - DNA, 23 bp, Homo sapiens
gctgggcagggccaggagtgagg

SEQ ID NO: 18156 - DNA, 23 bp, Homo sapiens
cctcatgttcgtgtggcctaggg

SEQ ID NO: 18157 - DNA, 23 bp, Homo sapiens
ccactctgctgtcttgtagctgg

SEQ ID NO: 18158 - DNA, 23 bp, Homo sapiens
ttctagaggagtggtgttagcgg

SEQ ID NO: 18159 - DNA, 23 bp, Homo sapiens
ataggagtggcatttgcggtggg

SEQ ID NO: 18160 - DNA, 23 bp, Homo sapiens
tctaatgcgtcttcagatttcgg

SEQ ID NO: 18161 - DNA, 23 bp, Homo sapiens
tctataccactggcttagagagg

SEQ ID NO: 18162 - DNA, 23 bp, Homo sapiens
aatccatactgaaaactgtgggg

SEQ ID NO: 18163 - DNA, 23 bp, Homo sapiens
cacagtgtttctcaggaggatgg

SEQ ID NO: 18164 - DNA, 23 bp, Homo sapiens
tacagcgaagagacaatctctgg

SEQ ID NO: 18165 - DNA, 23 bp, Homo sapiens
agcctccagggaacctcagctgg

SEQ ID NO: 18166 - DNA, 23 bp, Homo sapiens
ttcagcaatgatgcttcatttgg

SEQ ID NO: 18167 - DNA, 23 bp, Homo sapiens
tgggagagtctagtatttcctgg

SEQ ID NO: 18168 - DNA, 23 bp, Homo sapiens
tgagaggacagggagggtggagg

SEQ ID NO: 18169 - DNA, 23 bp, Homo sapiens
tgagaggacagggaaggtggagg

SEQ ID NO: 18170 - DNA, 23 bp, Homo sapiens
tgagagggaagggaaggtggagg

SEQ ID NO: 18171 - DNA, 23 bp, Homo sapiens
cctgtttgtgcgcacagtgctgg

SEQ ID NO: 18172 - DNA, 23 bp, Homo sapiens
tccacctgtgccttcatataggg

SEQ ID NO: 18173 - DNA, 23 bp, Homo sapiens
tgggctgtaaatccattcacagg

SEQ ID NO: 18174 - DNA, 23 bp, Homo sapiens
ccaactccaccacttttgttcgg

SEQ ID NO: 18175 - DNA, 23 bp, Homo sapiens
taattatgcatggacacctgtgg

SEQ ID NO: 18176 - DNA, 23 bp, Homo sapiens
cctactcccaaagttgtagctgg

SEQ ID NO: 18177 - DNA, 23 bp, Homo sapiens
ctgcccagggtcagctacggggg

SEQ ID NO: 18178 - DNA, 23 bp, Homo sapiens
gaggaaaatactatcactggtgg

SEQ ID NO: 18179 - DNA, 23 bp, Homo sapiens
tgtccctgagcagaggcagcggg

SEQ ID NO: 18180 - DNA, 23 bp, Homo sapiens
tcacatattgagggagtgaccgg

SEQ ID NO: 18181 - DNA, 23 bp, Homo sapiens
tcactgctggtcagcatctcagg

SEQ ID NO: 18182 - DNA, 23 bp, Homo sapiens
ctctcttcactcagccttcttgg

SEQ ID NO: 18183 - DNA, 23 bp, Homo sapiens
atcttgtgttctctggattctgg

SEQ ID NO: 18184 - DNA, 23 bp, Homo sapiens
tttttctcggcgggtttcagtgg

SEQ ID NO: 18185 - DNA, 23 bp, Homo sapiens
agcaggtgctaggactcctctgg

SEQ ID NO: 18186 - DNA, 23 bp, Homo sapiens
caatgccgcaggtgttttaaagg

SEQ ID NO: 18187 - DNA, 23 bp, Homo sapiens
ctgctgaacatgagactctgagg

SEQ ID NO: 18188 - DNA, 23 bp, Homo sapiens
gtttgagtggtgccaattaatgg

SEQ ID NO: 18189 - DNA, 23 bp, Homo sapiens
caggatgagggtcaccctagtgg

SEQ ID NO: 18190 - DNA, 23 bp, Homo sapiens
ttccttgtgttagtgatgcttgg

SEQ ID NO: 18191 - DNA, 23 bp, Homo sapiens
cgcatgtctggacactgatcagg

SEQ ID NO: 18192 - DNA, 23 bp, Homo sapiens
gcattcgttttgctcatctttgg

SEQ ID NO: 18193 - DNA, 23 bp, Homo sapiens
ttgctcacagttctggaggttgg

SEQ ID NO: 18194 - DNA, 23 bp, Homo sapiens
cgccatctttgtggatctcttgg

SEQ ID NO: 18195 - DNA, 23 bp, Homo sapiens
gaatgatcgtggactaagaatgg

SEQ ID NO: 18196 - DNA, 23 bp, Homo sapiens
ggtctgggagatgttctgatggg

SEQ ID NO: 18197 - DNA, 23 bp, Homo sapiens
tttcatcatcattttgggcgtgg

SEQ ID NO: 18198 - DNA, 23 bp, Homo sapiens
gctcttcatccaaatctaggggg

SEQ ID NO: 18199 - DNA, 23 bp, Homo sapiens
ttactgggaaaggtcaaaactgg

SEQ ID NO: 18200 - DNA, 23 bp, Homo sapiens
ctggacgttggcctgggctaggg

SEQ ID NO: 18201 - DNA, 23 bp, Homo sapiens
gctcatatatagccaagagcagg

SEQ ID NO: 18202 - DNA, 23 bp, Homo sapiens
ggtgctgttctcgctcttcgtgg

SEQ ID NO: 18203 - DNA, 23 bp, Homo sapiens
gtcagggagcacgttcaccaagg

SEQ ID NO: 18204 - DNA, 23 bp, Homo sapiens
ggacagatccagattgggtaggg

SEQ ID NO: 18205 - DNA, 23 bp, Homo sapiens
acatggctggctcagttactcgg

SEQ ID NO: 18206 - DNA, 23 bp, Homo sapiens
aggaatctctcaggcccacaagg

SEQ ID NO: 18207 - DNA, 23 bp, Homo sapiens
ggggtgggcctggcctaatcagg

SEQ ID NO: 18208 - DNA, 23 bp, Homo sapiens
ggtcttcctcaagtggtgagcgg

SEQ ID NO: 18209 - DNA, 23 bp, Homo sapiens
gactagggcagggtatcagaagg

SEQ ID NO: 18210 - DNA, 23 bp, Homo sapiens
gtgaccactgagggctgatgggg

SEQ ID NO: 18211 - DNA, 23 bp, Homo sapiens
gctgggatgcttttgggttttgg

SEQ ID NO: 18212 - DNA, 23 bp, Homo sapiens
gtatgttgctctggttgatatgg

SEQ ID NO: 18213 - DNA, 23 bp, Homo sapiens
gattgcccaccttgagtgagggg

SEQ ID NO: 18214 - DNA, 23 bp, Homo sapiens
ctcagcatatcattcatctctgg

SEQ ID NO: 18215 - DNA, 23 bp, Homo sapiens
gtatgcaggagaaatcgaattgg

SEQ ID NO: 18216 - DNA, 23 bp, Homo sapiens
gacatacttaggactgagtaagg

SEQ ID NO: 18217 - DNA, 23 bp, Homo sapiens
ggaccttgaacatttaatgctgg

SEQ ID NO: 18218 - DNA, 23 bp, Homo sapiens
catactgtatacctcgtgttagg

SEQ ID NO: 18219 - DNA, 23 bp, Homo sapiens
aggctgaagtcaggccgcgtagg

SEQ ID NO: 18220 - DNA, 23 bp, Homo sapiens
tgatgcaaaagaagttaggaagg

SEQ ID NO: 18221 - DNA, 23 bp, Homo sapiens
acggatgtcggggactagcttgg

SEQ ID NO: 18222 - DNA, 23 bp, Homo sapiens
ggagatcgagatggagatgttgg

SEQ ID NO: 18223 - DNA, 23 bp, Homo sapiens
gcatctggacctccctaactggg

SEQ ID NO: 18224 - DNA, 23 bp, Homo sapiens
taaatgttgagtgcagatgaagg

SEQ ID NO: 18225 - DNA, 23 bp, Homo sapiens
cttggtctgagaagtctatgcgg

SEQ ID NO: 18226 - DNA, 23 bp, Homo sapiens
accaggaggccttcgtgtagtgg

SEQ ID NO: 18227 - DNA, 23 bp, Homo sapiens
tctgaactatgcaattgcagagg

SEQ ID NO: 18228 - DNA, 23 bp, Homo sapiens
atgaaagaagctggtaagggagg

SEQ ID NO: 18229 - DNA, 23 bp, Homo sapiens
ttccagagagctaaagccgatgg

SEQ ID NO: 18230 - DNA, 23 bp, Homo sapiens
agaaggcagcggagtcctgaagg

SEQ ID NO: 18231 - DNA, 23 bp, Homo sapiens
aatgggtatctatctcacaatgg

SEQ ID NO: 18232 - DNA, 23 bp, Homo sapiens
cgcccccggacaacaagaagagg

SEQ ID NO: 18233 - DNA, 23 bp, Homo sapiens
aggaggaaaatccacaaactagg

SEQ ID NO: 18234 - DNA, 23 bp, Homo sapiens
ttttctactctttctgcttctgg

SEQ ID NO: 18235 - DNA, 23 bp, Homo sapiens
cgcgatgtcagacgttcagcagg

SEQ ID NO: 18236 - DNA, 23 bp, Homo sapiens
ccaccgcgaggaagaaaaggagg

SEQ ID NO: 18237 - DNA, 23 bp, Homo sapiens
cgctctctttgttagatatgtgg

SEQ ID NO: 18238 - DNA, 23 bp, Homo sapiens
tgtggagttgtgtgcactatagg

SEQ ID NO: 18239 - DNA, 23 bp, Homo sapiens
agttttctacgctgagtatttgg

SEQ ID NO: 18240 - DNA, 23 bp, Homo sapiens
cgggagtgcggctcagaccacgg

SEQ ID NO: 18241 - DNA, 23 bp, Homo sapiens
caaatcactgtcttctgcccagg

SEQ ID NO: 18242 - DNA, 23 bp, Homo sapiens
cttctaagagaaccacattgtgg

SEQ ID NO: 18243 - DNA, 23 bp, Homo sapiens
ttctggtccaggcagatcagggg

SEQ ID NO: 18244 - DNA, 23 bp, Homo sapiens
ttctctatgatgtctccatatgg

SEQ ID NO: 18245 - DNA, 23 bp, Homo sapiens
actatcaatagcagcttaacagg

SEQ ID NO: 18246 - DNA, 23 bp, Homo sapiens
ccagtgaagatgcttcagacagg

SEQ ID NO: 18247 - DNA, 23 bp, Homo sapiens
tatgtcagaattcagtgacgtgg

SEQ ID NO: 18248 - DNA, 23 bp, Homo sapiens
caagcttctttgctagtgcctgg

SEQ ID NO: 18249 - DNA, 23 bp, Homo sapiens
agtcaagaggtcaaggtgtaggg

SEQ ID NO: 18250 - DNA, 23 bp, Homo sapiens
agtggccatgcctgtgtgagggg

SEQ ID NO: 18251 - DNA, 23 bp, Homo sapiens
agcttctagagtgattaggaagg

SEQ ID NO: 18252 - DNA, 23 bp, Homo sapiens
tgccgataactcaaaagataagg

SEQ ID NO: 18253 - DNA, 23 bp, Homo sapiens
cgctgagcacaggccttgactgg

SEQ ID NO: 18254 - DNA, 23 bp, Homo sapiens
acccatcttaatgacaagtatgg

SEQ ID NO: 18255 - DNA, 23 bp, Homo sapiens
tccctcggtggcggctacacagg

SEQ ID NO: 18256 - DNA, 23 bp, Homo sapiens
actgtcttcaagggtcacactgg

SEQ ID NO: 18257 - DNA, 23 bp, Homo sapiens
agcatgatgtgtggcgttcaagg

SEQ ID NO: 18258 - DNA, 23 bp, Homo sapiens
gattatttctggaggagcaaggg

SEQ ID NO: 18259 - DNA, 23 bp, Homo sapiens
tcagagtgagtaactccaactgg

SEQ ID NO: 18260 - DNA, 23 bp, Homo sapiens
tgaaccaagaaagaaatacgtgg

SEQ ID NO: 18261 - DNA, 23 bp, Homo sapiens
ggagggacttctaagtgaagggg

SEQ ID NO: 18262 - DNA, 23 bp, Homo sapiens
tgcttgtaatcccagcattttgg

SEQ ID NO: 18263 - DNA, 23 bp, Homo sapiens
aaagctctcagtatgaattctgg

SEQ ID NO: 18264 - DNA, 23 bp, Homo sapiens
atgttgatttctggagcctttgg

SEQ ID NO: 18265 - DNA, 23 bp, Homo sapiens
ctctgagtcgaaacccatagagg

SEQ ID NO: 18266 - DNA, 23 bp, Homo sapiens
tactggctcctgcaaacctgagg

SEQ ID NO: 18267 - DNA, 23 bp, Homo sapiens
ttgaacctcaaagcctaaggtgg

SEQ ID NO: 18268 - DNA, 23 bp, Homo sapiens
ccagaaactgagagctagtgagg

SEQ ID NO: 18269 - DNA, 23 bp, Homo sapiens
ccccacctgcccaggctcagggg

SEQ ID NO: 18270 - DNA, 23 bp, Homo sapiens
tgcccaggctcaggagtcacagg

SEQ ID NO: 18271 - DNA, 23 bp, Homo sapiens
ctgcactgtccagcctaggcagg

SEQ ID NO: 18272 - DNA, 23 bp, Homo sapiens
ggactcaggcaaaatatgcatgg

SEQ ID NO: 18273 - DNA, 23 bp, Homo sapiens
atggcagtgtcaggcgaagtagg

SEQ ID NO: 18274 - DNA, 23 bp, Homo sapiens
tggggctattttgcttagtgtgg

SEQ ID NO: 18275 - DNA, 23 bp, Homo sapiens
tttgagactacccatttctaagg

SEQ ID NO: 18276 - DNA, 23 bp, Homo sapiens
cttaggcatagaagccccagagg

SEQ ID NO: 18277 - DNA, 23 bp, Homo sapiens
ctttttgctgtgtgttcacttgg

SEQ ID NO: 18278 - DNA, 23 bp, Homo sapiens
gctgtggtggtctttattcacgg

SEQ ID NO: 18279 - DNA, 23 bp, Homo sapiens
gcggctggccctgtcctcagagg

SEQ ID NO: 18280 - DNA, 23 bp, Homo sapiens
gggtcctgagtcaacatcacagg

SEQ ID NO: 18281 - DNA, 23 bp, Homo sapiens
attccagtccagaagggtctggg

SEQ ID NO: 18282 - DNA, 23 bp, Homo sapiens
atcagagtggcaagagcaatggg

SEQ ID NO: 18283 - DNA, 23 bp, Homo sapiens
atcacgcaaaatagccccagagg

SEQ ID NO: 18284 - DNA, 23 bp, Homo sapiens
aaggaggcctacatctagggtgg

SEQ ID NO: 18285 - DNA, 23 bp, Homo sapiens
catggagttttgggagtaagtgg

SEQ ID NO: 18286 - DNA, 23 bp, Homo sapiens
gaaggagacgcacttctgagcgg

SEQ ID NO: 18287 - DNA, 23 bp, Homo sapiens
gagaaggagacccatttgtaggg

SEQ ID NO: 18288 - DNA, 23 bp, Homo sapiens
gctagagtctcactgctaggggg

SEQ ID NO: 18289 - DNA, 23 bp, Homo sapiens
acatctatgggactccccagagg

SEQ ID NO: 18290 - DNA, 23 bp, Homo sapiens
tgttagtggcagcagaaaaccgg

SEQ ID NO: 18291 - DNA, 23 bp, Homo sapiens
ccagaatctgatttgtagctggg

SEQ ID NO: 18292 - DNA, 23 bp, Homo sapiens
tctgtaacagaatttgagagagg

SEQ ID NO: 18293 - DNA, 23 bp, Homo sapiens
acccagtaaagaggttcaaaagg

SEQ ID NO: 18294 - DNA, 23 bp, Homo sapiens
agtggtcacagctccgactcagg

SEQ ID NO: 18295 - DNA, 23 bp, Homo sapiens
cttcagcgcatgtccgtgtccgg

SEQ ID NO: 18296 - DNA, 23 bp, Homo sapiens
ggggacctgaagtactgagaagg

SEQ ID NO: 18297 - DNA, 23 bp, Homo sapiens
ctcctccaggcaggctcagatgg

SEQ ID NO: 18298 - DNA, 23 bp, Homo sapiens
ttcagggatttctgttcagcagg

SEQ ID NO: 18299 - DNA, 23 bp, Homo sapiens
gaagcccacatctcaggccacgg

SEQ ID NO: 18300 - DNA, 23 bp, Homo sapiens
ccactggctcaaggtgtagaggg

SEQ ID NO: 18301 - DNA, 23 bp, Homo sapiens
tgtgttacacagcattcaagcgg

SEQ ID NO: 18302 - DNA, 23 bp, Homo sapiens
ccagtgaaggatttggaactggg

SEQ ID NO: 18303 - DNA, 23 bp, Homo sapiens
acccgagagagctcacatcatgg

SEQ ID NO: 18304 - DNA, 23 bp, Homo sapiens
gtcatcgagttctgggagtaagg

SEQ ID NO: 18305 - DNA, 23 bp, Homo sapiens
gaggaggagtcgatgatgtgagg

SEQ ID NO: 18306 - DNA, 23 bp, Homo sapiens
gagcagcaaggtcgtcgtggtgg

SEQ ID NO: 18307 - DNA, 23 bp, Homo sapiens
ctggcagctgtgctcatatccgg

SEQ ID NO: 18308 - DNA, 23 bp, Homo sapiens
gggctgtgcgtcacttgcactgg

SEQ ID NO: 18309 - DNA, 23 bp, Homo sapiens
aaaatctcattgtggcttcgagg

SEQ ID NO: 18310 - DNA, 23 bp, Homo sapiens
tatgggacaagaaacccaggtgg

SEQ ID NO: 18311 - DNA, 23 bp, Homo sapiens
ttgcctccctgatgtgtctgagg

SEQ ID NO: 18312 - DNA, 23 bp, Homo sapiens
cttgtgtgtttctcctactctgg

SEQ ID NO: 18313 - DNA, 23 bp, Homo sapiens
aaaggtgaactgagatttcttgg

SEQ ID NO: 18314 - DNA, 23 bp, Homo sapiens
tgtgacgatgtcaaactgagtgg

SEQ ID NO: 18315 - DNA, 23 bp, Homo sapiens
ggctgatcagctactccatatgg

SEQ ID NO: 18316 - DNA, 23 bp, Homo sapiens
gtcccccaggagacatagccagg

SEQ ID NO: 18317 - DNA, 23 bp, Homo sapiens
atgagaggaaaactgactagagg

SEQ ID NO: 18318 - DNA, 23 bp, Homo sapiens
acgacctggattcagactgatgg

SEQ ID NO: 18319 - DNA, 23 bp, Homo sapiens
aggagagatgcccaagcaacggg

SEQ ID NO: 18320 - DNA, 23 bp, Homo sapiens
gcggggcagccccagccctgagg

SEQ ID NO: 18321 - DNA, 23 bp, Homo sapiens
agagacggagcttgttactcagg

SEQ ID NO: 18322 - DNA, 23 bp, Homo sapiens
gccacataaaaggcttctaaagg

SEQ ID NO: 18323 - DNA, 23 bp, Homo sapiens
tgccacatccggggcttctaggg

SEQ ID NO: 18324 - DNA, 23 bp, Homo sapiens
aggcctattgctacatcaagggg

SEQ ID NO: 18325 - DNA, 23 bp, Homo sapiens
gcttcagtcacatgcttttcagg

SEQ ID NO: 18326 - DNA, 23 bp, Homo sapiens
gccctggtgttactgccccttgg

SEQ ID NO: 18327 - DNA, 23 bp, Homo sapiens
aaggcttctcactcccaaatcgg

SEQ ID NO: 18328 - DNA, 23 bp, Homo sapiens
acatgtgtgtggactcggggagg

SEQ ID NO: 18329 - DNA, 23 bp, Homo sapiens
ggtggcagcagggcgctcagagg

SEQ ID NO: 18330 - DNA, 23 bp, Homo sapiens
cgccacagatggactggaacagg

SEQ ID NO: 18331 - DNA, 23 bp, Homo sapiens
ttttttggagcaaaggactatgg

SEQ ID NO: 18332 - DNA, 23 bp, Homo sapiens
ccgaggccttgagctacagccgg

SEQ ID NO: 18333 - DNA, 23 bp, Homo sapiens
gaggggacgctaggctctccagg

SEQ ID NO: 18334 - DNA, 23 bp, Homo sapiens
gagtattagtaagcttaggctgg

SEQ ID NO: 18335 - DNA, 23 bp, Homo sapiens
aaagtcaagcattatcttccagg

SEQ ID NO: 18336 - DNA, 23 bp, Homo sapiens
cggctccgaggacgacgagcagg

SEQ ID NO: 18337 - DNA, 23 bp, Homo sapiens
ctcaagcttgagcaaactttggg

SEQ ID NO: 18338 - DNA, 23 bp, Homo sapiens
cttcggttattgcctttccttgg

SEQ ID NO: 18339 - DNA, 23 bp, Homo sapiens
taatggcgtgtaagcattttagg

SEQ ID NO: 18340 - DNA, 23 bp, Homo sapiens
agacttctgtgcaagtttagagg

SEQ ID NO: 18341 - DNA, 23 bp, Homo sapiens
ttcaactttctgcagaagcctgg

SEQ ID NO: 18342 - DNA, 23 bp, Homo sapiens
agtcccctagaataaacctaagg

SEQ ID NO: 18343 - DNA, 23 bp, Homo sapiens
aacacggtctttgaacaaccagg

SEQ ID NO: 18344 - DNA, 23 bp, Homo sapiens
ttcatcatctttcaaaaccgtgg

SEQ ID NO: 18345 - DNA, 23 bp, Homo sapiens
acattttgtcccttctgctgggg

SEQ ID NO: 18346 - DNA, 23 bp, Homo sapiens
ttactatctgttccagcagaagg

SEQ ID NO: 18347 - DNA, 23 bp, Homo sapiens
atactttggtatcctttccatgg

SEQ ID NO: 18348 - DNA, 23 bp, Homo sapiens
ggtgtctacaagattccaaaagg

SEQ ID NO: 18349 - DNA, 23 bp, Homo sapiens
taaagttgagtttccttgcctgg

SEQ ID NO: 18350 - DNA, 23 bp, Homo sapiens
gcccagggtggggtcagatgagg

SEQ ID NO: 18351 - DNA, 23 bp, Homo sapiens
gccccaagacagctcacactcgg

SEQ ID NO: 18352 - DNA, 23 bp, Homo sapiens
actcctttgtgagaagctgaggg

SEQ ID NO: 18353 - DNA, 23 bp, Homo sapiens
ccatgagtggtgtgaaaacatgg

SEQ ID NO: 18354 - DNA, 23 bp, Homo sapiens
gcggtggtcagacgctgctctgg

SEQ ID NO: 18355 - DNA, 23 bp, Homo sapiens
aatgacacatctgtggctgatgg

SEQ ID NO: 18356 - DNA, 23 bp, Homo sapiens
attcctactccaatctactttgg

SEQ ID NO: 18357 - DNA, 23 bp, Homo sapiens
ttccattttcaagcttcaggagg

SEQ ID NO: 18358 - DNA, 23 bp, Homo sapiens
agaagaaactgacttgtaactgg

SEQ ID NO: 18359 - DNA, 23 bp, Homo sapiens
aatgatgtgtcggtcagtcatgg

SEQ ID NO: 18360 - DNA, 23 bp, Homo sapiens
cgcgggggcaagggtatgagggg

SEQ ID NO: 18361 - DNA, 23 bp, Homo sapiens
ctgggtaccagattcttaatagg

SEQ ID NO: 18362 - DNA, 23 bp, Homo sapiens
taacaaaatgacacctgagtagg

SEQ ID NO: 18363 - DNA, 23 bp, Homo sapiens
tgatttggagttcttcctaatgg

SEQ ID NO: 18364 - DNA, 23 bp, Homo sapiens
cttgtcgaaggctcacctgatgg

SEQ ID NO: 18365 - DNA, 23 bp, Homo sapiens
agctcaaacaatgaaagacttgg

SEQ ID NO: 18366 - DNA, 23 bp, Homo sapiens
atataggtgctgttttgccctgg

SEQ ID NO: 18367 - DNA, 23 bp, Homo sapiens
tctacctgctttatgaaaagagg

SEQ ID NO: 18368 - DNA, 23 bp, Homo sapiens
acatctgccagccagtgacccgg

SEQ ID NO: 18369 - DNA, 23 bp, Homo sapiens
tctgaaggcttctgtgtgacagg

SEQ ID NO: 18370 - DNA, 23 bp, Homo sapiens
ctgctccccagggccctcacagg

SEQ ID NO: 18371 - DNA, 23 bp, Homo sapiens
acttcggaatgcactacaacagg

SEQ ID NO: 18372 - DNA, 23 bp, Homo sapiens
tcagatgtttgcggaagttttgg

SEQ ID NO: 18373 - DNA, 23 bp, Homo sapiens
acgcccagcgctatgcgcagagg

SEQ ID NO: 18374 - DNA, 23 bp, Homo sapiens
tggtgaagtgcggctgtacgagg

SEQ ID NO: 18375 - DNA, 23 bp, Homo sapiens
caggggcttaggaacacgcgagg

SEQ ID NO: 18376 - DNA, 23 bp, Homo sapiens
gcccacagagtgtatgactgtgg

SEQ ID NO: 18377 - DNA, 23 bp, Homo sapiens
tgcaatcagtcagctgtgaaggg

SEQ ID NO: 18378 - DNA, 23 bp, Homo sapiens
tcctggagaagacaacatacagg

SEQ ID NO: 18379 - DNA, 23 bp, Homo sapiens
aacagctttgaacaagatctagg

SEQ ID NO: 18380 - DNA, 23 bp, Homo sapiens
cttttagaactggctaaacgtgg

SEQ ID NO: 18381 - DNA, 23 bp, Homo sapiens
cctggagcagcaaacatagatgg

SEQ ID NO: 18382 - DNA, 23 bp, Homo sapiens
tgcttccctttgttatgatccgg

SEQ ID NO: 18383 - DNA, 23 bp, Homo sapiens
acgctctcatggagaagctctgg

SEQ ID NO: 18384 - DNA, 23 bp, Homo sapiens
atggatatccgatttgcttttgg

SEQ ID NO: 18385 - DNA, 23 bp, Homo sapiens
tttggtgtttcggtccattgtgg

SEQ ID NO: 18386 - DNA, 23 bp, Homo sapiens
ggaataaatctaccgttccctgg

SEQ ID NO: 18387 - DNA, 23 bp, Homo sapiens
agtgttgcatgggcatgtgtggg

SEQ ID NO: 18388 - DNA, 23 bp, Homo sapiens
gctcattttcagaatcgtcgcgg

SEQ ID NO: 18389 - DNA, 23 bp, Homo sapiens
tgactagttgctactgtccaagg

SEQ ID NO: 18390 - DNA, 23 bp, Homo sapiens
cttccgagacctctgcaactcgg

SEQ ID NO: 18391 - DNA, 23 bp, Homo sapiens
ctgaggatcaggtctccagcagg

SEQ ID NO: 18392 - DNA, 23 bp, Homo sapiens
aaggtggagcggaactgatgggg

SEQ ID NO: 18393 - DNA, 23 bp, Homo sapiens
acaaacctcttcggtgttaatgg

SEQ ID NO: 18394 - DNA, 23 bp, Homo sapiens
taagaactttatccagccactgg

SEQ ID NO: 18395 - DNA, 23 bp, Homo sapiens
atgcttgagcaacgcactgaagg

SEQ ID NO: 18396 - DNA, 23 bp, Homo sapiens
ttgatgtctctaagacacactgg

SEQ ID NO: 18397 - DNA, 23 bp, Homo sapiens
gacccacaacctttagactgagg

SEQ ID NO: 18398 - DNA, 23 bp, Homo sapiens
acagaagatatggggttcagagg

SEQ ID NO: 18399 - DNA, 23 bp, Homo sapiens
ccgccggggccgccactatctgg

SEQ ID NO: 18400 - DNA, 23 bp, Homo sapiens
tcccctccgcacgcggctaccgg

SEQ ID NO: 18401 - DNA, 23 bp, Homo sapiens
gggaaaaacctgatgtcaccagg

SEQ ID NO: 18402 - DNA, 23 bp, Homo sapiens
actgaagaaatggggttatgtgg

SEQ ID NO: 18403 - DNA, 23 bp, Homo sapiens
ggccaagggcagcgagaaagagg

SEQ ID NO: 18404 - DNA, 23 bp, Homo sapiens
agactctcagcacacaactgtgg

SEQ ID NO: 18405 - DNA, 23 bp, Homo sapiens
tctactggccaatgacaaggtgg

SEQ ID NO: 18406 - DNA, 23 bp, Homo sapiens
agactctcagtcctcagatgtgg

SEQ ID NO: 18407 - DNA, 23 bp, Homo sapiens
acgggcaactaaaactccaatgg

SEQ ID NO: 18408 - DNA, 23 bp, Homo sapiens
tggaaagaaggatgtcaagaagg

SEQ ID NO: 18409 - DNA, 23 bp, Homo sapiens
acagtcagaaggaagtgggacgg

SEQ ID NO: 18410 - DNA, 23 bp, Homo sapiens
cttcgctgccacttcctgagcgg

SEQ ID NO: 18411 - DNA, 23 bp, Homo sapiens
gatggcgcacctgatggtcgagg

SEQ ID NO: 18412 - DNA, 23 bp, Homo sapiens
agtaatgtggctatatctgctgg

SEQ ID NO: 18413 - DNA, 23 bp, Homo sapiens
tttacgtctcccctgtaaaaggg

SEQ ID NO: 18414 - DNA, 23 bp, Homo sapiens
gtgctgatgggctggttaccagg

SEQ ID NO: 18415 - DNA, 23 bp, Homo sapiens
gcctcagctgctccttagcctgg

SEQ ID NO: 18416 - DNA, 23 bp, Homo sapiens
gtctggctggctcctcactgtgg

SEQ ID NO: 18417 - DNA, 23 bp, Homo sapiens
ctgggaatccggaatacataggg

SEQ ID NO: 18418 - DNA, 23 bp, Homo sapiens
gatccctgagcagttaggtcagg

SEQ ID NO: 18419 - DNA, 23 bp, Homo sapiens
gctggttgtgcgcaacacctagg

SEQ ID NO: 18420 - DNA, 23 bp, Homo sapiens
tcttctggtatgggatctgttgg

SEQ ID NO: 18421 - DNA, 23 bp, Homo sapiens
aaaatactgctactgctcattgg

SEQ ID NO: 18422 - DNA, 23 bp, Homo sapiens
tgctgcaggactgcccctagcgg

SEQ ID NO: 18423 - DNA, 23 bp, Homo sapiens
accacccaaaggagcacatgtgg

SEQ ID NO: 18424 - DNA, 23 bp, Homo sapiens
tgataccacacatggttaattgg

SEQ ID NO: 18425 - DNA, 23 bp, Homo sapiens
gcccactcccctttacttcatgg

SEQ ID NO: 18426 - DNA, 23 bp, Homo sapiens
taaaggctttccaaaggcggcgg

SEQ ID NO: 18427 - DNA, 23 bp, Homo sapiens
aagaagaagatgatgaccaaagg

SEQ ID NO: 18428 - DNA, 23 bp, Homo sapiens
aaccaaaacagatgtatgagagg

SEQ ID NO: 18429 - DNA, 23 bp, Homo sapiens
acaggttagtttttgacagatgg

SEQ ID NO: 18430 - DNA, 23 bp, Homo sapiens
gtatctttaggagggtaacaagg

SEQ ID NO: 18431 - DNA, 23 bp, Homo sapiens
aaacggctgttcatttcatttgg

SEQ ID NO: 18432 - DNA, 23 bp, Homo sapiens
agccggctgcggggctcactcgg

SEQ ID NO: 18433 - DNA, 23 bp, Homo sapiens
ttcttctgctctcatttgcttgg

SEQ ID NO: 18434 - DNA, 23 bp, Homo sapiens
gacatagtcaaacctgagcatgg

SEQ ID NO: 18435 - DNA, 23 bp, Homo sapiens
acatgacatttttgttccagagg

SEQ ID NO: 18436 - DNA, 23 bp, Homo sapiens
ttggacagcctgggtgtgaatgg

SEQ ID NO: 18437 - DNA, 23 bp, Homo sapiens
aatatcaatctacttgctggagg

SEQ ID NO: 18438 - DNA, 23 bp, Homo sapiens
ctcagtgccctgactacaactgg

SEQ ID NO: 18439 - DNA, 23 bp, Homo sapiens
tgtgtaccagaatcagttgttgg

SEQ ID NO: 18440 - DNA, 23 bp, Homo sapiens
gggttttcgtacttttttggtgg

SEQ ID NO: 18441 - DNA, 23 bp, Homo sapiens
tacaagcagtggaaggaaattgg

SEQ ID NO: 18442 - DNA, 23 bp, Homo sapiens
cgtgggcccaggtgggctgaggg

SEQ ID NO: 18443 - DNA, 23 bp, Homo sapiens
ttgccactttggcctcagtgtgg

SEQ ID NO: 18444 - DNA, 23 bp, Homo sapiens
ttttggaagagacgaaagaaagg

SEQ ID NO: 18445 - DNA, 23 bp, Homo sapiens
ggtgctccgtggggttcttaagg

SEQ ID NO: 18446 - DNA, 23 bp, Homo sapiens
tacagccgcctgctggcctgagg

SEQ ID NO: 18447 - DNA, 23 bp, Homo sapiens
tgtgcacatagtagcctgtgagg

SEQ ID NO: 18448 - DNA, 23 bp, Homo sapiens
ggctctaaatatatacctgcagg

SEQ ID NO: 18449 - DNA, 23 bp, Homo sapiens
gatcctcaacatccgattgcagg

SEQ ID NO: 18450 - DNA, 23 bp, Homo sapiens
gtggccgtattggcctagagggg

SEQ ID NO: 18451 - DNA, 23 bp, Homo sapiens
ctcttgcactggtaccctgaggg

SEQ ID NO: 18452 - DNA, 23 bp, Homo sapiens
aacaaaaactggaggctgaaagg

SEQ ID NO: 18453 - DNA, 23 bp, Homo sapiens
tgttttcaagcaaattcacgagg

SEQ ID NO: 18454 - DNA, 23 bp, Homo sapiens
aatgcagacatcaatgactgtgg

SEQ ID NO: 18455 - DNA, 23 bp, Homo sapiens
atatcacaaagttagtccacagg

SEQ ID NO: 18456 - DNA, 23 bp, Homo sapiens
cagtactctgttgcagtgagagg

SEQ ID NO: 18457 - DNA, 23 bp, Homo sapiens
ttttgttcctggttttaacgggg

SEQ ID NO: 18458 - DNA, 23 bp, Homo sapiens
cagaaaacgtgaaactgaagtgg

SEQ ID NO: 18459 - DNA, 23 bp, Homo sapiens
tgacagtgtgcaactctcattgg

SEQ ID NO: 18460 - DNA, 23 bp, Homo sapiens
caaagtcaggtgccagaagcagg

SEQ ID NO: 18461 - DNA, 23 bp, Homo sapiens
gggtgagatagcttcatttttgg

SEQ ID NO: 18462 - DNA, 23 bp, Homo sapiens
ggtttctgaagactggaaaaggg

SEQ ID NO: 18463 - DNA, 23 bp, Homo sapiens
ttctgcttctgctgtgttcctgg

SEQ ID NO: 18464 - DNA, 23 bp, Homo sapiens
agacacagggtcagggttccagg

SEQ ID NO: 18465 - DNA, 23 bp, Homo sapiens
gctagagatttctctaagcgggg

SEQ ID NO: 18466 - DNA, 23 bp, Homo sapiens
ctgtgctctttgctctctcatgg

SEQ ID NO: 18467 - DNA, 23 bp, Homo sapiens
acagttttaatagctccctctgg

SEQ ID NO: 18468 - DNA, 23 bp, Homo sapiens
gttgccctgattcccattttggg

SEQ ID NO: 18469 - DNA, 23 bp, Homo sapiens
ccctggtacagaaccatgactgg

SEQ ID NO: 18470 - DNA, 23 bp, Homo sapiens
ttagtctagatttcagggagtgg

SEQ ID NO: 18471 - DNA, 23 bp, Homo sapiens
ttcgtcccaaagattttgtctgg

SEQ ID NO: 18472 - DNA, 23 bp, Homo sapiens
aggagggctagagaaagcaaagg

SEQ ID NO: 18473 - DNA, 23 bp, Homo sapiens
cgctggaggaggagctgagctgg

SEQ ID NO: 18474 - DNA, 23 bp, Homo sapiens
aggcatttgtgcctgcttggggg

SEQ ID NO: 18475 - DNA, 23 bp, Homo sapiens
caaaagggcgattgcatcaccgg

SEQ ID NO: 18476 - DNA, 23 bp, Homo sapiens
tttcttgaaagtgagcagtaagg

SEQ ID NO: 18477 - DNA, 23 bp, Homo sapiens
aagacgcggccggtgtagcttgg

SEQ ID NO: 18478 - DNA, 23 bp, Homo sapiens
tctgcatcagactagcccgttgg

SEQ ID NO: 18479 - DNA, 23 bp, Homo sapiens
aagacagtatcagagaaggctgg

SEQ ID NO: 18480 - DNA, 23 bp, Homo sapiens
agtgtcaaattaccgtcgcgagg

SEQ ID NO: 18481 - DNA, 23 bp, Homo sapiens
tcagtgtgaagcgggtgaagagg

SEQ ID NO: 18482 - DNA, 23 bp, Homo sapiens
acatcatgaagatgttccacagg

SEQ ID NO: 18483 - DNA, 23 bp, Homo sapiens
tgcctttccatctagcactgggg

SEQ ID NO: 18484 - DNA, 23 bp, Homo sapiens
ccagcactactaatcccatttgg

SEQ ID NO: 18485 - DNA, 23 bp, Homo sapiens
ggaagtggggacagaaatggggg

SEQ ID NO: 18486 - DNA, 23 bp, Homo sapiens
tgaatcttctagttcttcagtgg

SEQ ID NO: 18487 - DNA, 23 bp, Homo sapiens
gtgctcccaaaggaaagaaaggg

SEQ ID NO: 18488 - DNA, 23 bp, Homo sapiens
ccctgtaccagagaatgaaatgg

SEQ ID NO: 18489 - DNA, 23 bp, Homo sapiens
tacatgagtggctatcatactgg

SEQ ID NO: 18490 - DNA, 23 bp, Homo sapiens
atgcctgacattgtatttagagg

SEQ ID NO: 18491 - DNA, 23 bp, Homo sapiens
agaactcatggatgcagactcgg

SEQ ID NO: 18492 - DNA, 23 bp, Homo sapiens
ggttttctgctccttagacgagg

SEQ ID NO: 18493 - DNA, 23 bp, Homo sapiens
gccaaggaaacaaggataaatgg

SEQ ID NO: 18494 - DNA, 23 bp, Homo sapiens
tcttccagcaggggacctgaggg

SEQ ID NO: 18495 - DNA, 23 bp, Homo sapiens
caagagccagaagttctcacggg

SEQ ID NO: 18496 - DNA, 23 bp, Homo sapiens
ccaaggccactgttttgctaggg

SEQ ID NO: 18497 - DNA, 23 bp, Homo sapiens
taccgtgtgtaccaaatagatgg

SEQ ID NO: 18498 - DNA, 23 bp, Homo sapiens
actcctggggcagcaggaggggg

SEQ ID NO: 18499 - DNA, 23 bp, Homo sapiens
ggtgtcttcgggggaggaggagg

SEQ ID NO: 18500 - DNA, 23 bp, Homo sapiens
ggaagctgcaccagccctgaagg

SEQ ID NO: 18501 - DNA, 23 bp, Homo sapiens
ctgtttgaggcaatctgcatagg

SEQ ID NO: 18502 - DNA, 23 bp, Homo sapiens
gaaggagctcaaccttcctgagg

SEQ ID NO: 18503 - DNA, 23 bp, Homo sapiens
gtcacagcacgagcgtgcacagg

SEQ ID NO: 18504 - DNA, 23 bp, Homo sapiens
ccccaaagctgaacagtagtagg

SEQ ID NO: 18505 - DNA, 23 bp, Homo sapiens
gttgtctgtatttagggtgcagg

SEQ ID NO: 18506 - DNA, 23 bp, Homo sapiens
ccaccccctcctcaaccctaagg

SEQ ID NO: 18507 - DNA, 23 bp, Homo sapiens
tgtgggtattttacactgtttgg

SEQ ID NO: 18508 - DNA, 23 bp, Homo sapiens
gagcaggggttaggactttttgg

SEQ ID NO: 18509 - DNA, 23 bp, Homo sapiens
gctagacattcttgccgcgcagg

SEQ ID NO: 18510 - DNA, 23 bp, Homo sapiens
aagaccaagaagaagtgaggagg

SEQ ID NO: 18511 - DNA, 23 bp, Homo sapiens
ggctttactcgaagcgacgcagg

SEQ ID NO: 18512 - DNA, 23 bp, Homo sapiens
aagatggactcctaaagctctgg

SEQ ID NO: 18513 - DNA, 23 bp, Homo sapiens
aaagttccaagtttcaaagctgg

SEQ ID NO: 18514 - DNA, 23 bp, Homo sapiens
ggcactcatttcaacagcagtgg

SEQ ID NO: 18515 - DNA, 23 bp, Homo sapiens
ggagacctgcgggtttgctgtgg

SEQ ID NO: 18516 - DNA, 23 bp, Homo sapiens
agaaacatgtggatttgctgtgg

SEQ ID NO: 18517 - DNA, 23 bp, Homo sapiens
ctgttccacaagaagcaatgagg

SEQ ID NO: 18518 - DNA, 23 bp, Homo sapiens
gaaatgctgcatagtttcagtgg

SEQ ID NO: 18519 - DNA, 23 bp, Homo sapiens
ccaacatcagagcatcctaaggg

SEQ ID NO: 18520 - DNA, 23 bp, Homo sapiens
cctgtagggcctgcattgtaggg

SEQ ID NO: 18521 - DNA, 23 bp, Homo sapiens
gccagaagatgcagagctggggg

SEQ ID NO: 18522 - DNA, 23 bp, Homo sapiens
gagggagcctcgagggtcagcgg

SEQ ID NO: 18523 - DNA, 23 bp, Homo sapiens
ctgcacaaacatgaggaatctgg

SEQ ID NO: 18524 - DNA, 23 bp, Homo sapiens
gccgaccacgtgcctctcagggg

SEQ ID NO: 18525 - DNA, 23 bp, Homo sapiens
gtcaatgagtttctttgctctgg

SEQ ID NO: 18526 - DNA, 23 bp, Homo sapiens
gcaacaaagatgctgggaagtgg

SEQ ID NO: 18527 - DNA, 23 bp, Homo sapiens
gacatctaacttgtccactttgg

SEQ ID NO: 18528 - DNA, 23 bp, Homo sapiens
ggatgaagaggctgacctagggg

SEQ ID NO: 18529 - DNA, 23 bp, Homo sapiens
agacagagactttcctagcaggg

SEQ ID NO: 18530 - DNA, 23 bp, Homo sapiens
attagcggatcttaacatcaagg

SEQ ID NO: 18531 - DNA, 23 bp, Homo sapiens
tcagtgttttctcctcttcttgg

SEQ ID NO: 18532 - DNA, 23 bp, Homo sapiens
agccacccctgccaggtgagggg

SEQ ID NO: 18533 - DNA, 23 bp, Homo sapiens
gcttatccttatgttgatcctgg

SEQ ID NO: 18534 - DNA, 23 bp, Homo sapiens
cacccggaagcggaggcggctgg

SEQ ID NO: 18535 - DNA, 23 bp, Homo sapiens
ccaccacagctagtgagtagcgg

SEQ ID NO: 18536 - DNA, 23 bp, Homo sapiens
tgtgacggaagaggaggaggagg

SEQ ID NO: 18537 - DNA, 23 bp, Homo sapiens
aggctcatctgttatttgcctgg

SEQ ID NO: 18538 - DNA, 23 bp, Homo sapiens
caaaaaggaccagttgggcaagg

SEQ ID NO: 18539 - DNA, 23 bp, Homo sapiens
ggcttatgaaatgccttctgagg

SEQ ID NO: 18540 - DNA, 23 bp, Homo sapiens
aagaagagttcttttgactctgg

SEQ ID NO: 18541 - DNA, 23 bp, Homo sapiens
cgctagcaaaggaaagaataagg

SEQ ID NO: 18542 - DNA, 23 bp, Homo sapiens
agtatgagccagaggcgtagggg

SEQ ID NO: 18543 - DNA, 23 bp, Homo sapiens
ccgcccgggacacgctcacatgg

SEQ ID NO: 18544 - DNA, 23 bp, Homo sapiens
ccagagtgggggagactagaggg

SEQ ID NO: 18545 - DNA, 23 bp, Homo sapiens
tgccccccaacaggagggtgagg

SEQ ID NO: 18546 - DNA, 23 bp, Homo sapiens
tttggctacagccgctaaggagg

SEQ ID NO: 18547 - DNA, 23 bp, Homo sapiens
cagacactggagaaatcttaagg

SEQ ID NO: 18548 - DNA, 23 bp, Homo sapiens
gcccttccacatgcagtcagggg

SEQ ID NO: 18549 - DNA, 23 bp, Homo sapiens
tgacgaggatgaggaggaggagg

SEQ ID NO: 18550 - DNA, 23 bp, Homo sapiens
cttgcatcctggctcagccgtgg

SEQ ID NO: 18551 - DNA, 23 bp, Homo sapiens
ggcggctcccagctctgaggggg

SEQ ID NO: 18552 - DNA, 23 bp, Homo sapiens
ggggccacagtcagatgacatgg

SEQ ID NO: 18553 - DNA, 23 bp, Homo sapiens
ccaggagtacaaattcagcgtgg

SEQ ID NO: 18554 - DNA, 23 bp, Homo sapiens
tttccttcatcaaaaagctgagg

SEQ ID NO: 18555 - DNA, 23 bp, Homo sapiens
tctcatgcaatgaaatccaaagg

SEQ ID NO: 18556 - DNA, 23 bp, Homo sapiens
agaaggaaagaggcaagtagagg

SEQ ID NO: 18557 - DNA, 23 bp, Homo sapiens
agtgacaagagactgtatatggg

SEQ ID NO: 18558 - DNA, 23 bp, Homo sapiens
agtcgagaagaaggaaagagagg

SEQ ID NO: 18559 - DNA, 23 bp, Homo sapiens
gaggctgcgccggagtgaagagg

SEQ ID NO: 18560 - DNA, 23 bp, Homo sapiens
ggggaaaaggtgctacttcttgg

SEQ ID NO: 18561 - DNA, 23 bp, Homo sapiens
aagaagacacagtcacaaacggg

SEQ ID NO: 18562 - DNA, 23 bp, Homo sapiens
ccaagatgagtctagggccttgg

SEQ ID NO: 18563 - DNA, 23 bp, Homo sapiens
ctgtggccaagggtcaaagaagg

SEQ ID NO: 18564 - DNA, 23 bp, Homo sapiens
cataggtgatcttcatagcatgg

SEQ ID NO: 18565 - DNA, 23 bp, Homo sapiens
atgactcgaccagacagataagg

SEQ ID NO: 18566 - DNA, 23 bp, Homo sapiens
cttgagagacattatcgcctagg

SEQ ID NO: 18567 - DNA, 23 bp, Homo sapiens
cgctcatcgccggcaagtagggg

SEQ ID NO: 18568 - DNA, 23 bp, Homo sapiens
agaggacgtggaatgggacgtgg

SEQ ID NO: 18569 - DNA, 23 bp, Homo sapiens
ctgggtcggatcatgctaaaagg

SEQ ID NO: 18570 - DNA, 23 bp, Homo sapiens
ggaagaagaggaagaagatgggg

SEQ ID NO: 18571 - DNA, 23 bp, Homo sapiens
gcataaagacctccaaggagtgg

SEQ ID NO: 18572 - DNA, 23 bp, Homo sapiens
tatcatcatgttagaagccttgg

SEQ ID NO: 18573 - DNA, 23 bp, Homo sapiens
tcaacagtatgctaaggtcttgg

SEQ ID NO: 18574 - DNA, 23 bp, Homo sapiens
agtcacccgcctcgggctgttgg

SEQ ID NO: 18575 - DNA, 23 bp, Homo sapiens
gattacaagactgggcttggtgg

SEQ ID NO: 18576 - DNA, 23 bp, Homo sapiens
tcggccaaagtcactcgtatggg

SEQ ID NO: 18577 - DNA, 23 bp, Homo sapiens
gcaacaaaggtaatgtgttcagg

SEQ ID NO: 18578 - DNA, 23 bp, Homo sapiens
tgtatactttgctttgctcgtgg

SEQ ID NO: 18579 - DNA, 23 bp, Homo sapiens
aatacatgtacagcagctaaagg

SEQ ID NO: 18580 - DNA, 23 bp, Homo sapiens
tgtgctcatcaagttcagaaagg

SEQ ID NO: 18581 - DNA, 23 bp, Homo sapiens
ttagactaagagcctttcaatgg

SEQ ID NO: 18582 - DNA, 23 bp, Homo sapiens
tctctctttaattctccatgagg

SEQ ID NO: 18583 - DNA, 23 bp, Homo sapiens
atatggctttaaccacctcttgg

SEQ ID NO: 18584 - DNA, 23 bp, Homo sapiens
caagaagaggaggaaggaatagg

SEQ ID NO: 18585 - DNA, 23 bp, Homo sapiens
gggtaagagttcattcactttgg

SEQ ID NO: 18586 - DNA, 23 bp, Homo sapiens
aggcaaaggccatctcctaatgg

SEQ ID NO: 18587 - DNA, 23 bp, Homo sapiens
acctcagctacctgttctgaggg

SEQ ID NO: 18588 - DNA, 23 bp, Homo sapiens
taaagtaaatacagctccgcagg

SEQ ID NO: 18589 - DNA, 23 bp, Homo sapiens
tggtcagttagaaacagttttgg

SEQ ID NO: 18590 - DNA, 23 bp, Homo sapiens
gtggtgagaggggctcctactgg

SEQ ID NO: 18591 - DNA, 23 bp, Homo sapiens
cagcgttcattctgagccagtgg

SEQ ID NO: 18592 - DNA, 23 bp, Homo sapiens
aagcgccttctttgcagaaaagg

SEQ ID NO: 18593 - DNA, 23 bp, Homo sapiens
agaggatccgatgatggggatgg

SEQ ID NO: 18594 - DNA, 23 bp, Homo sapiens
taggagacacagtgagaccaagg

SEQ ID NO: 18595 - DNA, 23 bp, Homo sapiens
aagttacctctgtgacatcttgg

SEQ ID NO: 18596 - DNA, 23 bp, Homo sapiens
tctcaactcccaccctaacaggg

SEQ ID NO: 18597 - DNA, 23 bp, Homo sapiens
agagatagaagtagcagaagtgg

SEQ ID NO: 18598 - DNA, 23 bp, Homo sapiens
cttcgagggcattggagatgagg

SEQ ID NO: 18599 - DNA, 23 bp, Homo sapiens
aatgatagcactgtcatcaaagg

SEQ ID NO: 18600 - DNA, 23 bp, Homo sapiens
gaagagcttcttccaacttctgg

SEQ ID NO: 18601 - DNA, 23 bp, Homo sapiens
gagcagagacgtggacgcctggg

SEQ ID NO: 18602 - DNA, 23 bp, Homo sapiens
gaagctcagggaaaactgagtgg

SEQ ID NO: 18603 - DNA, 23 bp, Homo sapiens
caacactggagttcaacacatgg

SEQ ID NO: 18604 - DNA, 23 bp, Homo sapiens
gatgggtgtctcctcttagctgg

SEQ ID NO: 18605 - DNA, 23 bp, Homo sapiens
ggatctcagtgcctctgttgagg

SEQ ID NO: 18606 - DNA, 23 bp, Homo sapiens
acaatcttattgctaggcaatgg

SEQ ID NO: 18607 - DNA, 23 bp, Homo sapiens
agggtcttgatatcagggtgtgg

SEQ ID NO: 18608 - DNA, 23 bp, Homo sapiens
agtaaaaggagactgctcaaagg

SEQ ID NO: 18609 - DNA, 23 bp, Homo sapiens
cgagaatacctgcactgagccgg

SEQ ID NO: 18610 - DNA, 23 bp, Homo sapiens
attgctcatcaaggaggtgctgg

SEQ ID NO: 18611 - DNA, 23 bp, Homo sapiens
gggaaggagatggcagccattgg

SEQ ID NO: 18612 - DNA, 23 bp, Homo sapiens
ctctggactgatcagggcatcgg

SEQ ID NO: 18613 - DNA, 23 bp, Homo sapiens
agccatgtaggatttctacctgg

SEQ ID NO: 18614 - DNA, 23 bp, Homo sapiens
tctaaatgaactctcagctcagg

SEQ ID NO: 18615 - DNA, 23 bp, Homo sapiens
cgagctcaagtggagaaaagagg

SEQ ID NO: 18616 - DNA, 23 bp, Homo sapiens
ggggataaggaaaggctaggtgg

SEQ ID NO: 18617 - DNA, 23 bp, Homo sapiens
tgcggttttgtcgaggtcagagg

SEQ ID NO: 18618 - DNA, 23 bp, Homo sapiens
caacgttcgttctgtgccagagg

SEQ ID NO: 18619 - DNA, 23 bp, Homo sapiens
cagccgccgggtgtcagccacgg

SEQ ID NO: 18620 - DNA, 23 bp, Homo sapiens
tcccaagaaagaactttacttgg

SEQ ID NO: 18621 - DNA, 23 bp, Homo sapiens
ctgcgtttttgggaacataaagg

SEQ ID NO: 18622 - DNA, 23 bp, Homo sapiens
tactctaaggctccccctttagg

SEQ ID NO: 18623 - DNA, 23 bp, Homo sapiens
gcccaggcacacgcggtcagagg

SEQ ID NO: 18624 - DNA, 23 bp, Homo sapiens
tcaagtttggaccaatgctaagg

SEQ ID NO: 18625 - DNA, 23 bp, Homo sapiens
agtcaatacagctctgcaaaagg

SEQ ID NO: 18626 - DNA, 23 bp, Homo sapiens
aactgcctggcagtgttaaatgg

SEQ ID NO: 18627 - DNA, 23 bp, Homo sapiens
cagaggcttcttccaagtgaagg

SEQ ID NO: 18628 - DNA, 23 bp, Homo sapiens
ctcagcctcaggcgctagtgagg

SEQ ID NO: 18629 - DNA, 23 bp, Homo sapiens
cagccgctttccagtgatgtagg

SEQ ID NO: 18630 - DNA, 23 bp, Homo sapiens
aaacacgtaacgacaagtccagg

SEQ ID NO: 18631 - DNA, 23 bp, Homo sapiens
cttggtcctgccatacctagagg

SEQ ID NO: 18632 - DNA, 23 bp, Homo sapiens
tggagccgccgctcaaaaggagg

SEQ ID NO: 18633 - DNA, 23 bp, Homo sapiens
cttccccttccagatttgaccgg

SEQ ID NO: 18634 - DNA, 23 bp, Homo sapiens
tggtaaaggcagtccccagatgg

SEQ ID NO: 18635 - DNA, 23 bp, Homo sapiens
gtacgatgccccgctttaagggg

SEQ ID NO: 18636 - DNA, 23 bp, Homo sapiens
tgttactagcattgctgttctgg

SEQ ID NO: 18637 - DNA, 23 bp, Homo sapiens
agagtttactttgccttgactgg

SEQ ID NO: 18638 - DNA, 23 bp, Homo sapiens
gcctttgccaaacaaaatgaagg

SEQ ID NO: 18639 - DNA, 23 bp, Homo sapiens
gtggaaccctccacgtagcgagg

SEQ ID NO: 18640 - DNA, 23 bp, Homo sapiens
acatccaagggaatgtttattgg

SEQ ID NO: 18641 - DNA, 23 bp, Homo sapiens
aagtgtgttcaaacccatcgagg

SEQ ID NO: 18642 - DNA, 23 bp, Homo sapiens
actgctggggattgatgtgtggg

SEQ ID NO: 18643 - DNA, 23 bp, Homo sapiens
gggtgggggccgcgctcaggcgg

SEQ ID NO: 18644 - DNA, 23 bp, Homo sapiens
gggaagggggttcacagtattgg

SEQ ID NO: 18645 - DNA, 23 bp, Homo sapiens
ttggctgctctgtcactcgctgg

SEQ ID NO: 18646 - DNA, 23 bp, Homo sapiens
actcacggaaatgggctcctcgg

SEQ ID NO: 18647 - DNA, 23 bp, Homo sapiens
gctcatatcaggtgcttacgcgg

SEQ ID NO: 18648 - DNA, 23 bp, Homo sapiens
tccacagcctggctgctagcagg

SEQ ID NO: 18649 - DNA, 23 bp, Homo sapiens
ctctcttcttcattcaagcaagg

SEQ ID NO: 18650 - DNA, 23 bp, Homo sapiens
tgggatgtgtagtgcacgtctgg

SEQ ID NO: 18651 - DNA, 23 bp, Homo sapiens
acatacaattgggtctggtaagg

SEQ ID NO: 18652 - DNA, 23 bp, Homo sapiens
actttctcttctatagtaggtgg

SEQ ID NO: 18653 - DNA, 23 bp, Homo sapiens
tctatagctctagattttggtgg

SEQ ID NO: 18654 - DNA, 23 bp, Homo sapiens
aaaggttttacatagttgcctgg

SEQ ID NO: 18655 - DNA, 23 bp, Homo sapiens
tccccggaaactacgtcaagagg

SEQ ID NO: 18656 - DNA, 23 bp, Homo sapiens
ttacgttgccccggtgtgagtgg

SEQ ID NO: 18657 - DNA, 23 bp, Homo sapiens
aaggtggaatcccagctcatagg

SEQ ID NO: 18658 - DNA, 23 bp, Homo sapiens
agtgatgtgcatagcagtgatgg

SEQ ID NO: 18659 - DNA, 23 bp, Homo sapiens
gctttgattctcagcaactatgg

SEQ ID NO: 18660 - DNA, 23 bp, Homo sapiens
ggggcacagtatgcaatttaagg

SEQ ID NO: 18661 - DNA, 23 bp, Homo sapiens
tggggtggcatcagctcaccagg

SEQ ID NO: 18662 - DNA, 23 bp, Homo sapiens
attaaacactagtgcagttgggg

SEQ ID NO: 18663 - DNA, 23 bp, Homo sapiens
cccattaacatcagggattctgg

SEQ ID NO: 18664 - DNA, 23 bp, Homo sapiens
gctctttcaggctatcaccatgg

SEQ ID NO: 18665 - DNA, 23 bp, Homo sapiens
ctctgaagagctattccaagagg

SEQ ID NO: 18666 - DNA, 23 bp, Homo sapiens
acagaggaactcaggaagaatgg

SEQ ID NO: 18667 - DNA, 23 bp, Homo sapiens
acatatggctaaggtcattgggg

SEQ ID NO: 18668 - DNA, 23 bp, Homo sapiens
gggcgcgggcgggctctagtagg

SEQ ID NO: 18669 - DNA, 23 bp, Homo sapiens
ctaactcatgctgtgcttgctgg

SEQ ID NO: 18670 - DNA, 23 bp, Homo sapiens
gtttgcctccaacaacctgaagg

SEQ ID NO: 18671 - DNA, 23 bp, Homo sapiens
gaagagtatagtgactgaggtgg

SEQ ID NO: 18672 - DNA, 23 bp, Homo sapiens
agaccaaagtccaatgtatttgg

SEQ ID NO: 18673 - DNA, 23 bp, Homo sapiens
tcattccaggaccgttgacaggg

SEQ ID NO: 18674 - DNA, 23 bp, Homo sapiens
gaaggcgctagatgtgcgtcagg

SEQ ID NO: 18675 - DNA, 23 bp, Homo sapiens
acactgtcccggccctaaagggg

SEQ ID NO: 18676 - DNA, 23 bp, Homo sapiens
cctggtgttcacatattgaaagg

SEQ ID NO: 18677 - DNA, 23 bp, Homo sapiens
ccgctgacggtgggctcagtagg

SEQ ID NO: 18678 - DNA, 23 bp, Homo sapiens
gaagagcgatggggagttggtgg

SEQ ID NO: 18679 - DNA, 23 bp, Homo sapiens
gggccgggctgggggttacatgg

SEQ ID NO: 18680 - DNA, 23 bp, Homo sapiens
tctgcgtccatgagggttagagg

SEQ ID NO: 18681 - DNA, 23 bp, Homo sapiens
caactatcctgacgtgtgacagg

SEQ ID NO: 18682 - DNA, 23 bp, Homo sapiens
ggcggcgccggcggcctagccgg

SEQ ID NO: 18683 - DNA, 23 bp, Homo sapiens
tgcccctctcacacatgtgaggg

SEQ ID NO: 18684 - DNA, 23 bp, Homo sapiens
ggccccgcggggtcatagcgcgg

SEQ ID NO: 18685 - DNA, 23 bp, Homo sapiens
cgcaggccggtgctcagatgtgg

SEQ ID NO: 18686 - DNA, 23 bp, Homo sapiens
gacaggtacccaaaacatgaggg

SEQ ID NO: 18687 - DNA, 23 bp, Homo sapiens
ggaagaagaaaaagtgctcaggg

SEQ ID NO: 18688 - DNA, 23 bp, Homo sapiens
cctggttttcacctactgaaggg

SEQ ID NO: 18689 - DNA, 23 bp, Homo sapiens
gcaggacaagccaactgataagg

SEQ ID NO: 18690 - DNA, 23 bp, Homo sapiens
gcaaacaaaaactcctcagttgg

SEQ ID NO: 18691 - DNA, 23 bp, Homo sapiens
actgtagctgttgtagtacgtgg

SEQ ID NO: 18692 - DNA, 23 bp, Homo sapiens
ccaccctgaccaggccctgaggg

SEQ ID NO: 18693 - DNA, 23 bp, Homo sapiens
cagctcactcgaccttgaggagg

SEQ ID NO: 18694 - DNA, 23 bp, Homo sapiens
tccattaatatcagtggcaatgg

SEQ ID NO: 18695 - DNA, 23 bp, Homo sapiens
tgaagaggatgaacaagaggagg

SEQ ID NO: 18696 - DNA, 23 bp, Homo sapiens
accaccaagcacaagaaaaaagg

SEQ ID NO: 18697 - DNA, 23 bp, Homo sapiens
agggtcaggtaaagaagattagg

SEQ ID NO: 18698 - DNA, 23 bp, Homo sapiens
cagactgggaattcaagtacagg

SEQ ID NO: 18699 - DNA, 23 bp, Homo sapiens
aagccaatgacggcggtttctgg

SEQ ID NO: 18700 - DNA, 23 bp, Homo sapiens
cgttgtgaaggaatgaccctagg

SEQ ID NO: 18701 - DNA, 23 bp, Homo sapiens
aacaaatgggaacaattgactgg

SEQ ID NO: 18702 - DNA, 23 bp, Homo sapiens
cacatactggtacactgaggagg

SEQ ID NO: 18703 - DNA, 23 bp, Homo sapiens
aacaaatgggaacagttgactgg

SEQ ID NO: 18704 - DNA, 23 bp, Homo sapiens
ctggtcacgaagaacttgtaagg

SEQ ID NO: 18705 - DNA, 23 bp, Homo sapiens
agtttctggaaatgagacaatgg

SEQ ID NO: 18706 - DNA, 23 bp, Homo sapiens
tcccaatgtttcaaccaacatgg

SEQ ID NO: 18707 - DNA, 23 bp, Homo sapiens
ccacctccgggagggctcacagg

SEQ ID NO: 18708 - DNA, 23 bp, Homo sapiens
gcggcactgaggagctcagttgg

SEQ ID NO: 18709 - DNA, 23 bp, Homo sapiens
aacttgctggagatctgagccgg

SEQ ID NO: 18710 - DNA, 23 bp, Homo sapiens
cgcagggtgggcgtcactctagg

SEQ ID NO: 18711 - DNA, 23 bp, Homo sapiens
ggaggcaaggaagcagcgtctgg

SEQ ID NO: 18712 - DNA, 23 bp, Homo sapiens
gggacacatagccagagaggagg

SEQ ID NO: 18713 - DNA, 23 bp, Homo sapiens
tggggcttaggagagctctgagg

SEQ ID NO: 18714 - DNA, 23 bp, Homo sapiens
cttaaagcatcatcttcaccagg

SEQ ID NO: 18715 - DNA, 23 bp, Homo sapiens
ctttggactacgaggctgatggg

SEQ ID NO: 18716 - DNA, 23 bp, Homo sapiens
gatggctgtgacttctaggatgg

SEQ ID NO: 18717 - DNA, 23 bp, Homo sapiens
gctctgcgtcttagaaccagtgg

SEQ ID NO: 18718 - DNA, 23 bp, Homo sapiens
atttatctgaatggctcaagggg

SEQ ID NO: 18719 - DNA, 23 bp, Homo sapiens
ttctttcgatggtactgcagtgg

SEQ ID NO: 18720 - DNA, 23 bp, Homo sapiens
aggagccaaggcagtcagtgagg

SEQ ID NO: 18721 - DNA, 23 bp, Homo sapiens
ctccgagaagttgccgcgcaagg

SEQ ID NO: 18722 - DNA, 23 bp, Homo sapiens
ctgagttacaatttcccaccagg

SEQ ID NO: 18723 - DNA, 23 bp, Homo sapiens
aaagctcatactgcctttttagg

SEQ ID NO: 18724 - DNA, 23 bp, Homo sapiens
cacagacaacgctgtggataagg

SEQ ID NO: 18725 - DNA, 23 bp, Homo sapiens
atggtatttctaattcccggtgg

SEQ ID NO: 18726 - DNA, 23 bp, Homo sapiens
cagagatggatggcagatctggg

SEQ ID NO: 18727 - DNA, 23 bp, Homo sapiens
gttgactgcaggagaagtgaagg

SEQ ID NO: 18728 - DNA, 23 bp, Homo sapiens
ctacacccagattatgcttttgg

SEQ ID NO: 18729 - DNA, 23 bp, Homo sapiens
ctgacggcacagttcgaacgtgg

SEQ ID NO: 18730 - DNA, 23 bp, Homo sapiens
agacatgaagactccaagtgtgg

SEQ ID NO: 18731 - DNA, 23 bp, Homo sapiens
gggcagagggcagtgcacagggg

SEQ ID NO: 18732 - DNA, 23 bp, Homo sapiens
caaagaactacagggattgctgg

SEQ ID NO: 18733 - DNA, 23 bp, Homo sapiens
agatacacttctgcagagggtgg

SEQ ID NO: 18734 - DNA, 23 bp, Homo sapiens
tgcaagtttgtgcactttttagg

SEQ ID NO: 18735 - DNA, 23 bp, Homo sapiens
agctgggcggggcgcctaggagg

SEQ ID NO: 18736 - DNA, 23 bp, Homo sapiens
gaggacagaggctggtgaggagg

SEQ ID NO: 18737 - DNA, 23 bp, Homo sapiens
gagaatgactcctttctgagggg

SEQ ID NO: 18738 - DNA, 23 bp, Homo sapiens
atagtgtggcaagtgatgtatgg

SEQ ID NO: 18739 - DNA, 23 bp, Homo sapiens
aggctggaagtctgggatcaagg

SEQ ID NO: 18740 - DNA, 23 bp, Homo sapiens
gaacattgtggcagatagtgtgg

SEQ ID NO: 18741 - DNA, 23 bp, Homo sapiens
ccccgaccaaatggaggaggagg

SEQ ID NO: 18742 - DNA, 23 bp, Homo sapiens
gtagcttcttgctactttgcagg

SEQ ID NO: 18743 - DNA, 23 bp, Homo sapiens
atcttcacaggagggtggggagg

SEQ ID NO: 18744 - DNA, 23 bp, Homo sapiens
atcttcacaggacagtggggagg

SEQ ID NO: 18745 - DNA, 23 bp, Homo sapiens
caggatctccacaggatggtggg

SEQ ID NO: 18746 - DNA, 23 bp, Homo sapiens
tgatggagttctctcaggactgg

SEQ ID NO: 18747 - DNA, 23 bp, Homo sapiens
gatgagtgggccggctgcttcgg

SEQ ID NO: 18748 - DNA, 23 bp, Homo sapiens
tgttgttctgcctggagacaagg

SEQ ID NO: 18749 - DNA, 23 bp, Homo sapiens
aaggagtggggccactgctttgg

SEQ ID NO: 18750 - DNA, 23 bp, Homo sapiens
gcagacgaaggaagtaaaggagg

SEQ ID NO: 18751 - DNA, 23 bp, Homo sapiens
tttggagataccactgtttaagg

SEQ ID NO: 18752 - DNA, 23 bp, Homo sapiens
acgaacattgaaaactgaactgg

SEQ ID NO: 18753 - DNA, 23 bp, Homo sapiens
atgtgtgtgtatgtgtgtgttgg

SEQ ID NO: 18754 - DNA, 23 bp, Homo sapiens
cagcctcctgttttcatttccgg

SEQ ID NO: 18755 - DNA, 23 bp, Homo sapiens
gacttcaaactgttcagcaaagg

SEQ ID NO: 18756 - DNA, 23 bp, Homo sapiens
aagctggacagattgtataaagg

SEQ ID NO: 18757 - DNA, 23 bp, Homo sapiens
agtccttctccaataagatgtgg

SEQ ID NO: 18758 - DNA, 23 bp, Homo sapiens
ctgttgctctcagcagtctgagg

SEQ ID NO: 18759 - DNA, 23 bp, Homo sapiens
catctcgtgtacagatagaccgg

SEQ ID NO: 18760 - DNA, 23 bp, Homo sapiens
tagtagttttcgtaattcgcagg

SEQ ID NO: 18761 - DNA, 23 bp, Homo sapiens
tcaggcctccagagggtcagtgg

SEQ ID NO: 18762 - DNA, 23 bp, Homo sapiens
ctgcaattttgacaaatgcctgg

SEQ ID NO: 18763 - DNA, 23 bp, Homo sapiens
tccagaagacaacaccctgaagg

SEQ ID NO: 18764 - DNA, 23 bp, Homo sapiens
gcggccattttatttttccctgg

SEQ ID NO: 18765 - DNA, 23 bp, Homo sapiens
tcctggctcctgcttgtagatgg

SEQ ID NO: 18766 - DNA, 23 bp, Homo sapiens
gggcccagctggcctagggccgg

SEQ ID NO: 18767 - DNA, 23 bp, Homo sapiens
caaggattcagtgatgtagtagg

SEQ ID NO: 18768 - DNA, 23 bp, Homo sapiens
ctttgggaaggtatctgatttgg

SEQ ID NO: 18769 - DNA, 23 bp, Homo sapiens
aaagacagtgccttggtcagtgg

SEQ ID NO: 18770 - DNA, 23 bp, Homo sapiens
tctgatttgtctgtctctgttgg

SEQ ID NO: 18771 - DNA, 23 bp, Homo sapiens
aggagtgaattattttgtggggg

SEQ ID NO: 18772 - DNA, 23 bp, Homo sapiens
ggccccacagcatcctcatatgg

SEQ ID NO: 18773 - DNA, 23 bp, Homo sapiens
gaagactggtctagttcaggagg

SEQ ID NO: 18774 - DNA, 23 bp, Homo sapiens
gttctgtctagtcatttctctgg

SEQ ID NO: 18775 - DNA, 23 bp, Homo sapiens
cccgccgccggcagcttcgctgg

SEQ ID NO: 18776 - DNA, 23 bp, Homo sapiens
attataggcgtctgctgtactgg

SEQ ID NO: 18777 - DNA, 23 bp, Homo sapiens
ttcttgtccatgtttctgatagg

SEQ ID NO: 18778 - DNA, 23 bp, Homo sapiens
gctgagtctccttgctcacatgg

SEQ ID NO: 18779 - DNA, 23 bp, Homo sapiens
atctctctagagacataagtagg

SEQ ID NO: 18780 - DNA, 23 bp, Homo sapiens
aagaaaccatagactactagagg

SEQ ID NO: 18781 - DNA, 23 bp, Homo sapiens
aaggctttggccaatgagagtgg

SEQ ID NO: 18782 - DNA, 23 bp, Homo sapiens
taaaaacgtctcaatgactcagg

SEQ ID NO: 18783 - DNA, 23 bp, Homo sapiens
aaggagctgaaaaaatgaagagg

SEQ ID NO: 18784 - DNA, 23 bp, Homo sapiens
gaaggattttctaacgtggaagg

SEQ ID NO: 18785 - DNA, 23 bp, Homo sapiens
tagttctgcttcacatacacagg

SEQ ID NO: 18786 - DNA, 23 bp, Homo sapiens
tgcagtgagtatttcttcagagg

SEQ ID NO: 18787 - DNA, 23 bp, Homo sapiens
gagcattgaggactgccctttgg

SEQ ID NO: 18788 - DNA, 23 bp, Homo sapiens
tcctgtttcacccatattgctgg

SEQ ID NO: 18789 - DNA, 23 bp, Homo sapiens
ttggagcttagctcggagcttgg

SEQ ID NO: 18790 - DNA, 23 bp, Homo sapiens
gctcattcatttcagctgattgg

SEQ ID NO: 18791 - DNA, 23 bp, Homo sapiens
acggcaagcccatgttcatctgg

SEQ ID NO: 18792 - DNA, 23 bp, Homo sapiens
ctcatccagcttgtggtcactgg

SEQ ID NO: 18793 - DNA, 23 bp, Homo sapiens
cgggcgcggggcggctcaccagg

SEQ ID NO: 18794 - DNA, 23 bp, Homo sapiens
gtttatgctcaggattgtcttgg

SEQ ID NO: 18795 - DNA, 23 bp, Homo sapiens
gttcacggcttcagtctgagagg

SEQ ID NO: 18796 - DNA, 23 bp, Homo sapiens
agtcccggctgtgacgttggtgg

SEQ ID NO: 18797 - DNA, 23 bp, Homo sapiens
acagtgcacaagggttaaaatgg

SEQ ID NO: 18798 - DNA, 23 bp, Homo sapiens
gtggacaccgagtggtagccagg

SEQ ID NO: 18799 - DNA, 23 bp, Homo sapiens
tttcacatctgtgacgggatggg

SEQ ID NO: 18800 - DNA, 23 bp, Homo sapiens
tcggaaagcttttactgccacgg

SEQ ID NO: 18801 - DNA, 23 bp, Homo sapiens
cacagacgacaagaaaccagggg

SEQ ID NO: 18802 - DNA, 23 bp, Homo sapiens
tttctatggcaagactgtcatgg

SEQ ID NO: 18803 - DNA, 23 bp, Homo sapiens
ctacctcttgtgacaggatcagg

SEQ ID NO: 18804 - DNA, 23 bp, Homo sapiens
ccctgggccaggcactcagatgg

SEQ ID NO: 18805 - DNA, 23 bp, Homo sapiens
aagacaagtctttactgttgagg

SEQ ID NO: 18806 - DNA, 23 bp, Homo sapiens
taaactgattgcaaagggaaagg

SEQ ID NO: 18807 - DNA, 23 bp, Homo sapiens
acaggaagtgaagaatgagatgg

SEQ ID NO: 18808 - DNA, 23 bp, Homo sapiens
caagcttatactggttctgaagg

SEQ ID NO: 18809 - DNA, 23 bp, Homo sapiens
cctgcagagcttcagtgcccagg

SEQ ID NO: 18810 - DNA, 23 bp, Homo sapiens
ggtttccccagaggagttggagg

SEQ ID NO: 18811 - DNA, 23 bp, Homo sapiens
ggtttcccgggaggagttggagg

SEQ ID NO: 18812 - DNA, 23 bp, Homo sapiens
ttgggtttccctggaggagttgg

SEQ ID NO: 18813 - DNA, 23 bp, Homo sapiens
ggtttccccggaggagttggagg

SEQ ID NO: 18814 - DNA, 23 bp, Homo sapiens
ccccggagctctaggaaatgagg

SEQ ID NO: 18815 - DNA, 23 bp, Homo sapiens
gcagagtgtgatgcagtacgtgg

SEQ ID NO: 18816 - DNA, 23 bp, Homo sapiens
tcacggaggggcggctctgctgg

SEQ ID NO: 18817 - DNA, 23 bp, Homo sapiens
tctgctagctgacagagcccagg

SEQ ID NO: 18818 - DNA, 23 bp, Homo sapiens
gaacgtgatgctgtatgtgacgg

SEQ ID NO: 18819 - DNA, 23 bp, Homo sapiens
ggagcgtaagcagcggtgagcgg

SEQ ID NO: 18820 - DNA, 23 bp, Homo sapiens
acttacagaactggagaaaaggg

SEQ ID NO: 18821 - DNA, 23 bp, Homo sapiens
atcaccttcaagacatacagagg

SEQ ID NO: 18822 - DNA, 23 bp, Homo sapiens
gaggcccgcttggaggtccgagg

SEQ ID NO: 18823 - DNA, 23 bp, Homo sapiens
gctgtggtccgtgcctctagggg

SEQ ID NO: 18824 - DNA, 23 bp, Homo sapiens
ttccctaactgggaggtgactgg

SEQ ID NO: 18825 - DNA, 23 bp, Homo sapiens
tgctggtcagttgagtttctcgg

SEQ ID NO: 18826 - DNA, 23 bp, Homo sapiens
taaccactcagtggctcacacgg

SEQ ID NO: 18827 - DNA, 23 bp, Homo sapiens
aagaagcctagcagggtctgagg

SEQ ID NO: 18828 - DNA, 23 bp, Homo sapiens
gcagctttttctctcatctctgg

SEQ ID NO: 18829 - DNA, 23 bp, Homo sapiens
tgtctaaaggacatgctagcagg

SEQ ID NO: 18830 - DNA, 23 bp, Homo sapiens
agacacactactgctcctcctgg

SEQ ID NO: 18831 - DNA, 23 bp, Homo sapiens
ccgacttggcccaagtagttggg

SEQ ID NO: 18832 - DNA, 23 bp, Homo sapiens
gtctctatcttcagtgcaaaagg

SEQ ID NO: 18833 - DNA, 23 bp, Homo sapiens
aaaaactctgggaaatgactagg

SEQ ID NO: 18834 - DNA, 23 bp, Homo sapiens
agcgcggcccaggggtcataagg

SEQ ID NO: 18835 - DNA, 23 bp, Homo sapiens
tagtttcagggctcccgccccgg

SEQ ID NO: 18836 - DNA, 23 bp, Homo sapiens
ctcttggaactgggataataagg

SEQ ID NO: 18837 - DNA, 23 bp, Homo sapiens
ggcgggggctgcgggctcagtgg

SEQ ID NO: 18838 - DNA, 23 bp, Homo sapiens
cgcgcgtcagtagccccagcagg

SEQ ID NO: 18839 - DNA, 23 bp, Homo sapiens
gcctcgggtgtgctcaggcccgg

SEQ ID NO: 18840 - DNA, 23 bp, Homo sapiens
aatcatggtgatttagctcatgg

SEQ ID NO: 18841 - DNA, 23 bp, Homo sapiens
agaaacagaatgaagaaggctgg

SEQ ID NO: 18842 - DNA, 23 bp, Homo sapiens
gggcctctgcagaacactagcgg

SEQ ID NO: 18843 - DNA, 23 bp, Homo sapiens
cgggagattggaacagaggccgg

SEQ ID NO: 18844 - DNA, 23 bp, Homo sapiens
tccctgctgaggtttgccgccgg

SEQ ID NO: 18845 - DNA, 23 bp, Homo sapiens
tggtggtggtggtggtgatttgg

SEQ ID NO: 18846 - DNA, 23 bp, Homo sapiens
aaacttgatgaaatagacggagg

SEQ ID NO: 18847 - DNA, 23 bp, Homo sapiens
gatgaaatacacagagggtttgg

SEQ ID NO: 18848 - DNA, 23 bp, Homo sapiens
aactggcatggtcattcatcagg

SEQ ID NO: 18849 - DNA, 23 bp, Homo sapiens
gatgacgggtccaagagaactgg

SEQ ID NO: 18850 - DNA, 23 bp, Homo sapiens
caaaaccttggttctcagcaagg

SEQ ID NO: 18851 - DNA, 23 bp, Homo sapiens
aacactcattctggaaagtgtgg

SEQ ID NO: 18852 - DNA, 23 bp, Homo sapiens
tcagctaacattttccatcatgg

SEQ ID NO: 18853 - DNA, 23 bp, Homo sapiens
acattttctgagagcaggtatgg

SEQ ID NO: 18854 - DNA, 23 bp, Homo sapiens
catgcacagagtacattcattgg

SEQ ID NO: 18855 - DNA, 23 bp, Homo sapiens
ctgtaaactgctccatcagcagg

SEQ ID NO: 18856 - DNA, 23 bp, Homo sapiens
gacatccagatcatgaaagatgg

SEQ ID NO: 18857 - DNA, 23 bp, Homo sapiens
agacgggggcatgctggctgcgg

SEQ ID NO: 18858 - DNA, 23 bp, Homo sapiens
caagccctcaaataatgcaaagg

SEQ ID NO: 18859 - DNA, 23 bp, Homo sapiens
gctttaactcagcattttccagg

SEQ ID NO: 18860 - DNA, 23 bp, Homo sapiens
agagttcagtttcttcacgatgg

SEQ ID NO: 18861 - DNA, 23 bp, Homo sapiens
cagatggcagtcactactgtagg

SEQ ID NO: 18862 - DNA, 23 bp, Homo sapiens
gatccaatttgtggatctgatgg

SEQ ID NO: 18863 - DNA, 23 bp, Homo sapiens
ccggtgagacccaggctcagagg

SEQ ID NO: 18864 - DNA, 23 bp, Homo sapiens
cttggcgacagggcggtcacagg

SEQ ID NO: 18865 - DNA, 23 bp, Homo sapiens
gcaacagcaacaactttttgagg

SEQ ID NO: 18866 - DNA, 23 bp, Homo sapiens
tggtttgtattttgcaacacagg

SEQ ID NO: 18867 - DNA, 23 bp, Homo sapiens
cggagtactgcccttcagagagg

SEQ ID NO: 18868 - DNA, 23 bp, Homo sapiens
tcacttgaagtcaagagtcctgg

SEQ ID NO: 18869 - DNA, 23 bp, Homo sapiens
cactattcaccgacacttaaggg

SEQ ID NO: 18870 - DNA, 23 bp, Homo sapiens
ggccagtgtgctcatctgagagg

SEQ ID NO: 18871 - DNA, 23 bp, Homo sapiens
gcatctgtgaaagtctgaggtgg

SEQ ID NO: 18872 - DNA, 23 bp, Homo sapiens
gcctctacagaggagccctgagg

SEQ ID NO: 18873 - DNA, 23 bp, Homo sapiens
tttgttaggtaagtacactctgg

SEQ ID NO: 18874 - DNA, 23 bp, Homo sapiens
aaggagggtcaggcctttctagg

SEQ ID NO: 18875 - DNA, 23 bp, Homo sapiens
aggatgaggtcgggtacatatgg

SEQ ID NO: 18876 - DNA, 23 bp, Homo sapiens
aaacgggagaggtcatggtgtgg

SEQ ID NO: 18877 - DNA, 23 bp, Homo sapiens
ctgacgacgggggctacatctgg

SEQ ID NO: 18878 - DNA, 23 bp, Homo sapiens
gaaggggatgatgatgatggtgg

SEQ ID NO: 18879 - DNA, 23 bp, Homo sapiens
tactgcttccagagacagcaagg

SEQ ID NO: 18880 - DNA, 23 bp, Homo sapiens
aatgttcatccttgttagcaagg

SEQ ID NO: 18881 - DNA, 23 bp, Homo sapiens
tggtcttagacgcagttatcagg

SEQ ID NO: 18882 - DNA, 23 bp, Homo sapiens
caggatcttaggattgcttcagg

SEQ ID NO: 18883 - DNA, 23 bp, Homo sapiens
agtttggcattccacgcaaacgg

SEQ ID NO: 18884 - DNA, 23 bp, Homo sapiens
cttagaactttcaggtgtgccgg

SEQ ID NO: 18885 - DNA, 23 bp, Homo sapiens
attagatagtgcatcttctgagg

SEQ ID NO: 18886 - DNA, 23 bp, Homo sapiens
tatttattcttgctctgtgccgg

SEQ ID NO: 18887 - DNA, 23 bp, Homo sapiens
gaagaaaaccctgtgatatctgg

SEQ ID NO: 18888 - DNA, 23 bp, Homo sapiens
agcctggcgcctcggcctagggg

SEQ ID NO: 18889 - DNA, 23 bp, Homo sapiens
ttctcacagtcagagcaaactgg

SEQ ID NO: 18890 - DNA, 23 bp, Homo sapiens
acccaggctcccttgtgaactgg

SEQ ID NO: 18891 - DNA, 23 bp, Homo sapiens
cccgattcctggaagtatgatgg

SEQ ID NO: 18892 - DNA, 23 bp, Homo sapiens
atttgtcatagaagtccacgtgg

SEQ ID NO: 18893 - DNA, 23 bp, Homo sapiens
cataaagctgctggatgaaatgg

SEQ ID NO: 18894 - DNA, 23 bp, Homo sapiens
gggagggaaactgagtcacgcgg

SEQ ID NO: 18895 - DNA, 23 bp, Homo sapiens
cacgaggaggctgcgcggtgagg

SEQ ID NO: 18896 - DNA, 23 bp, Homo sapiens
atggaatgttccagttatgatgg

SEQ ID NO: 18897 - DNA, 23 bp, Homo sapiens
aagaccaagcagaagtaatgtgg

SEQ ID NO: 18898 - DNA, 23 bp, Homo sapiens
tgaagctgttacttgctcttcgg

SEQ ID NO: 18899 - DNA, 23 bp, Homo sapiens
ctgaagctgttacttgctcttgg

SEQ ID NO: 18900 - DNA, 23 bp, Homo sapiens
ctagtgatgttacttgctcttgg

SEQ ID NO: 18901 - DNA, 23 bp, Homo sapiens
aagaccaagcagaagtaatttgg

SEQ ID NO: 18902 - DNA, 23 bp, Homo sapiens
ctcctcctgcccaagatgtaagg

SEQ ID NO: 18903 - DNA, 23 bp, Homo sapiens
ctttgatgctgtcaccttcaagg

SEQ ID NO: 18904 - DNA, 23 bp, Homo sapiens
gtattggccgcagagaataaagg

SEQ ID NO: 18905 - DNA, 23 bp, Homo sapiens
cccacctccaaaaatcatgatgg

SEQ ID NO: 18906 - DNA, 23 bp, Homo sapiens
tggtttttcaaagttcctagggg

SEQ ID NO: 18907 - DNA, 23 bp, Homo sapiens
aaggtcatacagacttttcctgg

SEQ ID NO: 18908 - DNA, 23 bp, Homo sapiens
ttcgacacaaactgtcagaaagg

SEQ ID NO: 18909 - DNA, 23 bp, Homo sapiens
ctgcaccccttgagtggctaggg

SEQ ID NO: 18910 - DNA, 23 bp, Homo sapiens
tccagtaatggacatactagagg

SEQ ID NO: 18911 - DNA, 23 bp, Homo sapiens
attttttcaaaaccaggtggagg

SEQ ID NO: 18912 - DNA, 23 bp, Homo sapiens
ggtatgatggcgaacgtcactgg

SEQ ID NO: 18913 - DNA, 23 bp, Homo sapiens
tgtggtatcacagggctcactgg

SEQ ID NO: 18914 - DNA, 23 bp, Homo sapiens
actgggaagtcagtcaggtccgg

SEQ ID NO: 18915 - DNA, 23 bp, Homo sapiens
gcccatcaggcttggctcactgg

SEQ ID NO: 18916 - DNA, 23 bp, Homo sapiens
tgcttattagttgccaaagtagg

SEQ ID NO: 18917 - DNA, 23 bp, Homo sapiens
ctcagttcacgaaaagcgagcgg

SEQ ID NO: 18918 - DNA, 23 bp, Homo sapiens
ccacctgggctgagcctagtagg

SEQ ID NO: 18919 - DNA, 23 bp, Homo sapiens
cttccccaaaaagaagtagcagg

SEQ ID NO: 18920 - DNA, 23 bp, Homo sapiens
gaacttcacagtccagaccatgg

SEQ ID NO: 18921 - DNA, 23 bp, Homo sapiens
gagaagcggttcagcctttttgg

SEQ ID NO: 18922 - DNA, 23 bp, Homo sapiens
gttgtgctccgcagcaaagacgg

SEQ ID NO: 18923 - DNA, 23 bp, Homo sapiens
attgacagcccccttctcaatgg

SEQ ID NO: 18924 - DNA, 23 bp, Homo sapiens
atcgcagggccagcgggcgcagg

SEQ ID NO: 18925 - DNA, 23 bp, Homo sapiens
cccggcctggatgtctactcagg

SEQ ID NO: 18926 - DNA, 23 bp, Homo sapiens
cccgggactctgcctagagcagg

SEQ ID NO: 18927 - DNA, 23 bp, Homo sapiens
ccttctcatggtcacacaattgg

SEQ ID NO: 18928 - DNA, 23 bp, Homo sapiens
tgtggacccagaggattttatgg

SEQ ID NO: 18929 - DNA, 23 bp, Homo sapiens
ttcatacgtcgtctcgtcaaagg

SEQ ID NO: 18930 - DNA, 23 bp, Homo sapiens
ctcgtctcatcatagagctcagg

SEQ ID NO: 18931 - DNA, 23 bp, Homo sapiens
cttcatgccccagcacatcatgg

SEQ ID NO: 18932 - DNA, 23 bp, Homo sapiens
gggatccccgactctactgaagg

SEQ ID NO: 18933 - DNA, 23 bp, Homo sapiens
tttattagcttgtcttccggtgg

SEQ ID NO: 18934 - DNA, 23 bp, Homo sapiens
gaagggccaagaagctgaagagg

SEQ ID NO: 18935 - DNA, 23 bp, Homo sapiens
tggaagacagtctgcttaactgg

SEQ ID NO: 18936 - DNA, 23 bp, Homo sapiens
aagctcttaggggaaaaatgagg

SEQ ID NO: 18937 - DNA, 23 bp, Homo sapiens
cctcgagcccttctcagtagtgg

SEQ ID NO: 18938 - DNA, 23 bp, Homo sapiens
ctgcgcaagttgtttcatctagg

SEQ ID NO: 18939 - DNA, 23 bp, Homo sapiens
gtgggcaaaagtggtcacaacgg

SEQ ID NO: 18940 - DNA, 23 bp, Homo sapiens
ccgaggattatgaagcctgctgg

SEQ ID NO: 18941 - DNA, 23 bp, Homo sapiens
ctgtgggcaggccgattagctgg

SEQ ID NO: 18942 - DNA, 23 bp, Homo sapiens
atactcataacacccgaatgagg

SEQ ID NO: 18943 - DNA, 23 bp, Homo sapiens
ctgggcccgcctgtgcctagagg

SEQ ID NO: 18944 - DNA, 23 bp, Homo sapiens
cgcaaggccaagacgtgagtggg

SEQ ID NO: 18945 - DNA, 23 bp, Homo sapiens
cggggtgaggggcttctagaagg

SEQ ID NO: 18946 - DNA, 23 bp, Homo sapiens
gatactcttcaaatttccggagg

SEQ ID NO: 18947 - DNA, 23 bp, Homo sapiens
gttctcatctcattcaggccagg

SEQ ID NO: 18948 - DNA, 23 bp, Homo sapiens
aataagggctttccgagatttgg

SEQ ID NO: 18949 - DNA, 23 bp, Homo sapiens
ttgtctcttacccgaagcatagg

SEQ ID NO: 18950 - DNA, 23 bp, Homo sapiens
ccggggacacggggtctagctgg

SEQ ID NO: 18951 - DNA, 23 bp, Homo sapiens
ggctgagcctggtggtcaggagg

SEQ ID NO: 18952 - DNA, 23 bp, Homo sapiens
taccaaaacagaagcagtatagg

SEQ ID NO: 18953 - DNA, 23 bp, Homo sapiens
tctttgctcacacttgaatctgg

SEQ ID NO: 18954 - DNA, 23 bp, Homo sapiens
ccaaagtctcagttactttctgg

SEQ ID NO: 18955 - DNA, 23 bp, Homo sapiens
gcgggcggatcattcactcttgg

SEQ ID NO: 18956 - DNA, 23 bp, Homo sapiens
cttcatgggaagcaagcagaagg

SEQ ID NO: 18957 - DNA, 23 bp, Homo sapiens
attgtgcatgacttgtctgttgg

SEQ ID NO: 18958 - DNA, 23 bp, Homo sapiens
acaagtcttgtactgtctgaggg

SEQ ID NO: 18959 - DNA, 23 bp, Homo sapiens
catcccccatcagtacatcgtgg

SEQ ID NO: 18960 - DNA, 23 bp, Homo sapiens
ttcacagtgagggagtgctatgg

SEQ ID NO: 18961 - DNA, 23 bp, Homo sapiens
ttcacagtaagggagtgctatgg

SEQ ID NO: 18962 - DNA, 23 bp, Homo sapiens
ggcccatcctgcaggtcacatgg

SEQ ID NO: 18963 - DNA, 23 bp, Homo sapiens
gggtcaacatggattagaagagg

SEQ ID NO: 18964 - DNA, 23 bp, Homo sapiens
agacgggatactgctcagcaagg

SEQ ID NO: 18965 - DNA, 23 bp, Homo sapiens
gagtcccatcattgttgcccagg

SEQ ID NO: 18966 - DNA, 23 bp, Homo sapiens
tcgctacaggaagcactaggtgg

SEQ ID NO: 18967 - DNA, 23 bp, Homo sapiens
gggctcagctcacatcattcagg

SEQ ID NO: 18968 - DNA, 23 bp, Homo sapiens
tgggtcacgtgaggactcagggg

SEQ ID NO: 18969 - DNA, 23 bp, Homo sapiens
agcaacagcagcacagtaaaggg

SEQ ID NO: 18970 - DNA, 23 bp, Homo sapiens
gagggaagtaaaaaagggaaagg

SEQ ID NO: 18971 - DNA, 23 bp, Homo sapiens
aagcctaacttctggttcctagg

SEQ ID NO: 18972 - DNA, 23 bp, Homo sapiens
agtcgtgggaggaggaagtcggg

SEQ ID NO: 18973 - DNA, 23 bp, Homo sapiens
tacgtgatgggaactgtacaagg

SEQ ID NO: 18974 - DNA, 23 bp, Homo sapiens
ggcaacatgaaaggcatgatggg

SEQ ID NO: 18975 - DNA, 23 bp, Homo sapiens
tttggattcaggagctaaccagg

SEQ ID NO: 18976 - DNA, 23 bp, Homo sapiens
agaaaggtggaaaaggtggctgg

SEQ ID NO: 18977 - DNA, 23 bp, Homo sapiens
tgtagtctctgctattcaggagg

SEQ ID NO: 18978 - DNA, 23 bp, Homo sapiens
taccatggaaactgagtgaatgg

SEQ ID NO: 18979 - DNA, 23 bp, Homo sapiens
ggggcttaggagttaagccaagg

SEQ ID NO: 18980 - DNA, 23 bp, Homo sapiens
gaggctccagggcttcagcttgg

SEQ ID NO: 18981 - DNA, 23 bp, Homo sapiens
gcgaatgccttcggcatccttgg

SEQ ID NO: 18982 - DNA, 23 bp, Homo sapiens
ggagccacagccgggcctagggg

SEQ ID NO: 18983 - DNA, 23 bp, Homo sapiens
gccctcatgaaggcttaacgtgg

SEQ ID NO: 18984 - DNA, 23 bp, Homo sapiens
gctggctaaaattgcctgagagg

SEQ ID NO: 18985 - DNA, 23 bp, Homo sapiens
accatcatgtcaggtgttacagg

SEQ ID NO: 18986 - DNA, 23 bp, Homo sapiens
ctccttcagtatggtgctagtgg

SEQ ID NO: 18987 - DNA, 23 bp, Homo sapiens
gacccagcgtcgggagcaaaggg

SEQ ID NO: 18988 - DNA, 23 bp, Homo sapiens
gaaacagactgataagaagctgg

SEQ ID NO: 18989 - DNA, 23 bp, Homo sapiens
cgagttcagtcagtagcagaagg

SEQ ID NO: 18990 - DNA, 23 bp, Homo sapiens
agtgtccccacagtcttaggggg

SEQ ID NO: 18991 - DNA, 23 bp, Homo sapiens
ccatgagacaccgctcctccagg

SEQ ID NO: 18992 - DNA, 23 bp, Homo sapiens
cggagcagctctgagagcggggg

SEQ ID NO: 18993 - DNA, 23 bp, Homo sapiens
ccccgctctcagagctgctccgg

SEQ ID NO: 18994 - DNA, 23 bp, Homo sapiens
gggcacttagcgcctcgtgctgg

SEQ ID NO: 18995 - DNA, 23 bp, Homo sapiens
gactgggggctacgccagcttgg

SEQ ID NO: 18996 - DNA, 23 bp, Homo sapiens
aaagaaatcaacatcgtctgggg

SEQ ID NO: 18997 - DNA, 23 bp, Homo sapiens
ttgaccagaattggatacagtgg

SEQ ID NO: 18998 - DNA, 23 bp, Homo sapiens
gagagcgagatctgctatgacgg

SEQ ID NO: 18999 - DNA, 23 bp, Homo sapiens
gaatggcttctgctacgccgtgg

SEQ ID NO: 19000 - DNA, 23 bp, Homo sapiens
accatggtttatactatcagtgg

SEQ ID NO: 19001 - DNA, 23 bp, Homo sapiens
tgtagtaagcagaactgtactgg

SEQ ID NO: 19002 - DNA, 23 bp, Homo sapiens
tgatcatcatgaagaagacatgg

SEQ ID NO: 19003 - DNA, 23 bp, Homo sapiens
atgacgataacttcgagatctgg

SEQ ID NO: 19004 - DNA, 23 bp, Homo sapiens
gtctcctgaagaggaaggagcgg

SEQ ID NO: 19005 - DNA, 23 bp, Homo sapiens
gtcgatctaggtcaaatgaaagg

SEQ ID NO: 19006 - DNA, 23 bp, Homo sapiens
gtcccactcaaggtcctaactgg

SEQ ID NO: 19007 - DNA, 23 bp, Homo sapiens
aggtccagatcagttgacagtgg

SEQ ID NO: 19008 - DNA, 23 bp, Homo sapiens
aggagttctgagttaatctctgg

SEQ ID NO: 19009 - DNA, 23 bp, Homo sapiens
aagtgcaagtcctgaaagaatgg

SEQ ID NO: 19010 - DNA, 23 bp, Homo sapiens
cccaagtctcctgaagaggaagg

SEQ ID NO: 19011 - DNA, 23 bp, Homo sapiens
ttcccatcacctgtctcagtagg

SEQ ID NO: 19012 - DNA, 23 bp, Homo sapiens
atctaagtgaagatatgcagagg

SEQ ID NO: 19013 - DNA, 23 bp, Homo sapiens
cagccactggacaaagctgtagg

SEQ ID NO: 19014 - DNA, 23 bp, Homo sapiens
tgtaagtactttttcactgctgg

SEQ ID NO: 19015 - DNA, 23 bp, Homo sapiens
atggaaattaccagcagtaaggg

SEQ ID NO: 19016 - DNA, 23 bp, Homo sapiens
attgcttttgaagtgctggttgg

SEQ ID NO: 19017 - DNA, 23 bp, Homo sapiens
cagaaaacagaaaatggtgctgg

SEQ ID NO: 19018 - DNA, 23 bp, Homo sapiens
acgaaagagaaggagtagaaagg

SEQ ID NO: 19019 - DNA, 23 bp, Homo sapiens
cacacgctcattgtcatgctagg

SEQ ID NO: 19020 - DNA, 23 bp, Homo sapiens
cacacactcatcgtcatgcttgg

SEQ ID NO: 19021 - DNA, 23 bp, Homo sapiens
atgaccatgagcgtgtgatgggg

SEQ ID NO: 19022 - DNA, 23 bp, Homo sapiens
cagagcgggctgggtcatgaagg

SEQ ID NO: 19023 - DNA, 23 bp, Homo sapiens
agggtcacacgtctcccctcagg

SEQ ID NO: 19024 - DNA, 23 bp, Homo sapiens
gggggcgctatgggctagggagg

SEQ ID NO: 19025 - DNA, 23 bp, Homo sapiens
gtgggtaaaatgctgtcttcagg

SEQ ID NO: 19026 - DNA, 23 bp, Homo sapiens
atcagacgggaaattgtaagtgg

SEQ ID NO: 19027 - DNA, 23 bp, Homo sapiens
gaagatacttgctgttgagctgg

SEQ ID NO: 19028 - DNA, 23 bp, Homo sapiens
cagcttttgctcatccacgaagg

SEQ ID NO: 19029 - DNA, 23 bp, Homo sapiens
gacctgagggttctttcacaggg

SEQ ID NO: 19030 - DNA, 23 bp, Homo sapiens
ctattggtggaagaatgaactgg

SEQ ID NO: 19031 - DNA, 23 bp, Homo sapiens
tgtgtaggctcagaatcacatgg

SEQ ID NO: 19032 - DNA, 23 bp, Homo sapiens
tgacagtggagaggagggcgagg

SEQ ID NO: 19033 - DNA, 23 bp, Homo sapiens
aatgaaaagagacagtcaagagg

SEQ ID NO: 19034 - DNA, 23 bp, Homo sapiens
ccagaaaagtagcggcggcaggg

SEQ ID NO: 19035 - DNA, 23 bp, Homo sapiens
aatgttagatcttttgctggggg

SEQ ID NO: 19036 - DNA, 23 bp, Homo sapiens
agtgcagctcctgccagggtggg

SEQ ID NO: 19037 - DNA, 23 bp, Homo sapiens
cgggcacagaagagatcagtggg

SEQ ID NO: 19038 - DNA, 23 bp, Homo sapiens
agtgtcatatttcctcttgctgg

SEQ ID NO: 19039 - DNA, 23 bp, Homo sapiens
tgaagctgacatggtctatttgg

SEQ ID NO: 19040 - DNA, 23 bp, Homo sapiens
agagccacatccaggcctgaggg

SEQ ID NO: 19041 - DNA, 23 bp, Homo sapiens
cttcctccgtttctactcatcgg

SEQ ID NO: 19042 - DNA, 23 bp, Homo sapiens
cttagtgctgtagctgctgcagg

SEQ ID NO: 19043 - DNA, 23 bp, Homo sapiens
ctggctgcaagaatttcttctgg

SEQ ID NO: 19044 - DNA, 23 bp, Homo sapiens
gggctcagagcgtcgtgatccgg

SEQ ID NO: 19045 - DNA, 23 bp, Homo sapiens
cccccaagcagttcagatactgg

SEQ ID NO: 19046 - DNA, 23 bp, Homo sapiens
ggctttccccaggcccctacagg

SEQ ID NO: 19047 - DNA, 23 bp, Homo sapiens
taggggaagggctcctcagaagg

SEQ ID NO: 19048 - DNA, 23 bp, Homo sapiens
cctgcactctcacagcttgctgg

SEQ ID NO: 19049 - DNA, 23 bp, Homo sapiens
ctgggctcagtagaagcagacgg

SEQ ID NO: 19050 - DNA, 23 bp, Homo sapiens
agccatgctatgtcacacgatgg

SEQ ID NO: 19051 - DNA, 23 bp, Homo sapiens
tgaagagatcagtgaccctgagg

SEQ ID NO: 19052 - DNA, 23 bp, Homo sapiens
actgcgtgagagaaaacagctgg

SEQ ID NO: 19053 - DNA, 23 bp, Homo sapiens
atgagaatttgtgtagctcaagg

SEQ ID NO: 19054 - DNA, 23 bp, Homo sapiens
agttactcatcatcttcctcagg

SEQ ID NO: 19055 - DNA, 23 bp, Homo sapiens
gcgtgagagaaagcagctggtgg

SEQ ID NO: 19056 - DNA, 23 bp, Homo sapiens
gggcatgtgtcatatccccgagg

SEQ ID NO: 19057 - DNA, 23 bp, Homo sapiens
agttactcgtcatcttcctgagg

SEQ ID NO: 19058 - DNA, 23 bp, Homo sapiens
agttactcgtcgtcttcttcagg

SEQ ID NO: 19059 - DNA, 23 bp, Homo sapiens
ttacgcttgacctccaaatttgg

SEQ ID NO: 19060 - DNA, 23 bp, Homo sapiens
aagagaacactggggtatagggg

SEQ ID NO: 19061 - DNA, 23 bp, Homo sapiens
aacactggtgatcagttaccagg

SEQ ID NO: 19062 - DNA, 23 bp, Homo sapiens
cagcgctgtgatcctacacatgg

SEQ ID NO: 19063 - DNA, 23 bp, Homo sapiens
gaatgcatttcctcactcattgg

SEQ ID NO: 19064 - DNA, 23 bp, Homo sapiens
aagagtcagaaaaattaggccgg

SEQ ID NO: 19065 - DNA, 23 bp, Homo sapiens
ctgttgacgagtcttcgtaaagg

SEQ ID NO: 19066 - DNA, 23 bp, Homo sapiens
ataaaatccggatcttcaagggg

SEQ ID NO: 19067 - DNA, 23 bp, Homo sapiens
gtctaccggggcaactgagccgg

SEQ ID NO: 19068 - DNA, 23 bp, Homo sapiens
acgactatgacattgtggtgagg

SEQ ID NO: 19069 - DNA, 23 bp, Homo sapiens
ctaagcagtggcatctgagtggg

SEQ ID NO: 19070 - DNA, 23 bp, Homo sapiens
ctgcctgatgggccctctagtgg

SEQ ID NO: 19071 - DNA, 23 bp, Homo sapiens
gaaagagtttctgcggaagctgg

SEQ ID NO: 19072 - DNA, 23 bp, Homo sapiens
aacctcacgtccttctgacctgg

SEQ ID NO: 19073 - DNA, 23 bp, Homo sapiens
gcatggcctcatctcagacctgg

SEQ ID NO: 19074 - DNA, 23 bp, Homo sapiens
gtggtgaaagatctcagtggagg

SEQ ID NO: 19075 - DNA, 23 bp, Homo sapiens
cttgagtcaagttgattacgagg

SEQ ID NO: 19076 - DNA, 23 bp, Homo sapiens
aggaggcttaattcttcttgtgg

SEQ ID NO: 19077 - DNA, 23 bp, Homo sapiens
agcctgtgcttagcagtgaatgg

SEQ ID NO: 19078 - DNA, 23 bp, Homo sapiens
agaaaccctttttaagagtgtgg

SEQ ID NO: 19079 - DNA, 23 bp, Homo sapiens
gctcactgcaagctctgatatgg

SEQ ID NO: 19080 - DNA, 23 bp, Homo sapiens
gccaaagccaagaactgaccggg

SEQ ID NO: 19081 - DNA, 23 bp, Homo sapiens
cagtgcattggggtcagcgctgg

SEQ ID NO: 19082 - DNA, 23 bp, Homo sapiens
aagctcacttccttccataaagg

SEQ ID NO: 19083 - DNA, 23 bp, Homo sapiens
tatcaagacaatgtccagtttgg

SEQ ID NO: 19084 - DNA, 23 bp, Homo sapiens
ttcgatcaatcaacactgcatgg

SEQ ID NO: 19085 - DNA, 23 bp, Homo sapiens
ttttaagaaggaaactgggaagg

SEQ ID NO: 19086 - DNA, 23 bp, Homo sapiens
cggaagctactcagtcctccagg

SEQ ID NO: 19087 - DNA, 23 bp, Homo sapiens
ataaggtactgaagggtgattgg

SEQ ID NO: 19088 - DNA, 23 bp, Homo sapiens
atgctcattccttagaacacagg

SEQ ID NO: 19089 - DNA, 23 bp, Homo sapiens
ttgcactggagctctgtgacagg

SEQ ID NO: 19090 - DNA, 23 bp, Homo sapiens
agccaatcagggccttgaggagg

SEQ ID NO: 19091 - DNA, 23 bp, Homo sapiens
ccacctcctggaaaactttaggg

SEQ ID NO: 19092 - DNA, 23 bp, Homo sapiens
ctcccacccctcctggacctagg

SEQ ID NO: 19093 - DNA, 23 bp, Homo sapiens
aggggtgatgagttcagttttgg

SEQ ID NO: 19094 - DNA, 23 bp, Homo sapiens
gtctgtggcaccagctaacacgg

SEQ ID NO: 19095 - DNA, 23 bp, Homo sapiens
aagctgtaagtatgatctcaagg

SEQ ID NO: 19096 - DNA, 23 bp, Homo sapiens
gaagacctaggtttgagttctgg

SEQ ID NO: 19097 - DNA, 23 bp, Homo sapiens
ctcactccagcccacttcctagg

SEQ ID NO: 19098 - DNA, 23 bp, Homo sapiens
tgcgatggggccacgtagggtgg

SEQ ID NO: 19099 - DNA, 23 bp, Homo sapiens
acagtgtgacagagtcagcttgg

SEQ ID NO: 19100 - DNA, 23 bp, Homo sapiens
ggagctctaaaactgacaacagg

SEQ ID NO: 19101 - DNA, 23 bp, Homo sapiens
gttagacagtgaatgtggaaagg

SEQ ID NO: 19102 - DNA, 23 bp, Homo sapiens
gcacctgcagctgctgctgatgg

SEQ ID NO: 19103 - DNA, 23 bp, Homo sapiens
atcctccaacttcacatgaaagg

SEQ ID NO: 19104 - DNA, 23 bp, Homo sapiens
atcctcacagtcaagtgacgagg

SEQ ID NO: 19105 - DNA, 23 bp, Homo sapiens
accccttgaggacactgtgaggg

SEQ ID NO: 19106 - DNA, 23 bp, Homo sapiens
tgttttctagtacatcaaggggg

SEQ ID NO: 19107 - DNA, 23 bp, Homo sapiens
cgccctgactgagatctgagagg

SEQ ID NO: 19108 - DNA, 23 bp, Homo sapiens
gtttcccaccgactttctagagg

SEQ ID NO: 19109 - DNA, 23 bp, Homo sapiens
ttcttcagacttcagaacatagg

SEQ ID NO: 19110 - DNA, 23 bp, Homo sapiens
gaagctggatcaaagaaatcagg

SEQ ID NO: 19111 - DNA, 23 bp, Homo sapiens
ttctacagagctggatattgagg

SEQ ID NO: 19112 - DNA, 23 bp, Homo sapiens
ttctcagaaggctctgctatagg

SEQ ID NO: 19113 - DNA, 23 bp, Homo sapiens
tctaaaggagaggctgctgatgg

SEQ ID NO: 19114 - DNA, 23 bp, Homo sapiens
aggatttcatccacacagcaagg

SEQ ID NO: 19115 - DNA, 23 bp, Homo sapiens
tggactcaaacgctcatcgaagg

SEQ ID NO: 19116 - DNA, 23 bp, Homo sapiens
atccacacaccaaggagcccagg

SEQ ID NO: 19117 - DNA, 23 bp, Homo sapiens
gtcaagaacccagtatggaaggg

SEQ ID NO: 19118 - DNA, 23 bp, Homo sapiens
cgggcactggagcactgattcgg

SEQ ID NO: 19119 - DNA, 23 bp, Homo sapiens
gcaggctggtcttcaacacctgg

SEQ ID NO: 19120 - DNA, 23 bp, Homo sapiens
gtgcggcgctcaggtgagcgagg

SEQ ID NO: 19121 - DNA, 23 bp, Homo sapiens
acgcagcaactgcctcgatcagg

SEQ ID NO: 19122 - DNA, 23 bp, Homo sapiens
tccatatctatcagtgtaagtgg

SEQ ID NO: 19123 - DNA, 23 bp, Homo sapiens
ttccagcccctcattgctgaggg

SEQ ID NO: 19124 - DNA, 23 bp, Homo sapiens
ggagggggcacagtcacgcccgg

SEQ ID NO: 19125 - DNA, 23 bp, Homo sapiens
tgaagaagctgaagaaaaacagg

SEQ ID NO: 19126 - DNA, 23 bp, Homo sapiens
aaagaagggcttttatcttgtgg

SEQ ID NO: 19127 - DNA, 23 bp, Homo sapiens
agcactttaaccaacttctatgg

SEQ ID NO: 19128 - DNA, 23 bp, Homo sapiens
agtaacgatagcattactcatgg

SEQ ID NO: 19129 - DNA, 23 bp, Homo sapiens
cacagaactccatcaagacgtgg

SEQ ID NO: 19130 - DNA, 23 bp, Homo sapiens
tcggattgagtatgcttgacagg

SEQ ID NO: 19131 - DNA, 23 bp, Homo sapiens
aaggctcacagctttgtctcagg

SEQ ID NO: 19132 - DNA, 23 bp, Homo sapiens
cggtgagatgctacctaccaagg

SEQ ID NO: 19133 - DNA, 23 bp, Homo sapiens
cttgatggccctaaaggaactgg

SEQ ID NO: 19134 - DNA, 23 bp, Homo sapiens
gacgaggtgtctcggatagtggg

SEQ ID NO: 19135 - DNA, 23 bp, Homo sapiens
cttgatgccttctgacttctagg

SEQ ID NO: 19136 - DNA, 23 bp, Homo sapiens
cacagataaacttggtcttcagg

SEQ ID NO: 19137 - DNA, 23 bp, Homo sapiens
tccgttctcagctcctcacatgg

SEQ ID NO: 19138 - DNA, 23 bp, Homo sapiens
tccttattctgctgaatgacagg

SEQ ID NO: 19139 - DNA, 23 bp, Homo sapiens
gggattcaaacattcatgagagg

SEQ ID NO: 19140 - DNA, 23 bp, Homo sapiens
cggggtcacgattgtgcgtgcgg

SEQ ID NO: 19141 - DNA, 23 bp, Homo sapiens
ctccagctgggatcaccaactgg

SEQ ID NO: 19142 - DNA, 23 bp, Homo sapiens
tgttggtattgtggttggtatgg

SEQ ID NO: 19143 - DNA, 23 bp, Homo sapiens
gagatgccaagaacaggaaacgg

SEQ ID NO: 19144 - DNA, 23 bp, Homo sapiens
gggttctgggagctgctagacgg

SEQ ID NO: 19145 - DNA, 23 bp, Homo sapiens
agcaaggattcaaggctttcagg

SEQ ID NO: 19146 - DNA, 23 bp, Homo sapiens
aagtggttcacgcatggtggggg

SEQ ID NO: 19147 - DNA, 23 bp, Homo sapiens
tcccatgagagtgcataaccagg

SEQ ID NO: 19148 - DNA, 23 bp, Homo sapiens
caggcctttcatttcacctccgg

SEQ ID NO: 19149 - DNA, 23 bp, Homo sapiens
actgaagattagacatggttggg

SEQ ID NO: 19150 - DNA, 23 bp, Homo sapiens
gagctaacatttccctttgaagg

SEQ ID NO: 19151 - DNA, 23 bp, Homo sapiens
tactggcaggatctgtcacaagg

SEQ ID NO: 19152 - DNA, 23 bp, Homo sapiens
cacattactgtgaccctctccgg

SEQ ID NO: 19153 - DNA, 23 bp, Homo sapiens
tacccagactgagctggaactgg

SEQ ID NO: 19154 - DNA, 23 bp, Homo sapiens
tgcagatacccagactgagctgg

SEQ ID NO: 19155 - DNA, 23 bp, Homo sapiens
gagaagacgagccacgtatgagg

SEQ ID NO: 19156 - DNA, 23 bp, Homo sapiens
gtcatcaagaggatttgagctgg

SEQ ID NO: 19157 - DNA, 23 bp, Homo sapiens
ggatccgccagggctgggaaagg

SEQ ID NO: 19158 - DNA, 23 bp, Homo sapiens
acctcatgccaagtgtagaaagg

SEQ ID NO: 19159 - DNA, 23 bp, Homo sapiens
atctgctttagcgtttcagaagg

SEQ ID NO: 19160 - DNA, 23 bp, Homo sapiens
aagcctcttaagaagtaggcagg

SEQ ID NO: 19161 - DNA, 23 bp, Homo sapiens
cacgctggcggtcactcatgtgg

SEQ ID NO: 19162 - DNA, 23 bp, Homo sapiens
ccacatgacctttgtcataatgg

SEQ ID NO: 19163 - DNA, 23 bp, Homo sapiens
ttttgcacgcaccgagcccaagg

SEQ ID NO: 19164 - DNA, 23 bp, Homo sapiens
atgtgggtctgattgcaattcgg

SEQ ID NO: 19165 - DNA, 23 bp, Homo sapiens
gttcttcccctacagttctgcgg

SEQ ID NO: 19166 - DNA, 23 bp, Homo sapiens
tcggcctgcaagcagcagtgagg

SEQ ID NO: 19167 - DNA, 23 bp, Homo sapiens
ggtcagcgtgggaccctcatcgg

SEQ ID NO: 19168 - DNA, 23 bp, Homo sapiens
acatgctgctttttcagatttgg

SEQ ID NO: 19169 - DNA, 23 bp, Homo sapiens
gctcagtagataaattctcctgg

SEQ ID NO: 19170 - DNA, 23 bp, Homo sapiens
tgaaacaagttcatggggattgg

SEQ ID NO: 19171 - DNA, 23 bp, Homo sapiens
gagcagaatcttcatgtctctgg

SEQ ID NO: 19172 - DNA, 23 bp, Homo sapiens
aaatgccaaaggaatttcagtgg

SEQ ID NO: 19173 - DNA, 23 bp, Homo sapiens
tgaacagcagtgcgcttcagcgg

SEQ ID NO: 19174 - DNA, 23 bp, Homo sapiens
tcccggcatcacagataaaatgg

SEQ ID NO: 19175 - DNA, 23 bp, Homo sapiens
cgatggatgcaaagaaaagaagg

SEQ ID NO: 19176 - DNA, 23 bp, Homo sapiens
tgtatggagaagacaagaaatgg

SEQ ID NO: 19177 - DNA, 23 bp, Homo sapiens
aaagacccacaaggtgaggatgg

SEQ ID NO: 19178 - DNA, 23 bp, Homo sapiens
acctcgaaagtttcataaagtgg

SEQ ID NO: 19179 - DNA, 23 bp, Homo sapiens
tcctacaagtcccactgaattgg

SEQ ID NO: 19180 - DNA, 23 bp, Homo sapiens
gggctcagctgctgcagccacgg

SEQ ID NO: 19181 - DNA, 23 bp, Homo sapiens
gccgtgagtggcgaaggggatgg

SEQ ID NO: 19182 - DNA, 23 bp, Homo sapiens
acggaggagtgaggggggcgagg

SEQ ID NO: 19183 - DNA, 23 bp, Homo sapiens
tcggccgggagcggctaggccgg

SEQ ID NO: 19184 - DNA, 23 bp, Homo sapiens
tggcattgctacttccatgaagg

SEQ ID NO: 19185 - DNA, 23 bp, Homo sapiens
ttctgtggcccatcaagaggggg

SEQ ID NO: 19186 - DNA, 23 bp, Homo sapiens
caactgcaacctctgcctcctgg

SEQ ID NO: 19187 - DNA, 23 bp, Homo sapiens
gtttctttttggttctggacagg

SEQ ID NO: 19188 - DNA, 23 bp, Homo sapiens
tttaagcagcacatgtgacctgg

SEQ ID NO: 19189 - DNA, 23 bp, Homo sapiens
gaatctggaatcacatgctatgg

SEQ ID NO: 19190 - DNA, 23 bp, Homo sapiens
tttgctgctttcatgtaggaagg

SEQ ID NO: 19191 - DNA, 23 bp, Homo sapiens
tccccacctacatgaaagctggg

SEQ ID NO: 19192 - DNA, 23 bp, Homo sapiens
ctgatgaagtgaagctgattggg

SEQ ID NO: 19193 - DNA, 23 bp, Homo sapiens
ccatagaggctaagaagagacgg

SEQ ID NO: 19194 - DNA, 23 bp, Homo sapiens
agaaagcgtatctacacagcagg

SEQ ID NO: 19195 - DNA, 23 bp, Homo sapiens
gctgaggctgttatttccgcagg

SEQ ID NO: 19196 - DNA, 23 bp, Homo sapiens
gtgcaccacgtctgggggactgg

SEQ ID NO: 19197 - DNA, 23 bp, Homo sapiens
gcaaggccctttatttctctggg

SEQ ID NO: 19198 - DNA, 23 bp, Homo sapiens
tcagcttcagtctcgtcagcagg

SEQ ID NO: 19199 - DNA, 23 bp, Homo sapiens
gaactccaggttgaactgtctgg

SEQ ID NO: 19200 - DNA, 23 bp, Homo sapiens
tttctggagcttcagagggaagg

SEQ ID NO: 19201 - DNA, 23 bp, Homo sapiens
ccccttcacactttacagcaagg

SEQ ID NO: 19202 - DNA, 23 bp, Homo sapiens
cccgggagtcaccgcgcagcagg

SEQ ID NO: 19203 - DNA, 23 bp, Homo sapiens
tttggcctctaggctttacctgg

SEQ ID NO: 19204 - DNA, 23 bp, Homo sapiens
agtagactatgtcatctgcttgg

SEQ ID NO: 19205 - DNA, 23 bp, Homo sapiens
gctggcatcaccaccacacctgg

SEQ ID NO: 19206 - DNA, 23 bp, Homo sapiens
gagtgacattgtcagcacaatgg

SEQ ID NO: 19207 - DNA, 23 bp, Homo sapiens
catctctacactagcctagatgg

SEQ ID NO: 19208 - DNA, 23 bp, Homo sapiens
ggtggagcgtgtggaaattaagg

SEQ ID NO: 19209 - DNA, 23 bp, Homo sapiens
gtgaactcagagtctcaaagagg

SEQ ID NO: 19210 - DNA, 23 bp, Homo sapiens
cagccaaggctgctacttcaagg

SEQ ID NO: 19211 - DNA, 23 bp, Homo sapiens
atcgagtcaagatgagttagtgg

SEQ ID NO: 19212 - DNA, 23 bp, Homo sapiens
aagcttccaaataaagcctgagg

SEQ ID NO: 19213 - DNA, 23 bp, Homo sapiens
tggtgactgcataactcagtagg

SEQ ID NO: 19214 - DNA, 23 bp, Homo sapiens
aagccattggtgatgcagagtgg

SEQ ID NO: 19215 - DNA, 23 bp, Homo sapiens
gagataccagggttcgtcatggg

SEQ ID NO: 19216 - DNA, 23 bp, Homo sapiens
ggcatcatctatcagaacaatgg

SEQ ID NO: 19217 - DNA, 23 bp, Homo sapiens
taaggcagtaagaggttaccagg

SEQ ID NO: 19218 - DNA, 23 bp, Homo sapiens
acgtttatgactggagttagcgg

SEQ ID NO: 19219 - DNA, 23 bp, Homo sapiens
cgtttgatgaaacattacccagg

SEQ ID NO: 19220 - DNA, 23 bp, Homo sapiens
gccagcttccatgacatatctgg

SEQ ID NO: 19221 - DNA, 23 bp, Homo sapiens
aacagaagcttgcaagcagttgg

SEQ ID NO: 19222 - DNA, 23 bp, Homo sapiens
aaatggatcccggttctgtaggg

SEQ ID NO: 19223 - DNA, 23 bp, Homo sapiens
aggaaatctcattggtgaaatgg

SEQ ID NO: 19224 - DNA, 23 bp, Homo sapiens
ccaacagcatctcagtgtagcgg

SEQ ID NO: 19225 - DNA, 23 bp, Homo sapiens
ctggctctagagcgtgcagaagg

SEQ ID NO: 19226 - DNA, 23 bp, Homo sapiens
acgggaataaaataggttgttgg

SEQ ID NO: 19227 - DNA, 23 bp, Homo sapiens
tgaagaaaaggctatgctcttgg

SEQ ID NO: 19228 - DNA, 23 bp, Homo sapiens
ccaatggtgcccagccctgaggg

SEQ ID NO: 19229 - DNA, 23 bp, Homo sapiens
agaacactaggttcaaatccagg

SEQ ID NO: 19230 - DNA, 23 bp, Homo sapiens
atgatcatctcttcatcaacggg

SEQ ID NO: 19231 - DNA, 23 bp, Homo sapiens
agagctggaggtggacgattggg

SEQ ID NO: 19232 - DNA, 23 bp, Homo sapiens
agagggtgctcaggagggtaagg

SEQ ID NO: 19233 - DNA, 23 bp, Homo sapiens
tgaagaaagagtggttcaggagg

SEQ ID NO: 19234 - DNA, 23 bp, Homo sapiens
gactcatactgggaattctaggg

SEQ ID NO: 19235 - DNA, 23 bp, Homo sapiens
gacaataaactgcttgctgatgg

SEQ ID NO: 19236 - DNA, 23 bp, Homo sapiens
tccttcagctcctgatgttaagg

SEQ ID NO: 19237 - DNA, 23 bp, Homo sapiens
tgctaaaagaatgagtagtgggg

SEQ ID NO: 19238 - DNA, 23 bp, Homo sapiens
tgtagagacaggctcatagcagg

SEQ ID NO: 19239 - DNA, 23 bp, Homo sapiens
tgggaagagctgctgcagtgagg

SEQ ID NO: 19240 - DNA, 23 bp, Homo sapiens
aagaacttagtcagtgattctgg

SEQ ID NO: 19241 - DNA, 23 bp, Homo sapiens
ctccaggaagtcaagagctttgg

SEQ ID NO: 19242 - DNA, 23 bp, Homo sapiens
cagtgctggagctgacgcactgg

SEQ ID NO: 19243 - DNA, 23 bp, Homo sapiens
aaagcatatatagctagtgcagg

SEQ ID NO: 19244 - DNA, 23 bp, Homo sapiens
tgggcatcatacgaagaccttgg

SEQ ID NO: 19245 - DNA, 23 bp, Homo sapiens
tggtccccaggcgctgctagcgg

SEQ ID NO: 19246 - DNA, 23 bp, Homo sapiens
tggataatcgaggcttgtcaagg

SEQ ID NO: 19247 - DNA, 23 bp, Homo sapiens
aatgtagccacgcttccttttgg

SEQ ID NO: 19248 - DNA, 23 bp, Homo sapiens
ggctgggtggaggactactgagg

SEQ ID NO: 19249 - DNA, 23 bp, Homo sapiens
ccgtgggctcacagctgctgtgg

SEQ ID NO: 19250 - DNA, 23 bp, Homo sapiens
acgagaaggtcaggggtcacggg

SEQ ID NO: 19251 - DNA, 23 bp, Homo sapiens
actcgtcatgtgggatactttgg

SEQ ID NO: 19252 - DNA, 23 bp, Homo sapiens
agaatagtaagatgagaacgagg

SEQ ID NO: 19253 - DNA, 23 bp, Homo sapiens
ctgtccctgcctcaagtagcagg

SEQ ID NO: 19254 - DNA, 23 bp, Homo sapiens
tcactgacaggacaagcaccagg

SEQ ID NO: 19255 - DNA, 23 bp, Homo sapiens
tggcgtgaagtctcgataagtgg

SEQ ID NO: 19256 - DNA, 23 bp, Homo sapiens
aactgcatttcttgtcagtttgg

SEQ ID NO: 19257 - DNA, 23 bp, Homo sapiens
gactggtacgacagctagccagg

SEQ ID NO: 19258 - DNA, 23 bp, Homo sapiens
cttgcagagtactgtgttgttgg

SEQ ID NO: 19259 - DNA, 23 bp, Homo sapiens
agtaccagagcaaggcgcgccgg

SEQ ID NO: 19260 - DNA, 23 bp, Homo sapiens
gtcatcgcctccactgttggggg

SEQ ID NO: 19261 - DNA, 23 bp, Homo sapiens
tggggggacgctgggcttgtagg

SEQ ID NO: 19262 - DNA, 23 bp, Homo sapiens
caaggcaagaagggtgagtttgg

SEQ ID NO: 19263 - DNA, 23 bp, Homo sapiens
gcttgtcagttggcaaatgatgg

SEQ ID NO: 19264 - DNA, 23 bp, Homo sapiens
gtctgagtctcaaggataaatgg

SEQ ID NO: 19265 - DNA, 23 bp, Homo sapiens
ttgttgctaggataattccaagg

SEQ ID NO: 19266 - DNA, 23 bp, Homo sapiens
ccactcttaattcagcccaacgg

SEQ ID NO: 19267 - DNA, 23 bp, Homo sapiens
tccattctcatctgaagacaagg

SEQ ID NO: 19268 - DNA, 23 bp, Homo sapiens
atcattggcgtcacagtggttgg

SEQ ID NO: 19269 - DNA, 23 bp, Homo sapiens
aggatcgacgagaacgtgctagg

SEQ ID NO: 19270 - DNA, 23 bp, Homo sapiens
gagtagagagggttcaagcaagg

SEQ ID NO: 19271 - DNA, 23 bp, Homo sapiens
tcctcttcttagtgctgtgacgg

SEQ ID NO: 19272 - DNA, 23 bp, Homo sapiens
gattcctgcatgttgatgtgagg

SEQ ID NO: 19273 - DNA, 23 bp, Homo sapiens
gtgctcctttataacttcagtgg

SEQ ID NO: 19274 - DNA, 23 bp, Homo sapiens
gtctctttactgccatcagttgg

SEQ ID NO: 19275 - DNA, 23 bp, Homo sapiens
cctcaccccacagaaactgctgg

SEQ ID NO: 19276 - DNA, 23 bp, Homo sapiens
tttggctctcactccattgttgg

SEQ ID NO: 19277 - DNA, 23 bp, Homo sapiens
gcggggccaggggtcagggcagg

SEQ ID NO: 19278 - DNA, 23 bp, Homo sapiens
aaagatgctgaataaacccaagg

SEQ ID NO: 19279 - DNA, 23 bp, Homo sapiens
tccccaaccagaaaagttgatgg

SEQ ID NO: 19280 - DNA, 23 bp, Homo sapiens
tggattctggttgtcagaactgg

SEQ ID NO: 19281 - DNA, 23 bp, Homo sapiens
tttggaaaatgcttctgcactgg

SEQ ID NO: 19282 - DNA, 23 bp, Homo sapiens
ttctcaacatttgtgcttcatgg

SEQ ID NO: 19283 - DNA, 23 bp, Homo sapiens
gcatgctatagttgtagaagagg

SEQ ID NO: 19284 - DNA, 23 bp, Homo sapiens
caagtggcgactgcacagaatgg

SEQ ID NO: 19285 - DNA, 23 bp, Homo sapiens
ctcggagaagatcagtagagcgg

SEQ ID NO: 19286 - DNA, 23 bp, Homo sapiens
tctgctcgttactatgcatgagg

SEQ ID NO: 19287 - DNA, 23 bp, Homo sapiens
cagaaatctgttccttcagctgg

SEQ ID NO: 19288 - DNA, 23 bp, Homo sapiens
actgggttttcagatcatattgg

SEQ ID NO: 19289 - DNA, 23 bp, Homo sapiens
gctgggaaccacgatctacaagg

SEQ ID NO: 19290 - DNA, 23 bp, Homo sapiens
aggacaaagacatcacttcttgg

SEQ ID NO: 19291 - DNA, 23 bp, Homo sapiens
tggcacacttactcagattttgg

SEQ ID NO: 19292 - DNA, 23 bp, Homo sapiens
ttcattcagagaaaagtgagggg

SEQ ID NO: 19293 - DNA, 23 bp, Homo sapiens
tttggtgttacagcagtctcggg

SEQ ID NO: 19294 - DNA, 23 bp, Homo sapiens
aaagtcaagcagctgagcgccgg

SEQ ID NO: 19295 - DNA, 23 bp, Homo sapiens
cttacgcggctcatggaccctgg

SEQ ID NO: 19296 - DNA, 23 bp, Homo sapiens
gacagtccgctacactagcctgg

SEQ ID NO: 19297 - DNA, 23 bp, Homo sapiens
tttgtcagtgagtttcatgttgg

SEQ ID NO: 19298 - DNA, 23 bp, Homo sapiens
ttccagaacactcagtagtaagg

SEQ ID NO: 19299 - DNA, 23 bp, Homo sapiens
gcagatgtacagacacaagcggg

SEQ ID NO: 19300 - DNA, 23 bp, Homo sapiens
atcctcctgatgatatggaatgg

SEQ ID NO: 19301 - DNA, 23 bp, Homo sapiens
cagttatgggatggatgggaagg

SEQ ID NO: 19302 - DNA, 23 bp, Homo sapiens
caactgtgggaaggctgggaagg

SEQ ID NO: 19303 - DNA, 23 bp, Homo sapiens
ttccgctctgagctgtgagaggg

SEQ ID NO: 19304 - DNA, 23 bp, Homo sapiens
agacactttaaatctctgtgcgg

SEQ ID NO: 19305 - DNA, 23 bp, Homo sapiens
aacctccataaacttctgcatgg

SEQ ID NO: 19306 - DNA, 23 bp, Homo sapiens
agatctctgtgcggaaggttagg

SEQ ID NO: 19307 - DNA, 23 bp, Homo sapiens
cttctgcctggagatctgagagg

SEQ ID NO: 19308 - DNA, 23 bp, Homo sapiens
ttccacttccagttctagtaagg

SEQ ID NO: 19309 - DNA, 23 bp, Homo sapiens
tttcgaactgagatctaagaagg

SEQ ID NO: 19310 - DNA, 23 bp, Homo sapiens
tgttttggacgttattcccatgg

SEQ ID NO: 19311 - DNA, 23 bp, Homo sapiens
cgtgtttattatgagggtcgtgg

SEQ ID NO: 19312 - DNA, 23 bp, Homo sapiens
aaacttctcattcatggagacgg

SEQ ID NO: 19313 - DNA, 23 bp, Homo sapiens
gaattgactggaatcaaccctgg

SEQ ID NO: 19314 - DNA, 23 bp, Homo sapiens
ccttggttgtcagtccatagtgg

SEQ ID NO: 19315 - DNA, 23 bp, Homo sapiens
ccggctgcttacagctcccctgg

SEQ ID NO: 19316 - DNA, 23 bp, Homo sapiens
gggccaggtgtttctgttagagg

SEQ ID NO: 19317 - DNA, 23 bp, Homo sapiens
gtttatcaggaacaaacgggggg

SEQ ID NO: 19318 - DNA, 23 bp, Homo sapiens
acgggaggtgtctactgaaaagg

SEQ ID NO: 19319 - DNA, 23 bp, Homo sapiens
ggcagggcacagtttctagaggg

SEQ ID NO: 19320 - DNA, 23 bp, Homo sapiens
gagtagtgtcttcacttgacagg

SEQ ID NO: 19321 - DNA, 23 bp, Homo sapiens
agtgtctgcactatttgtcttgg

SEQ ID NO: 19322 - DNA, 23 bp, Homo sapiens
gcaccagtaagcagggctagtgg

SEQ ID NO: 19323 - DNA, 23 bp, Homo sapiens
ctcttctagatgtgcttgcctgg

SEQ ID NO: 19324 - DNA, 23 bp, Homo sapiens
tttaatctctcttagggtagggg

SEQ ID NO: 19325 - DNA, 23 bp, Homo sapiens
tggctcctttccatgctcatggg

SEQ ID NO: 19326 - DNA, 23 bp, Homo sapiens
ctgcaccccccaagaaaaagagg

SEQ ID NO: 19327 - DNA, 23 bp, Homo sapiens
actcaaaattttggagtggttgg

SEQ ID NO: 19328 - DNA, 23 bp, Homo sapiens
ctacatcatcatcggcatacagg

SEQ ID NO: 19329 - DNA, 23 bp, Homo sapiens
ttggtagatcagaggaaggaagg

SEQ ID NO: 19330 - DNA, 23 bp, Homo sapiens
ccaacccctccagctccctgagg

SEQ ID NO: 19331 - DNA, 23 bp, Homo sapiens
atcacagttgtcacatcagcagg

SEQ ID NO: 19332 - DNA, 23 bp, Homo sapiens
ctgaattccatgaagttctgtgg

SEQ ID NO: 19333 - DNA, 23 bp, Homo sapiens
ggtctttatagctgtgtctctgg

SEQ ID NO: 19334 - DNA, 23 bp, Homo sapiens
cctgcctgcttcaggcttccagg

SEQ ID NO: 19335 - DNA, 23 bp, Homo sapiens
ggacgagatggatcggtaggggg

SEQ ID NO: 19336 - DNA, 23 bp, Homo sapiens
agcgctgcaagaagaggatgagg

SEQ ID NO: 19337 - DNA, 23 bp, Homo sapiens
acagaaaactagtccgaatcagg

SEQ ID NO: 19338 - DNA, 23 bp, Homo sapiens
cagctgatctgtcacacaccagg

SEQ ID NO: 19339 - DNA, 23 bp, Homo sapiens
ggcatgtgcttttattaacctgg

SEQ ID NO: 19340 - DNA, 23 bp, Homo sapiens
tggatgagaagaagaaggagtgg

SEQ ID NO: 19341 - DNA, 23 bp, Homo sapiens
gacggccacgggtcttagccagg

SEQ ID NO: 19342 - DNA, 23 bp, Homo sapiens
gagctgtgcccacgatgttctgg

SEQ ID NO: 19343 - DNA, 23 bp, Homo sapiens
aggtgggaaagactcagaccagg

SEQ ID NO: 19344 - DNA, 23 bp, Homo sapiens
caccttattgaagatcagcccgg

SEQ ID NO: 19345 - DNA, 23 bp, Homo sapiens
cacattcctctccttctcagcgg

SEQ ID NO: 19346 - DNA, 23 bp, Homo sapiens
tgagaatgatcacaacagccagg

SEQ ID NO: 19347 - DNA, 23 bp, Homo sapiens
ctggggtgcacagccctgatggg

SEQ ID NO: 19348 - DNA, 23 bp, Homo sapiens
cctcactgcgtggtcaccctagg

SEQ ID NO: 19349 - DNA, 23 bp, Homo sapiens
atggaagaagatccctaatatgg

SEQ ID NO: 19350 - DNA, 23 bp, Homo sapiens
catttagaacagagatgtggtgg

SEQ ID NO: 19351 - DNA, 23 bp, Homo sapiens
gatcgagatggagaaggtctagg

SEQ ID NO: 19352 - DNA, 23 bp, Homo sapiens
cactgttgaaagaagcatgaggg

SEQ ID NO: 19353 - DNA, 23 bp, Homo sapiens
agacttctaagggctagaagagg

SEQ ID NO: 19354 - DNA, 23 bp, Homo sapiens
ttcctgaaaaagttcagttgagg

SEQ ID NO: 19355 - DNA, 23 bp, Homo sapiens
ggaaacagatagtgtctcagggg

SEQ ID NO: 19356 - DNA, 23 bp, Homo sapiens
gggcaggtgctgcagtgaagggg

SEQ ID NO: 19357 - DNA, 23 bp, Homo sapiens
tcccataggttgttcacatcagg

SEQ ID NO: 19358 - DNA, 23 bp, Homo sapiens
aacccaggttctgatgtaatggg

SEQ ID NO: 19359 - DNA, 23 bp, Homo sapiens
gccaggagttcaagatcagccgg

SEQ ID NO: 19360 - DNA, 23 bp, Homo sapiens
atgcagcctcctggagaatgagg

SEQ ID NO: 19361 - DNA, 23 bp, Homo sapiens
aaacccagtcctccttttcctgg

SEQ ID NO: 19362 - DNA, 23 bp, Homo sapiens
gcaaaaggcctgttctgagtggg

SEQ ID NO: 19363 - DNA, 23 bp, Homo sapiens
cccaccagaaggtggacttaggg

SEQ ID NO: 19364 - DNA, 23 bp, Homo sapiens
ccccaccagaaggtggacttagg

SEQ ID NO: 19365 - DNA, 23 bp, Homo sapiens
caggtcgaactctggctctcagg

SEQ ID NO: 19366 - DNA, 23 bp, Homo sapiens
ccccatcgaaaccaaaggacggg

SEQ ID NO: 19367 - DNA, 23 bp, Homo sapiens
cagcaagctcagtcactccgtgg

SEQ ID NO: 19368 - DNA, 23 bp, Homo sapiens
ctggacatgaatgactgagcagg

SEQ ID NO: 19369 - DNA, 23 bp, Homo sapiens
cacccaccaaagctcagggctgg

SEQ ID NO: 19370 - DNA, 23 bp, Homo sapiens
gtgaagacatgctcaactatagg

SEQ ID NO: 19371 - DNA, 23 bp, Homo sapiens
acgagatgaaaactgggataagg

SEQ ID NO: 19372 - DNA, 23 bp, Homo sapiens
ttaggttttgatacggaaggcgg

SEQ ID NO: 19373 - DNA, 23 bp, Homo sapiens
caggtagaccagtgacatggtgg

SEQ ID NO: 19374 - DNA, 23 bp, Homo sapiens
ggcgggtcctgctggcctagagg

SEQ ID NO: 19375 - DNA, 23 bp, Homo sapiens
gaagtacagaccaacagagatgg

SEQ ID NO: 19376 - DNA, 23 bp, Homo sapiens
tgagaccaagcaaaggctgtagg

SEQ ID NO: 19377 - DNA, 23 bp, Homo sapiens
ctatctccgcgctctactgcagg

SEQ ID NO: 19378 - DNA, 23 bp, Homo sapiens
ttgggctgtaattgctaaaatgg

SEQ ID NO: 19379 - DNA, 23 bp, Homo sapiens
gctgcaagacaggcttcttaagg

SEQ ID NO: 19380 - DNA, 23 bp, Homo sapiens
tctgtgatctgcaagtgctgagg

SEQ ID NO: 19381 - DNA, 23 bp, Homo sapiens
agcaagagatagcaagtgttcgg

SEQ ID NO: 19382 - DNA, 23 bp, Homo sapiens
caccccgtcatctggctcagagg

SEQ ID NO: 19383 - DNA, 23 bp, Homo sapiens
gcagacagttgagtctacagtgg

SEQ ID NO: 19384 - DNA, 23 bp, Homo sapiens
catcattataaggacgtctccgg

SEQ ID NO: 19385 - DNA, 23 bp, Homo sapiens
gcgcaattactactatgacgtgg

SEQ ID NO: 19386 - DNA, 23 bp, Homo sapiens
gccaaggggaacagctgacgggg

SEQ ID NO: 19387 - DNA, 23 bp, Homo sapiens
gcccaggcccagccttagccagg

SEQ ID NO: 19388 - DNA, 23 bp, Homo sapiens
tctcagagtggggtatcagtcgg

SEQ ID NO: 19389 - DNA, 23 bp, Homo sapiens
taagaagcttggacttgttttgg

SEQ ID NO: 19390 - DNA, 23 bp, Homo sapiens
tgaagagctaatctgaaaagagg

SEQ ID NO: 19391 - DNA, 23 bp, Homo sapiens
gatggcgttagtcagagaacagg

SEQ ID NO: 19392 - DNA, 23 bp, Homo sapiens
cttgcggaggtgggcgtggctgg

SEQ ID NO: 19393 - DNA, 23 bp, Homo sapiens
ggaatggagacacagtctcaagg

SEQ ID NO: 19394 - DNA, 23 bp, Homo sapiens
agaagttttttgctgtttccggg

SEQ ID NO: 19395 - DNA, 23 bp, Homo sapiens
aggatacttttgggcaacagtgg

SEQ ID NO: 19396 - DNA, 23 bp, Homo sapiens
aagtcagtcttcattgtaacagg

SEQ ID NO: 19397 - DNA, 23 bp, Homo sapiens
tccattcgcaggaagctcacagg

SEQ ID NO: 19398 - DNA, 23 bp, Homo sapiens
tacatgtcccagaacggtcatgg

SEQ ID NO: 19399 - DNA, 23 bp, Homo sapiens
gacctggccctggctcagaaagg

SEQ ID NO: 19400 - DNA, 23 bp, Homo sapiens
ggcatctgcttagttcagagtgg

SEQ ID NO: 19401 - DNA, 23 bp, Homo sapiens
tgggccaccccccacatagaggg

SEQ ID NO: 19402 - DNA, 23 bp, Homo sapiens
gtgtgccccagtgggttaggtgg

SEQ ID NO: 19403 - DNA, 23 bp, Homo sapiens
ttattacacacatcagactgggg

SEQ ID NO: 19404 - DNA, 23 bp, Homo sapiens
ggtggggccagcgtcacacgcgg

SEQ ID NO: 19405 - DNA, 23 bp, Homo sapiens
tctgatgctgggtgggctagtgg

SEQ ID NO: 19406 - DNA, 23 bp, Homo sapiens
ccccagggctaccagtcgcaggg

SEQ ID NO: 19407 - DNA, 23 bp, Homo sapiens
ccctgcctcggcacagccgtagg

SEQ ID NO: 19408 - DNA, 23 bp, Homo sapiens
gccgccccctgtgtactgagcgg

SEQ ID NO: 19409 - DNA, 23 bp, Homo sapiens
gagtggggtcaacgtaattctgg

SEQ ID NO: 19410 - DNA, 23 bp, Homo sapiens
tgtgcctgccagccgctagtagg

SEQ ID NO: 19411 - DNA, 23 bp, Homo sapiens
tgtcaggcatcatagcaagccgg

SEQ ID NO: 19412 - DNA, 23 bp, Homo sapiens
ggagcaaccatcagggtaacagg

SEQ ID NO: 19413 - DNA, 23 bp, Homo sapiens
tctttctgtaaagtccagtgtgg

SEQ ID NO: 19414 - DNA, 23 bp, Homo sapiens
ctcagtcatgtttttgccagtgg

SEQ ID NO: 19415 - DNA, 23 bp, Homo sapiens
cctgggctttcatgagataccgg

SEQ ID NO: 19416 - DNA, 23 bp, Homo sapiens
aggaggagaatgatgggcattgg

SEQ ID NO: 19417 - DNA, 23 bp, Homo sapiens
ggttcgttacttgaagcagaagg

SEQ ID NO: 19418 - DNA, 23 bp, Homo sapiens
gtcgggggtggggctctaggtgg

SEQ ID NO: 19419 - DNA, 23 bp, Homo sapiens
acaacccacacccaaggggatgg

SEQ ID NO: 19420 - DNA, 23 bp, Homo sapiens
attatcaggtagaggaagaaagg

SEQ ID NO: 19421 - DNA, 23 bp, Homo sapiens
ggtgtggaaaccatctgttgtgg

SEQ ID NO: 19422 - DNA, 23 bp, Homo sapiens
gtttgctttctctagtccatcgg

SEQ ID NO: 19423 - DNA, 23 bp, Homo sapiens
ggggcagggcaccagtgaacagg

SEQ ID NO: 19424 - DNA, 23 bp, Homo sapiens
aatctgattggtaaaggaagtgg

SEQ ID NO: 19425 - DNA, 23 bp, Homo sapiens
acagaggagttgttcagagcagg

SEQ ID NO: 19426 - DNA, 23 bp, Homo sapiens
ttctccaatcagatgtagtctgg

SEQ ID NO: 19427 - DNA, 23 bp, Homo sapiens
ggaggtattccacctcctaccgg

SEQ ID NO: 19428 - DNA, 23 bp, Homo sapiens
tgcagctgagcagggagcagtgg

SEQ ID NO: 19429 - DNA, 23 bp, Homo sapiens
aagggcctgattctagacattgg

SEQ ID NO: 19430 - DNA, 23 bp, Homo sapiens
cccctctagcctttcttaacagg

SEQ ID NO: 19431 - DNA, 23 bp, Homo sapiens
tgctggccgtcaagaagtaaagg

SEQ ID NO: 19432 - DNA, 23 bp, Homo sapiens
attttggaggcattatggtgtgg

SEQ ID NO: 19433 - DNA, 23 bp, Homo sapiens
ctcgctcagactgtgccacttgg

SEQ ID NO: 19434 - DNA, 23 bp, Homo sapiens
gccctggttgctagtttcgccgg

SEQ ID NO: 19435 - DNA, 23 bp, Homo sapiens
gcagctgggcagctggttacagg

SEQ ID NO: 19436 - DNA, 23 bp, Homo sapiens
aaggacagcaagtatgtagatgg

SEQ ID NO: 19437 - DNA, 23 bp, Homo sapiens
gggggtggctggcatctatccgg

SEQ ID NO: 19438 - DNA, 23 bp, Homo sapiens
ggcgaagggtcagggctccgtgg

SEQ ID NO: 19439 - DNA, 23 bp, Homo sapiens
gcacactttgctggaatcctagg

SEQ ID NO: 19440 - DNA, 23 bp, Homo sapiens
cctccctggaggtgacctgaggg

SEQ ID NO: 19441 - DNA, 23 bp, Homo sapiens
ctgtctacttgttcttgcccagg

SEQ ID NO: 19442 - DNA, 23 bp, Homo sapiens
gaaagagaactccgagtgagggg

SEQ ID NO: 19443 - DNA, 23 bp, Homo sapiens
aagtggcacgtgctctgtgatgg

SEQ ID NO: 19444 - DNA, 23 bp, Homo sapiens
tggggtgggagtcagggcgcagg

SEQ ID NO: 19445 - DNA, 23 bp, Homo sapiens
cgtgaatgaaatcacaaccgagg

SEQ ID NO: 19446 - DNA, 23 bp, Homo sapiens
caccagctgaaggcctgagtggg

SEQ ID NO: 19447 - DNA, 23 bp, Homo sapiens
gcatgtggtgcattcaggagtgg

SEQ ID NO: 19448 - DNA, 23 bp, Homo sapiens
tgcacactggcattccctggtgg

SEQ ID NO: 19449 - DNA, 23 bp, Homo sapiens
ggcttggtggggctacgtcctgg

SEQ ID NO: 19450 - DNA, 23 bp, Homo sapiens
cagtggaatttgggctcatttgg

SEQ ID NO: 19451 - DNA, 23 bp, Homo sapiens
tgaggccttcatgtcagtgcagg

SEQ ID NO: 19452 - DNA, 23 bp, Homo sapiens
tcaatggccaagcagaagctggg

SEQ ID NO: 19453 - DNA, 23 bp, Homo sapiens
gggaaaatgtaggctctaaaggg

SEQ ID NO: 19454 - DNA, 23 bp, Homo sapiens
ctgggctggggcagtgtcagtgg

SEQ ID NO: 19455 - DNA, 23 bp, Homo sapiens
ttgggtcctgatgggtctcaagg

SEQ ID NO: 19456 - DNA, 23 bp, Homo sapiens
ggtccagtccactccctcagagg

SEQ ID NO: 19457 - DNA, 23 bp, Homo sapiens
ctgggccttgctgcttcacatgg

SEQ ID NO: 19458 - DNA, 23 bp, Homo sapiens
tacacctggatgaatctttttgg

SEQ ID NO: 19459 - DNA, 23 bp, Homo sapiens
gcactgaagtacattttgctagg

SEQ ID NO: 19460 - DNA, 23 bp, Homo sapiens
aaatcaacagtgcgtgtctgcgg

SEQ ID NO: 19461 - DNA, 23 bp, Homo sapiens
aatctcataaatacaggcagggg

SEQ ID NO: 19462 - DNA, 23 bp, Homo sapiens
tttatggctttcctaaaccaagg

SEQ ID NO: 19463 - DNA, 23 bp, Homo sapiens
ttgtaagcggcaaggtcttaagg

SEQ ID NO: 19464 - DNA, 23 bp, Homo sapiens
agcctgaccccagggtaggaagg

SEQ ID NO: 19465 - DNA, 23 bp, Homo sapiens
agcgtggtgacagcaccgtaggg

SEQ ID NO: 19466 - DNA, 23 bp, Homo sapiens
catttggctcagaaatgccttgg

SEQ ID NO: 19467 - DNA, 23 bp, Homo sapiens
ttctgaattcaggtgtaccgtgg

SEQ ID NO: 19468 - DNA, 23 bp, Homo sapiens
agattcctttgttggactaatgg

SEQ ID NO: 19469 - DNA, 23 bp, Homo sapiens
gccctgttaaaggctctttatgg

SEQ ID NO: 19470 - DNA, 23 bp, Homo sapiens
ttaatgggcaaacgggatgctgg

SEQ ID NO: 19471 - DNA, 23 bp, Homo sapiens
gtatcccccgagagcagaatagg

SEQ ID NO: 19472 - DNA, 23 bp, Homo sapiens
gcgaagctgtgcatttatgcagg

SEQ ID NO: 19473 - DNA, 23 bp, Homo sapiens
ggggcttttactctgaaccttgg

SEQ ID NO: 19474 - DNA, 23 bp, Homo sapiens
gatgagctgattgcaaagctggg

SEQ ID NO: 19475 - DNA, 23 bp, Homo sapiens
ttcatcctcagaagcaggtatgg

SEQ ID NO: 19476 - DNA, 23 bp, Homo sapiens
gagttagcttttccccattttgg

SEQ ID NO: 19477 - DNA, 23 bp, Homo sapiens
aggtcagatcttctccatcttgg

SEQ ID NO: 19478 - DNA, 23 bp, Homo sapiens
agacgtgaatcacatcctcgtgg

SEQ ID NO: 19479 - DNA, 23 bp, Homo sapiens
ctcctccaatgtgctctcctagg

SEQ ID NO: 19480 - DNA, 23 bp, Homo sapiens
tgctgcctcaatgacaggtgagg

SEQ ID NO: 19481 - DNA, 23 bp, Homo sapiens
ttcaacatgagttttggtggggg

SEQ ID NO: 19482 - DNA, 23 bp, Homo sapiens
aagctcaccctatacctctgtgg

SEQ ID NO: 19483 - DNA, 23 bp, Homo sapiens
gagaaaggaaccgagcttgtagg

SEQ ID NO: 19484 - DNA, 23 bp, Homo sapiens
gcacagcaaaagcccctccttgg

SEQ ID NO: 19485 - DNA, 23 bp, Homo sapiens
acacacacaaatactgctcaagg

SEQ ID NO: 19486 - DNA, 23 bp, Homo sapiens
ggatacatcactaaaggctaagg

SEQ ID NO: 19487 - DNA, 23 bp, Homo sapiens
tcagcttcaagacgcgtccctgg

SEQ ID NO: 19488 - DNA, 23 bp, Homo sapiens
ctgctaacgctcacctcagcagg

SEQ ID NO: 19489 - DNA, 23 bp, Homo sapiens
gcatcctgaagctgctggatggg

SEQ ID NO: 19490 - DNA, 23 bp, Homo sapiens
gacttggactctgatgaatgagg

SEQ ID NO: 19491 - DNA, 23 bp, Homo sapiens
gtggctcaggtgaagtagtgcgg

SEQ ID NO: 19492 - DNA, 23 bp, Homo sapiens
actacaacccaaacatatgaggg

SEQ ID NO: 19493 - DNA, 23 bp, Homo sapiens
atatgagggaagccgttagaagg

SEQ ID NO: 19494 - DNA, 23 bp, Homo sapiens
cctttccgtgtgttatttcttgg

SEQ ID NO: 19495 - DNA, 23 bp, Homo sapiens
agtaagcaagtctttaaccctgg

SEQ ID NO: 19496 - DNA, 23 bp, Homo sapiens
aaaacagtcatcagtatggtcgg

SEQ ID NO: 19497 - DNA, 23 bp, Homo sapiens
agcaagatcaccaaatcttaggg

SEQ ID NO: 19498 - DNA, 23 bp, Homo sapiens
tcaatgtcgtctcactttcttgg

SEQ ID NO: 19499 - DNA, 23 bp, Homo sapiens
aagcctcgaatgggcttctgagg

SEQ ID NO: 19500 - DNA, 23 bp, Homo sapiens
gagaggcctgaaaatgtgacagg

SEQ ID NO: 19501 - DNA, 23 bp, Homo sapiens
ggagaacacaaggatgggcacgg

SEQ ID NO: 19502 - DNA, 23 bp, Homo sapiens
ccttccctttcagactgagaagg

SEQ ID NO: 19503 - DNA, 23 bp, Homo sapiens
agcccctcgggagtcgtcagtgg

SEQ ID NO: 19504 - DNA, 23 bp, Homo sapiens
gcgtcctcctgtgtcacttaagg

SEQ ID NO: 19505 - DNA, 23 bp, Homo sapiens
agtggagtggtcacttcagaagg

SEQ ID NO: 19506 - DNA, 23 bp, Homo sapiens
agaaacctggttctagctgcagg

SEQ ID NO: 19507 - DNA, 23 bp, Homo sapiens
tgtaaccttcttctggtgactgg

SEQ ID NO: 19508 - DNA, 23 bp, Homo sapiens
ttgtgatattctggaggaggagg

SEQ ID NO: 19509 - DNA, 23 bp, Homo sapiens
caggtggagcatcacggagcagg

SEQ ID NO: 19510 - DNA, 23 bp, Homo sapiens
aaggggccactgactcagagcgg

SEQ ID NO: 19511 - DNA, 23 bp, Homo sapiens
gcaactcagctctttgcaagagg

SEQ ID NO: 19512 - DNA, 23 bp, Homo sapiens
cagcgttttctgaagaagtgagg

SEQ ID NO: 19513 - DNA, 23 bp, Homo sapiens
tttccttctcagctcaggagagg

SEQ ID NO: 19514 - DNA, 23 bp, Homo sapiens
tttttggacccgattaatgatgg

SEQ ID NO: 19515 - DNA, 23 bp, Homo sapiens
tcttcatgttttctcttcagtgg

SEQ ID NO: 19516 - DNA, 23 bp, Homo sapiens
ccagaaggacctgaacaacaagg

SEQ ID NO: 19517 - DNA, 23 bp, Homo sapiens
atgtagccagccggtctttgagg

SEQ ID NO: 19518 - DNA, 23 bp, Homo sapiens
cggcagatcatcagttagagcgg

SEQ ID NO: 19519 - DNA, 23 bp, Homo sapiens
aaggcctggggtgggatcagagg

SEQ ID NO: 19520 - DNA, 23 bp, Homo sapiens
gatgcccaggcagatcatgtagg

SEQ ID NO: 19521 - DNA, 23 bp, Homo sapiens
ccccaggtcttaggaaagacagg

SEQ ID NO: 19522 - DNA, 23 bp, Homo sapiens
tggagccggccctcggtgatggg

SEQ ID NO: 19523 - DNA, 23 bp, Homo sapiens
agccaccacattccttagtgtgg

SEQ ID NO: 19524 - DNA, 23 bp, Homo sapiens
cgaatgttcaatgcagagaatgg

SEQ ID NO: 19525 - DNA, 23 bp, Homo sapiens
aaatgtggaaagggtggctgagg

SEQ ID NO: 19526 - DNA, 23 bp, Homo sapiens
agagtttcacagcctcttgcagg

SEQ ID NO: 19527 - DNA, 23 bp, Homo sapiens
gctttggtttggctgcagtgagg

SEQ ID NO: 19528 - DNA, 23 bp, Homo sapiens
taaacattagactccacgaacgg

SEQ ID NO: 19529 - DNA, 23 bp, Homo sapiens
gctctgcagtgtgaactcatagg

SEQ ID NO: 19530 - DNA, 23 bp, Homo sapiens
acacaaaaattagctgggcatgg

SEQ ID NO: 19531 - DNA, 23 bp, Homo sapiens
catcatgctacgctcagtgaagg

SEQ ID NO: 19532 - DNA, 23 bp, Homo sapiens
cttggagccaggtctacggcagg

SEQ ID NO: 19533 - DNA, 23 bp, Homo sapiens
gcagaagcaatgtctacctttgg

SEQ ID NO: 19534 - DNA, 23 bp, Homo sapiens
agtgtgaattaagatgccgaagg

SEQ ID NO: 19535 - DNA, 23 bp, Homo sapiens
ataagacatgtgtgacccattgg

SEQ ID NO: 19536 - DNA, 23 bp, Homo sapiens
ggctggagtcagctacctccagg

SEQ ID NO: 19537 - DNA, 23 bp, Homo sapiens
tcttcccacttctattcctgagg

SEQ ID NO: 19538 - DNA, 23 bp, Homo sapiens
tctcatctgtagtcctccttagg

SEQ ID NO: 19539 - DNA, 23 bp, Homo sapiens
tctcgctgcgttccttctgaagg

SEQ ID NO: 19540 - DNA, 23 bp, Homo sapiens
gtctgagaaggctttcattctgg

SEQ ID NO: 19541 - DNA, 23 bp, Homo sapiens
aagcttgcccagctctaggaggg

SEQ ID NO: 19542 - DNA, 23 bp, Homo sapiens
cagcagcggctgatggactgagg

SEQ ID NO: 19543 - DNA, 23 bp, Homo sapiens
cctagatgtgcagtgcgagcagg

SEQ ID NO: 19544 - DNA, 23 bp, Homo sapiens
tggcactatatcctaactgtagg

SEQ ID NO: 19545 - DNA, 23 bp, Homo sapiens
tgtctacctgtccacctgcaagg

SEQ ID NO: 19546 - DNA, 23 bp, Homo sapiens
tcatgtcgctttaggtcagctgg

SEQ ID NO: 19547 - DNA, 23 bp, Homo sapiens
agccacagattcagtcaattcgg

SEQ ID NO: 19548 - DNA, 23 bp, Homo sapiens
aaggaaggcacatcatggcttgg

SEQ ID NO: 19549 - DNA, 23 bp, Homo sapiens
cagtacctcaagatcatggcagg

SEQ ID NO: 19550 - DNA, 23 bp, Homo sapiens
gattctaagtcttctggctgggg

SEQ ID NO: 19551 - DNA, 23 bp, Homo sapiens
ggttcaagatggagtcactctgg

SEQ ID NO: 19552 - DNA, 23 bp, Homo sapiens
agaacggctttctgctgcaatgg

SEQ ID NO: 19553 - DNA, 23 bp, Homo sapiens
caaagagttccgcagcaaacagg

SEQ ID NO: 19554 - DNA, 23 bp, Homo sapiens
ggtggagctacagaacacgaggg

SEQ ID NO: 19555 - DNA, 23 bp, Homo sapiens
tatcagggaaggacttcaaaagg

SEQ ID NO: 19556 - DNA, 23 bp, Homo sapiens
ctgctgacccactggtcaggtgg

SEQ ID NO: 19557 - DNA, 23 bp, Homo sapiens
ccagggctacaccatgaggaggg

SEQ ID NO: 19558 - DNA, 23 bp, Homo sapiens
acgggaacacaggaaatcagggg

SEQ ID NO: 19559 - DNA, 23 bp, Homo sapiens
ctcactgacagcacttactgtgg

SEQ ID NO: 19560 - DNA, 23 bp, Homo sapiens
aattgaagtgctgtgagaaaagg

SEQ ID NO: 19561 - DNA, 23 bp, Homo sapiens
tttggtggcagctaaggtatggg

SEQ ID NO: 19562 - DNA, 23 bp, Homo sapiens
tctaaattctttgtgacctgagg

SEQ ID NO: 19563 - DNA, 23 bp, Homo sapiens
gattctaaagggaaagtgctagg

SEQ ID NO: 19564 - DNA, 23 bp, Homo sapiens
agacctttctttcagttttgtgg

SEQ ID NO: 19565 - DNA, 23 bp, Homo sapiens
tgtgaatctatggagttgactgg

SEQ ID NO: 19566 - DNA, 23 bp, Homo sapiens
ctaagagaaaatgggtcccttgg

SEQ ID NO: 19567 - DNA, 23 bp, Homo sapiens
tctccatagattcacaagagggg

SEQ ID NO: 19568 - DNA, 23 bp, Homo sapiens
tcatgaatctatggagatgaagg

SEQ ID NO: 19569 - DNA, 23 bp, Homo sapiens
tccattctcagcacagtgtccgg

SEQ ID NO: 19570 - DNA, 23 bp, Homo sapiens
ttcatctttacccaaaagagtgg

SEQ ID NO: 19571 - DNA, 23 bp, Homo sapiens
ataatgagaacagaatgtcctgg

SEQ ID NO: 19572 - DNA, 23 bp, Homo sapiens
aaaagggcagactctgtgactgg

SEQ ID NO: 19573 - DNA, 23 bp, Homo sapiens
gttggcaaggggcttctgggtgg

SEQ ID NO: 19574 - DNA, 23 bp, Homo sapiens
tgaggctactgtggcatcttagg

SEQ ID NO: 19575 - DNA, 23 bp, Homo sapiens
caaatgaggtactgggtgaaagg

SEQ ID NO: 19576 - DNA, 23 bp, Homo sapiens
gcttcttgtttccccaaatcagg

SEQ ID NO: 19577 - DNA, 23 bp, Homo sapiens
catgtgaggtactgggtgaaagg

SEQ ID NO: 19578 - DNA, 23 bp, Homo sapiens
agatgctggggcccatgatctgg

SEQ ID NO: 19579 - DNA, 23 bp, Homo sapiens
aaaggtgtgttttagcttcttgg

SEQ ID NO: 19580 - DNA, 23 bp, Homo sapiens
gtcgtcgttcctcaaggtgtggg

SEQ ID NO: 19581 - DNA, 23 bp, Homo sapiens
atgcatctctaaaggtgatttgg

SEQ ID NO: 19582 - DNA, 23 bp, Homo sapiens
taaaataagtgagtgacccaagg

SEQ ID NO: 19583 - DNA, 23 bp, Homo sapiens
aggggtctctatggaacaaaagg

SEQ ID NO: 19584 - DNA, 23 bp, Homo sapiens
agcctgaagggtcagttcactgg

SEQ ID NO: 19585 - DNA, 23 bp, Homo sapiens
ccaggaggagtgtgataaatagg

SEQ ID NO: 19586 - DNA, 23 bp, Homo sapiens
agtgtattggctaattccagtgg

SEQ ID NO: 19587 - DNA, 23 bp, Homo sapiens
tctctgcttaaagactgtagagg

SEQ ID NO: 19588 - DNA, 23 bp, Homo sapiens
gctatttctggagcaagtgtcgg

SEQ ID NO: 19589 - DNA, 23 bp, Homo sapiens
aatatattgcccaggtgaaaggg

SEQ ID NO: 19590 - DNA, 23 bp, Homo sapiens
atgaccagcaggtgtttgaaagg

SEQ ID NO: 19591 - DNA, 23 bp, Homo sapiens
tggtggctgctaggacagcatgg

SEQ ID NO: 19592 - DNA, 23 bp, Homo sapiens
gcaagcaaggcctatctcccagg

SEQ ID NO: 19593 - DNA, 23 bp, Homo sapiens
gccgagggcagagagctgagggg

SEQ ID NO: 19594 - DNA, 23 bp, Homo sapiens
gcagagctgtcagtcgcccgtgg

SEQ ID NO: 19595 - DNA, 23 bp, Homo sapiens
tagctgccagggttacaagtagg

SEQ ID NO: 19596 - DNA, 23 bp, Homo sapiens
gtcagaagtaagcgtcctgccgg

SEQ ID NO: 19597 - DNA, 23 bp, Homo sapiens
cctggacacccgcttctgagagg

SEQ ID NO: 19598 - DNA, 23 bp, Homo sapiens
cggggcccaagccatctttgagg

SEQ ID NO: 19599 - DNA, 23 bp, Homo sapiens
gaagactagcttttcaaagcagg

SEQ ID NO: 19600 - DNA, 23 bp, Homo sapiens
ctccaagactcaaagtagcccgg

SEQ ID NO: 19601 - DNA, 23 bp, Homo sapiens
agtccgtccctccgacactgagg

SEQ ID NO: 19602 - DNA, 23 bp, Homo sapiens
agcaagaacagtgatcatgcagg

SEQ ID NO: 19603 - DNA, 23 bp, Homo sapiens
ggcctgctgggcccactaccagg

SEQ ID NO: 19604 - DNA, 23 bp, Homo sapiens
ttcggcttccgcagataggtcgg

SEQ ID NO: 19605 - DNA, 23 bp, Homo sapiens
tgcctggcggggttaggagtcgg

SEQ ID NO: 19606 - DNA, 23 bp, Homo sapiens
cctgatggaggtgacatcactgg

SEQ ID NO: 19607 - DNA, 23 bp, Homo sapiens
gtggagggggaagcctgacttgg

SEQ ID NO: 19608 - DNA, 23 bp, Homo sapiens
aacagctgcagctgaaacttagg

SEQ ID NO: 19609 - DNA, 23 bp, Homo sapiens
gcgggctttggtgtcctcagagg

SEQ ID NO: 19610 - DNA, 23 bp, Homo sapiens
ggctcatttcttgtagtgattgg

SEQ ID NO: 19611 - DNA, 23 bp, Homo sapiens
ccggaggagacagcacctatcgg

SEQ ID NO: 19612 - DNA, 23 bp, Homo sapiens
acagcagatcatgaaagttttgg

SEQ ID NO: 19613 - DNA, 23 bp, Homo sapiens
accgtggcacaggccgtcactgg

SEQ ID NO: 19614 - DNA, 23 bp, Homo sapiens
gccacagccgcatcttgatcagg

SEQ ID NO: 19615 - DNA, 23 bp, Homo sapiens
ccaggtgtctcatgatctttggg

SEQ ID NO: 19616 - DNA, 23 bp, Homo sapiens
caggcatgggtgtctctcggggg

SEQ ID NO: 19617 - DNA, 23 bp, Homo sapiens
ggagatgtggcaggataataggg

SEQ ID NO: 19618 - DNA, 23 bp, Homo sapiens
gaggaggaggatacctgagtggg

SEQ ID NO: 19619 - DNA, 23 bp, Homo sapiens
ccagctcggtcagctccagccgg

SEQ ID NO: 19620 - DNA, 23 bp, Homo sapiens
tgatttcaggcagagctgctggg

SEQ ID NO: 19621 - DNA, 23 bp, Homo sapiens
aaacccggcggtggaaacagtgg

SEQ ID NO: 19622 - DNA, 23 bp, Homo sapiens
atgtcaaacccctcatcttttgg

SEQ ID NO: 19623 - DNA, 23 bp, Homo sapiens
cagtgctgctgagagacatgcgg

SEQ ID NO: 19624 - DNA, 23 bp, Homo sapiens
acctggacgtagaggggccttgg

SEQ ID NO: 19625 - DNA, 23 bp, Homo sapiens
gaaactaacaagaaagcaggggg

SEQ ID NO: 19626 - DNA, 23 bp, Homo sapiens
ggcatatgaggagtacaacccgg

SEQ ID NO: 19627 - DNA, 23 bp, Homo sapiens
ccaaccgacctggacgtagaggg

SEQ ID NO: 19628 - DNA, 23 bp, Homo sapiens
agccgtgtgctcccacctcaggg

SEQ ID NO: 19629 - DNA, 23 bp, Homo sapiens
cctaacaacaaagccaagatagg

SEQ ID NO: 19630 - DNA, 23 bp, Homo sapiens
ggcactgtggtcagatgtccagg

SEQ ID NO: 19631 - DNA, 23 bp, Homo sapiens
aggttgggtcagaatgtgcatgg

SEQ ID NO: 19632 - DNA, 23 bp, Homo sapiens
gcgggtgcgttcagcttgaatgg

SEQ ID NO: 19633 - DNA, 23 bp, Homo sapiens
taagttcagattgtgattggtgg

SEQ ID NO: 19634 - DNA, 23 bp, Homo sapiens
attcctagggatttacatcttgg

SEQ ID NO: 19635 - DNA, 23 bp, Homo sapiens
ccaaggacaatgtgttattgggg

SEQ ID NO: 19636 - DNA, 23 bp, Homo sapiens
tcggccatgtccggctgacacgg

SEQ ID NO: 19637 - DNA, 23 bp, Homo sapiens
tcacagctgcaggcatcagccgg

SEQ ID NO: 19638 - DNA, 23 bp, Homo sapiens
acttttggctttccatgtattgg

SEQ ID NO: 19639 - DNA, 23 bp, Homo sapiens
taaagaagcacgtttagtactgg

SEQ ID NO: 19640 - DNA, 23 bp, Homo sapiens
cccggaggaggactacgggttgg

SEQ ID NO: 19641 - DNA, 23 bp, Homo sapiens
tgacaactgcttagtcccactgg

SEQ ID NO: 19642 - DNA, 23 bp, Homo sapiens
tccaaacaagcagctggataagg

SEQ ID NO: 19643 - DNA, 23 bp, Homo sapiens
gctccaggactggcttcagcagg

SEQ ID NO: 19644 - DNA, 23 bp, Homo sapiens
gagattgtctattagtgcgatgg

SEQ ID NO: 19645 - DNA, 23 bp, Homo sapiens
cattcctttggcattagggatgg

SEQ ID NO: 19646 - DNA, 23 bp, Homo sapiens
tcatatttgaggagatgggatgg

SEQ ID NO: 19647 - DNA, 23 bp, Homo sapiens
aaagacagtcaacgttgcgaagg

SEQ ID NO: 19648 - DNA, 23 bp, Homo sapiens
ctggagaacagcaagatctaggg

SEQ ID NO: 19649 - DNA, 23 bp, Homo sapiens
gtgggtgccagcgcgtccgacgg

SEQ ID NO: 19650 - DNA, 23 bp, Homo sapiens
actagtagcgctatttccgaagg

SEQ ID NO: 19651 - DNA, 23 bp, Homo sapiens
gtgggcgccagcgcgtctgatgg

SEQ ID NO: 19652 - DNA, 23 bp, Homo sapiens
cctcccagagtcacttcttcagg

SEQ ID NO: 19653 - DNA, 23 bp, Homo sapiens
taaaggcgcactgccctagccgg

SEQ ID NO: 19654 - DNA, 23 bp, Homo sapiens
gattcaggaagacgacgtaatgg

SEQ ID NO: 19655 - DNA, 23 bp, Homo sapiens
acccatttgtgtttgaaagcagg

SEQ ID NO: 19656 - DNA, 23 bp, Homo sapiens
atagatctcagaacgttctttgg

SEQ ID NO: 19657 - DNA, 23 bp, Homo sapiens
tggcttctactcgcacagctagg

SEQ ID NO: 19658 - DNA, 23 bp, Homo sapiens
tgaattgggctaccctgtgatgg

SEQ ID NO: 19659 - DNA, 23 bp, Homo sapiens
tgctgctggcacaagtcacttgg

SEQ ID NO: 19660 - DNA, 23 bp, Homo sapiens
cacactgcaaggacacttgaagg

SEQ ID NO: 19661 - DNA, 23 bp, Homo sapiens
gactattgccccagataacacgg

SEQ ID NO: 19662 - DNA, 23 bp, Homo sapiens
gcctcagcattcaacaaagacgg

SEQ ID NO: 19663 - DNA, 23 bp, Homo sapiens
cccagggcttctggcatcactgg

SEQ ID NO: 19664 - DNA, 23 bp, Homo sapiens
tgtccgtgcacatggtttaaagg

SEQ ID NO: 19665 - DNA, 23 bp, Homo sapiens
atctcaagtatctgcacatatgg

SEQ ID NO: 19666 - DNA, 23 bp, Homo sapiens
tcctcactggatggttaagcagg

SEQ ID NO: 19667 - DNA, 23 bp, Homo sapiens
ccgggagtcgcccaagtgagggg

SEQ ID NO: 19668 - DNA, 23 bp, Homo sapiens
ccaggctcactgacattgagagg

SEQ ID NO: 19669 - DNA, 23 bp, Homo sapiens
aaatggcgtcatcacagcagagg

SEQ ID NO: 19670 - DNA, 23 bp, Homo sapiens
ccttttgataaggaagctgaagg

SEQ ID NO: 19671 - DNA, 23 bp, Homo sapiens
agtcaagtttcttttggagaagg

SEQ ID NO: 19672 - DNA, 23 bp, Homo sapiens
cgtgtctgggacgggtctacggg

SEQ ID NO: 19673 - DNA, 23 bp, Homo sapiens
actgtggagaactggactgacgg

SEQ ID NO: 19674 - DNA, 23 bp, Homo sapiens
tagctattgtcgctccactctgg

SEQ ID NO: 19675 - DNA, 23 bp, Homo sapiens
cccagcagtggttcagtacatgg

SEQ ID NO: 19676 - DNA, 23 bp, Homo sapiens
cgttcacattcaatcctttctgg

SEQ ID NO: 19677 - DNA, 23 bp, Homo sapiens
gcagcgctccgggctgcagtagg

SEQ ID NO: 19678 - DNA, 23 bp, Homo sapiens
ccggcagccttctgtgtcagcgg

SEQ ID NO: 19679 - DNA, 23 bp, Homo sapiens
gatttggattctagctgcagcgg

SEQ ID NO: 19680 - DNA, 23 bp, Homo sapiens
aatgtgtgaagtcttcaagatgg

SEQ ID NO: 19681 - DNA, 23 bp, Homo sapiens
tacctcctcacacagatgtaagg

SEQ ID NO: 19682 - DNA, 23 bp, Homo sapiens
tcttgacttcaatttcagtgggg

SEQ ID NO: 19683 - DNA, 23 bp, Homo sapiens
agcagaaattctgggagaagggg

SEQ ID NO: 19684 - DNA, 23 bp, Homo sapiens
acctccgtgccaggaagtaaagg

SEQ ID NO: 19685 - DNA, 23 bp, Homo sapiens
attccttggaattggaagaatgg

SEQ ID NO: 19686 - DNA, 23 bp, Homo sapiens
gtccagcagcatgcatcataagg

SEQ ID NO: 19687 - DNA, 23 bp, Homo sapiens
gaagcacagagaggctgagaggg

SEQ ID NO: 19688 - DNA, 23 bp, Homo sapiens
cgatggaagttctgttgagttgg

SEQ ID NO: 19689 - DNA, 23 bp, Homo sapiens
gcaacgagtgtggaaaccgctgg

SEQ ID NO: 19690 - DNA, 23 bp, Homo sapiens
gcaatgaatgtggcaatcgctgg

SEQ ID NO: 19691 - DNA, 23 bp, Homo sapiens
aaaggccgaacacattaaatagg

SEQ ID NO: 19692 - DNA, 23 bp, Homo sapiens
tggaaggccaaaggcattaaagg

SEQ ID NO: 19693 - DNA, 23 bp, Homo sapiens
tgccagggacactacacataagg

SEQ ID NO: 19694 - DNA, 23 bp, Homo sapiens
ggacatcttctaagtctttctgg

SEQ ID NO: 19695 - DNA, 23 bp, Homo sapiens
cggggtgtcaggggagtgagggg

SEQ ID NO: 19696 - DNA, 23 bp, Homo sapiens
ttctaaccataggcattctcggg

SEQ ID NO: 19697 - DNA, 23 bp, Homo sapiens
gtccttatcctgtgtgctttagg

SEQ ID NO: 19698 - DNA, 23 bp, Homo sapiens
acattaaataggggtaaggatgg

SEQ ID NO: 19699 - DNA, 23 bp, Homo sapiens
accatagcaagtgggtgtgctgg

SEQ ID NO: 19700 - DNA, 23 bp, Homo sapiens
cgtcctcaggtcactttttgtgg

SEQ ID NO: 19701 - DNA, 23 bp, Homo sapiens
ttattttgttgatcgtctcgtgg

SEQ ID NO: 19702 - DNA, 23 bp, Homo sapiens
aggaaaacagactaaggctgcgg

SEQ ID NO: 19703 - DNA, 23 bp, Homo sapiens
agtgaaactaccaaccctatggg

SEQ ID NO: 19704 - DNA, 23 bp, Homo sapiens
agggtccaggctcatctccgtgg

SEQ ID NO: 19705 - DNA, 23 bp, Homo sapiens
cgggctggcattcagacctaagg

SEQ ID NO: 19706 - DNA, 23 bp, Homo sapiens
cagtcggagcgggggtgaggggg

SEQ ID NO: 19707 - DNA, 23 bp, Homo sapiens
gtgagactgtggagatgagaagg

SEQ ID NO: 19708 - DNA, 23 bp, Homo sapiens
gcacctccaaggtcaggacgcgg

SEQ ID NO: 19709 - DNA, 23 bp, Homo sapiens
ttacaaccccaatctatacatgg

SEQ ID NO: 19710 - DNA, 23 bp, Homo sapiens
aattatttgtcaccaagagctgg

SEQ ID NO: 19711 - DNA, 23 bp, Homo sapiens
tccaacagactcacagccttagg

SEQ ID NO: 19712 - DNA, 23 bp, Homo sapiens
cgctgagggggagggggagtggg

SEQ ID NO: 19713 - DNA, 23 bp, Homo sapiens
ccccgccgggcacatgtgaaagg

SEQ ID NO: 19714 - DNA, 23 bp, Homo sapiens
gcgaagcccacaaccccgccggg

SEQ ID NO: 19715 - DNA, 23 bp, Homo sapiens
cacatgggacagatgtaaaaggg

SEQ ID NO: 19716 - DNA, 23 bp, Homo sapiens
ccttccgatgacagtgctctagg

SEQ ID NO: 19717 - DNA, 23 bp, Homo sapiens
aaccagcagacggattggtgtgg

SEQ ID NO: 19718 - DNA, 23 bp, Homo sapiens
agccatcccagtcctcaagctgg

SEQ ID NO: 19719 - DNA, 23 bp, Homo sapiens
ctctcttcactattcctaggagg

SEQ ID NO: 19720 - DNA, 23 bp, Homo sapiens
aggggtcggggggagcttagtgg

SEQ ID NO: 19721 - DNA, 23 bp, Homo sapiens
ctcagcccaccctcttcagatgg

SEQ ID NO: 19722 - DNA, 23 bp, Homo sapiens
agaagtgtcgggcactgttcggg

SEQ ID NO: 19723 - DNA, 23 bp, Homo sapiens
gacttggtgacgagcgacagcgg

SEQ ID NO: 19724 - DNA, 23 bp, Homo sapiens
gatcaacagaataactggtgcgg

SEQ ID NO: 19725 - DNA, 23 bp, Homo sapiens
aaatacatccaggaaagacatgg

SEQ ID NO: 19726 - DNA, 23 bp, Homo sapiens
ctcgatggagatcaagtgatcgg

SEQ ID NO: 19727 - DNA, 23 bp, Homo sapiens
ttggcaacatcacttaagggcgg

SEQ ID NO: 19728 - DNA, 23 bp, Homo sapiens
gaggctggtactacaaagggagg

SEQ ID NO: 19729 - DNA, 23 bp, Homo sapiens
acggacatccaaaaattgcttgg

SEQ ID NO: 19730 - DNA, 23 bp, Homo sapiens
ttctcttcagtgaactttgatgg

SEQ ID NO: 19731 - DNA, 23 bp, Homo sapiens
ttcgctgccacagatgactaggg

SEQ ID NO: 19732 - DNA, 23 bp, Homo sapiens
gctgtgttctcacaagttcacgg

SEQ ID NO: 19733 - DNA, 23 bp, Homo sapiens
cagtgtcagtctttcctctccgg

SEQ ID NO: 19734 - DNA, 23 bp, Homo sapiens
gagaaaacttggaggttcgctgg

SEQ ID NO: 19735 - DNA, 23 bp, Homo sapiens
ttgagctgaggctggttagctgg

SEQ ID NO: 19736 - DNA, 23 bp, Homo sapiens
atgggattcaagaagactcctgg

SEQ ID NO: 19737 - DNA, 23 bp, Homo sapiens
ttcttctttttcttctgggacgg

SEQ ID NO: 19738 - DNA, 23 bp, Homo sapiens
tatgaagatgctgttcactctgg

SEQ ID NO: 19739 - DNA, 23 bp, Homo sapiens
ccctgtgcagagagacggggggg

SEQ ID NO: 19740 - DNA, 23 bp, Homo sapiens
caggacatggggccctgacctgg

SEQ ID NO: 19741 - DNA, 23 bp, Homo sapiens
ccaggcactggaaacaaaagtgg

SEQ ID NO: 19742 - DNA, 23 bp, Homo sapiens
gggtgcatacacgttaggatcgg

SEQ ID NO: 19743 - DNA, 23 bp, Homo sapiens
aaagcaaggtcagcctcatgagg

SEQ ID NO: 19744 - DNA, 23 bp, Homo sapiens
caatgaggaagccatggggaagg

SEQ ID NO: 19745 - DNA, 23 bp, Homo sapiens
ggggtccagcactatcagttagg

SEQ ID NO: 19746 - DNA, 23 bp, Homo sapiens
accatcagttcttttgtcttagg

SEQ ID NO: 19747 - DNA, 23 bp, Homo sapiens
aatggccctgagaactctgtggg

SEQ ID NO: 19748 - DNA, 23 bp, Homo sapiens
atcctacgtggcactggtcttgg

SEQ ID NO: 19749 - DNA, 23 bp, Homo sapiens
tatcacttttaggatcccagagg

SEQ ID NO: 19750 - DNA, 23 bp, Homo sapiens
ttctgcgttgtagcagcatttgg

SEQ ID NO: 19751 - DNA, 23 bp, Homo sapiens
gggctctactgcgagtgaggggg

SEQ ID NO: 19752 - DNA, 23 bp, Homo sapiens
aaacgggaagaagaagttaaagg

SEQ ID NO: 19753 - DNA, 23 bp, Homo sapiens
tcaaggttaccaggaaaactggg

SEQ ID NO: 19754 - DNA, 23 bp, Homo sapiens
ccaggtggttgtctaactatagg

SEQ ID NO: 19755 - DNA, 23 bp, Homo sapiens
atcctgtgcctcttactacttgg

SEQ ID NO: 19756 - DNA, 23 bp, Homo sapiens
agaagcaccattcttaagcatgg

SEQ ID NO: 19757 - DNA, 23 bp, Homo sapiens
actaccacttttatgctagttgg

SEQ ID NO: 19758 - DNA, 23 bp, Homo sapiens
tgattcatcactgctgaagtagg

SEQ ID NO: 19759 - DNA, 23 bp, Homo sapiens
agtgcctcaagattctcaggagg

SEQ ID NO: 19760 - DNA, 23 bp, Homo sapiens
gtgccctcctgagaatcttgagg

SEQ ID NO: 19761 - DNA, 23 bp, Homo sapiens
agatttcctagtgatcactgggg

SEQ ID NO: 19762 - DNA, 23 bp, Homo sapiens
ttgctgtttcctgtctcataagg

SEQ ID NO: 19763 - DNA, 23 bp, Homo sapiens
aatcactggtgctttgaactcgg

SEQ ID NO: 19764 - DNA, 23 bp, Homo sapiens
tctgcagcaggctgctgcctagg

SEQ ID NO: 19765 - DNA, 23 bp, Homo sapiens
cctgatcctttgagagctgacgg

SEQ ID NO: 19766 - DNA, 23 bp, Homo sapiens
gcagtaattgcatcaagatgagg

SEQ ID NO: 19767 - DNA, 23 bp, Homo sapiens
accccgggctcggaactaatagg

SEQ ID NO: 19768 - DNA, 23 bp, Homo sapiens
tgaaaaggatggaagcatgaggg

SEQ ID NO: 19769 - DNA, 23 bp, Homo sapiens
gaaaaggggtttggaggtgatgg

SEQ ID NO: 19770 - DNA, 23 bp, Homo sapiens
cgttgccagacaccgatacctgg

SEQ ID NO: 19771 - DNA, 23 bp, Homo sapiens
ctccacaaactggttgtgctcgg

SEQ ID NO: 19772 - DNA, 23 bp, Homo sapiens
agagtaagtagtcatcttcaagg

SEQ ID NO: 19773 - DNA, 23 bp, Homo sapiens
ccggaggaggcggagtgaggggg

SEQ ID NO: 19774 - DNA, 23 bp, Homo sapiens
ggagcctgcgcgcggcagggagg

SEQ ID NO: 19775 - DNA, 23 bp, Homo sapiens
acaagaaactctactctgcatgg

SEQ ID NO: 19776 - DNA, 23 bp, Homo sapiens
cgcctggtcagggactgaagggg

SEQ ID NO: 19777 - DNA, 23 bp, Homo sapiens
tacaagctcgtcaaagactaggg

SEQ ID NO: 19778 - DNA, 23 bp, Homo sapiens
tcagcaccacatctacaggctgg

SEQ ID NO: 19779 - DNA, 23 bp, Homo sapiens
cgcagcagatcttcgaaagaagg

SEQ ID NO: 19780 - DNA, 23 bp, Homo sapiens
catggccccgtctgctgctgagg

SEQ ID NO: 19781 - DNA, 23 bp, Homo sapiens
acgagtgggaggtcatctgaagg

SEQ ID NO: 19782 - DNA, 23 bp, Homo sapiens
ccaggtaagcagaagttagctgg

SEQ ID NO: 19783 - DNA, 23 bp, Homo sapiens
caggggtgagcgctcagagcagg

SEQ ID NO: 19784 - DNA, 23 bp, Homo sapiens
gagtatccagatgtctttgtggg

SEQ ID NO: 19785 - DNA, 23 bp, Homo sapiens
cttcaatggaacttcaagtctgg

SEQ ID NO: 19786 - DNA, 23 bp, Homo sapiens
ggggatttgtgccgtgttatagg

SEQ ID NO: 19787 - DNA, 23 bp, Homo sapiens
tcccgccacctggacgctgaggg

SEQ ID NO: 19788 - DNA, 23 bp, Homo sapiens
atgggaaaggctcagactgcagg

SEQ ID NO: 19789 - DNA, 23 bp, Homo sapiens
cactgtaggccctgtctcagggg

SEQ ID NO: 19790 - DNA, 23 bp, Homo sapiens
ggcggggggcacgggttacaagg

SEQ ID NO: 19791 - DNA, 23 bp, Homo sapiens
tctgatgggaagaacacccgagg

SEQ ID NO: 19792 - DNA, 23 bp, Homo sapiens
ttctgctgaagaagcggcctagg

SEQ ID NO: 19793 - DNA, 23 bp, Homo sapiens
tactattagcagacagcatcagg

SEQ ID NO: 19794 - DNA, 23 bp, Homo sapiens
caaaagctgccagctggagctgg

SEQ ID NO: 19795 - DNA, 23 bp, Homo sapiens
cggctggtcggcttctgctaggg

SEQ ID NO: 19796 - DNA, 23 bp, Homo sapiens
agcaccgtgccgctgctcactgg

SEQ ID NO: 19797 - DNA, 23 bp, Homo sapiens
gccagggcggtgctcaggtgtgg

SEQ ID NO: 19798 - DNA, 23 bp, Homo sapiens
ctccagggactagggagacgcgg

SEQ ID NO: 19799 - DNA, 23 bp, Homo sapiens
gctaggctgctgtttcctactgg

SEQ ID NO: 19800 - DNA, 23 bp, Homo sapiens
gacagagcgaaataggcaggagg

SEQ ID NO: 19801 - DNA, 23 bp, Homo sapiens
gacagaatgagatgggaaagagg

SEQ ID NO: 19802 - DNA, 23 bp, Homo sapiens
ggcagagcgagatcggcaggagg

SEQ ID NO: 19803 - DNA, 23 bp, Homo sapiens
ttggtcctctctgtcacctccgg

SEQ ID NO: 19804 - DNA, 23 bp, Homo sapiens
cttgccgtgggagacgtgcaggg

SEQ ID NO: 19805 - DNA, 23 bp, Homo sapiens
cctttccagagattaatgccagg

SEQ ID NO: 19806 - DNA, 23 bp, Homo sapiens
ggccatcgggtcaggcgttcagg

SEQ ID NO: 19807 - DNA, 23 bp, Homo sapiens
agctgcacacgtggggtgtttgg

SEQ ID NO: 19808 - DNA, 23 bp, Homo sapiens
tcctggaacctcaggatatttgg

SEQ ID NO: 19809 - DNA, 23 bp, Homo sapiens
caatcagtcttcgctgtctgagg

SEQ ID NO: 19810 - DNA, 23 bp, Homo sapiens
tggcggaccatgaaaagacttgg

SEQ ID NO: 19811 - DNA, 23 bp, Homo sapiens
gtgctcagaatgtagctcggagg

SEQ ID NO: 19812 - DNA, 23 bp, Homo sapiens
tcaagaccatcctggactgatgg

SEQ ID NO: 19813 - DNA, 23 bp, Homo sapiens
taagaagaggatgtcttaggagg

SEQ ID NO: 19814 - DNA, 23 bp, Homo sapiens
cggaggtggcggtgggtcagtgg

SEQ ID NO: 19815 - DNA, 23 bp, Homo sapiens
cactgctaagagcgtgccccagg

SEQ ID NO: 19816 - DNA, 23 bp, Homo sapiens
ggaaagcaggatgggtgaggggg

SEQ ID NO: 19817 - DNA, 23 bp, Homo sapiens
aaaataactttggctgggtaagg

SEQ ID NO: 19818 - DNA, 23 bp, Homo sapiens
tgatcctggaggaatttggaagg

SEQ ID NO: 19819 - DNA, 23 bp, Homo sapiens
caccaccaccagacttttgctgg

SEQ ID NO: 19820 - DNA, 23 bp, Homo sapiens
cctataaccattgggtctgaagg

SEQ ID NO: 19821 - DNA, 23 bp, Homo sapiens
atgccttcactcgggtcacaggg

SEQ ID NO: 19822 - DNA, 23 bp, Homo sapiens
cagaaatgtactgagacacatgg

SEQ ID NO: 19823 - DNA, 23 bp, Homo sapiens
cccctacagccgctggatctagg

SEQ ID NO: 19824 - DNA, 23 bp, Homo sapiens
ctggctacagtgtattgaagagg

SEQ ID NO: 19825 - DNA, 23 bp, Homo sapiens
ataaatgatggcagcagcaatgg

SEQ ID NO: 19826 - DNA, 23 bp, Homo sapiens
ctactggagcaagtcagattagg

SEQ ID NO: 19827 - DNA, 23 bp, Homo sapiens
aaagagagttcctgcgacagagg

SEQ ID NO: 19828 - DNA, 23 bp, Homo sapiens
ttgcatttctgcactcaatgagg

SEQ ID NO: 19829 - DNA, 23 bp, Homo sapiens
tgaccacaggctagcatcagagg

SEQ ID NO: 19830 - DNA, 23 bp, Homo sapiens
tgaaatcaatgagtttacgctgg

SEQ ID NO: 19831 - DNA, 23 bp, Homo sapiens
gagtgacttgtcagactgattgg

SEQ ID NO: 19832 - DNA, 23 bp, Homo sapiens
gaagactattttcagtgtcctgg

SEQ ID NO: 19833 - DNA, 23 bp, Homo sapiens
agcttctttccttcatagcaggg

SEQ ID NO: 19834 - DNA, 23 bp, Homo sapiens
ggctgctgatcagccatgatggg

SEQ ID NO: 19835 - DNA, 23 bp, Homo sapiens
gctgaatggggctcttaggaagg

SEQ ID NO: 19836 - DNA, 23 bp, Homo sapiens
ctttgtaggaaagactctgaagg

SEQ ID NO: 19837 - DNA, 23 bp, Homo sapiens
tcagtatatcttctgacgactgg

SEQ ID NO: 19838 - DNA, 23 bp, Homo sapiens
cactgcccctgagaagggcaagg

SEQ ID NO: 19839 - DNA, 23 bp, Homo sapiens
tccagcagatggaccttaagggg

SEQ ID NO: 19840 - DNA, 23 bp, Homo sapiens
aacagaagccgaagaaactgagg

SEQ ID NO: 19841 - DNA, 23 bp, Homo sapiens
attccatggcagtgaaaggacgg

SEQ ID NO: 19842 - DNA, 23 bp, Homo sapiens
tcaatccagtggattttatgggg

SEQ ID NO: 19843 - DNA, 23 bp, Homo sapiens
actgtgtcaaaactagtacttgg

SEQ ID NO: 19844 - DNA, 23 bp, Homo sapiens
actgtgcatcttaaggagcttgg

SEQ ID NO: 19845 - DNA, 23 bp, Homo sapiens
caaagtcccagactgagggaagg

SEQ ID NO: 19846 - DNA, 23 bp, Homo sapiens
cagtgggactgctggatctatgg

SEQ ID NO: 19847 - DNA, 23 bp, Homo sapiens
aaggttcactgttgacaaaaagg

SEQ ID NO: 19848 - DNA, 23 bp, Homo sapiens
cccaaagagctcacactgcaagg

SEQ ID NO: 19849 - DNA, 23 bp, Homo sapiens
atgccattttaccagtaggaagg

SEQ ID NO: 19850 - DNA, 23 bp, Homo sapiens
agaggaggctacagttctgaagg

SEQ ID NO: 19851 - DNA, 23 bp, Homo sapiens
tgatttcccatggcttcaggagg

SEQ ID NO: 19852 - DNA, 23 bp, Homo sapiens
tgcagggctctaatcatagttgg

SEQ ID NO: 19853 - DNA, 23 bp, Homo sapiens
gccaagatggcatttattgctgg

SEQ ID NO: 19854 - DNA, 23 bp, Homo sapiens
tcgagttcccccagctaatgagg

SEQ ID NO: 19855 - DNA, 23 bp, Homo sapiens
gcctgctccttcacgtttctagg

SEQ ID NO: 19856 - DNA, 23 bp, Homo sapiens
tccagccatgcctcactgggagg

SEQ ID NO: 19857 - DNA, 23 bp, Homo sapiens
atcactctattctcaatgacagg

SEQ ID NO: 19858 - DNA, 23 bp, Homo sapiens
tatacaagatctgggagcacagg

SEQ ID NO: 19859 - DNA, 23 bp, Homo sapiens
aaggaagaaggaggcagtaaagg

SEQ ID NO: 19860 - DNA, 23 bp, Homo sapiens
gatgctatctttcactgaggagg

SEQ ID NO: 19861 - DNA, 23 bp, Homo sapiens
ttaaggtctacggaaagtgcagg

SEQ ID NO: 19862 - DNA, 23 bp, Homo sapiens
acaacgaaaatatggtgctgagg

SEQ ID NO: 19863 - DNA, 23 bp, Homo sapiens
gaggagaagcacagaaagtgagg

SEQ ID NO: 19864 - DNA, 23 bp, Homo sapiens
gcgacaaggaggagaaacacagg

SEQ ID NO: 19865 - DNA, 23 bp, Homo sapiens
tggagaaaatggagaaacacagg

SEQ ID NO: 19866 - DNA, 23 bp, Homo sapiens
tcagaggctgccgtgaaagaggg

SEQ ID NO: 19867 - DNA, 23 bp, Homo sapiens
aagcagttatttccgatgcttgg

SEQ ID NO: 19868 - DNA, 23 bp, Homo sapiens
ggaggagccgtcgggggacgggg

SEQ ID NO: 19869 - DNA, 23 bp, Homo sapiens
gaaggaaatactgccatcgaggg

SEQ ID NO: 19870 - DNA, 23 bp, Homo sapiens
gaggctcttaaagtgtgagatgg

SEQ ID NO: 19871 - DNA, 23 bp, Homo sapiens
ctagttgctacctatcttccagg

SEQ ID NO: 19872 - DNA, 23 bp, Homo sapiens
atgagcacatgaattcctgttgg

SEQ ID NO: 19873 - DNA, 23 bp, Homo sapiens
taccacatcatcctgaaatgtgg

SEQ ID NO: 19874 - DNA, 23 bp, Homo sapiens
tgacttcaacgagaatgacgagg

SEQ ID NO: 19875 - DNA, 23 bp, Homo sapiens
ctcttgtctttattctggggagg

SEQ ID NO: 19876 - DNA, 23 bp, Homo sapiens
cgacctcagtgagaatgacgagg

SEQ ID NO: 19877 - DNA, 23 bp, Homo sapiens
atggaagaggagtcctgatcagg

SEQ ID NO: 19878 - DNA, 23 bp, Homo sapiens
agcagcttcagcatggaggaggg

SEQ ID NO: 19879 - DNA, 23 bp, Homo sapiens
agtagctttagctcagatgatgg

SEQ ID NO: 19880 - DNA, 23 bp, Homo sapiens
ggagggacgtcgatggtattagg

SEQ ID NO: 19881 - DNA, 23 bp, Homo sapiens
gaaccagcctctcttagtaatgg

SEQ ID NO: 19882 - DNA, 23 bp, Homo sapiens
gcagctggaggtgcctcagaagg

SEQ ID NO: 19883 - DNA, 23 bp, Homo sapiens
ggacctggttatcgataaggagg

SEQ ID NO: 19884 - DNA, 23 bp, Homo sapiens
tggacctgccacagttcacttgg

SEQ ID NO: 19885 - DNA, 23 bp, Homo sapiens
atccatgttctttctaggattgg

SEQ ID NO: 19886 - DNA, 23 bp, Homo sapiens
ggcctccttttgatattctttgg

SEQ ID NO: 19887 - DNA, 23 bp, Homo sapiens
caataactttgttagcagggagg

SEQ ID NO: 19888 - DNA, 23 bp, Homo sapiens
ccagtagaatccggaaaattcgg

SEQ ID NO: 19889 - DNA, 23 bp, Homo sapiens
attgggcatgcgtcagtcagagg

SEQ ID NO: 19890 - DNA, 23 bp, Homo sapiens
atgcgcttagcggggatgtctgg

SEQ ID NO: 19891 - DNA, 23 bp, Homo sapiens
tgccctctctggtgacgtttggg

SEQ ID NO: 19892 - DNA, 23 bp, Homo sapiens
aagggctggtcacttgctgtagg

SEQ ID NO: 19893 - DNA, 23 bp, Homo sapiens
aaatggtgattataccggaaagg

SEQ ID NO: 19894 - DNA, 23 bp, Homo sapiens
tgtttctgagtggcagcaagcgg

SEQ ID NO: 19895 - DNA, 23 bp, Homo sapiens
cgctcctgcaagtgcagctgagg

SEQ ID NO: 19896 - DNA, 23 bp, Homo sapiens
ccctgcttcctgaagctcttcgg

SEQ ID NO: 19897 - DNA, 23 bp, Homo sapiens
tttgccaatgtagtagagaatgg

SEQ ID NO: 19898 - DNA, 23 bp, Homo sapiens
ccatgtgggcccagtctcaccgg

SEQ ID NO: 19899 - DNA, 23 bp, Homo sapiens
ggagcagctctccaacatggtgg

SEQ ID NO: 19900 - DNA, 23 bp, Homo sapiens
acaagcatcagcgttttccaggg

SEQ ID NO: 19901 - DNA, 23 bp, Homo sapiens
tcgcaactcagtcaacaggaagg

SEQ ID NO: 19902 - DNA, 23 bp, Homo sapiens
cctgccccagaagagctatttgg

SEQ ID NO: 19903 - DNA, 23 bp, Homo sapiens
gccttgctccagcagcagcacgg

SEQ ID NO: 19904 - DNA, 23 bp, Homo sapiens
cagcccaggaggtcccagtgagg

SEQ ID NO: 19905 - DNA, 23 bp, Homo sapiens
agcagcagagagaacggagatgg

SEQ ID NO: 19906 - DNA, 23 bp, Homo sapiens
gctcatccagtcctggcactcgg

SEQ ID NO: 19907 - DNA, 23 bp, Homo sapiens
ggctgcagagatggagcttcagg

SEQ ID NO: 19908 - DNA, 23 bp, Homo sapiens
ccttcttggcagatgcctactgg

SEQ ID NO: 19909 - DNA, 23 bp, Homo sapiens
cttcttctctagctccagctcgg

SEQ ID NO: 19910 - DNA, 23 bp, Homo sapiens
tttctttggctgggctattccgg

SEQ ID NO: 19911 - DNA, 23 bp, Homo sapiens
atccctatggcatctcgaggtgg

SEQ ID NO: 19912 - DNA, 23 bp, Homo sapiens
gggagcaggggtcccttaggcgg

SEQ ID NO: 19913 - DNA, 23 bp, Homo sapiens
tggcggtcaacaaatgctccagg

SEQ ID NO: 19914 - DNA, 23 bp, Homo sapiens
catcgatgtagccgaatgaaggg

SEQ ID NO: 19915 - DNA, 23 bp, Homo sapiens
cagcatcagacaaggctacttgg

SEQ ID NO: 19916 - DNA, 23 bp, Homo sapiens
ttaaggacattaagggttacagg

SEQ ID NO: 19917 - DNA, 23 bp, Homo sapiens
gtccctcatgatccatcacttgg

SEQ ID NO: 19918 - DNA, 23 bp, Homo sapiens
tggagggggtgatgtcaaactgg

SEQ ID NO: 19919 - DNA, 23 bp, Homo sapiens
catcttcgtcactgtggctgggg

SEQ ID NO: 19920 - DNA, 23 bp, Homo sapiens
acgagagcagcacaatccattgg

SEQ ID NO: 19921 - DNA, 23 bp, Homo sapiens
ggccagtgactaccaacgtttgg

SEQ ID NO: 19922 - DNA, 23 bp, Homo sapiens
tgacgttcatctttttccagagg

SEQ ID NO: 19923 - DNA, 23 bp, Homo sapiens
aagaaatgctgatattgaccagg

SEQ ID NO: 19924 - DNA, 23 bp, Homo sapiens
gctgcatagttaggtttcagagg

SEQ ID NO: 19925 - DNA, 23 bp, Homo sapiens
tgcgctgagtgccattggctagg

SEQ ID NO: 19926 - DNA, 23 bp, Homo sapiens
aactcttccaagaacagaagcgg

SEQ ID NO: 19927 - DNA, 23 bp, Homo sapiens
gggcgagtccactgtataacagg

SEQ ID NO: 19928 - DNA, 23 bp, Homo sapiens
ggtggaaaggaacacattaatgg

SEQ ID NO: 19929 - DNA, 23 bp, Homo sapiens
aaagacgacgtatcagaaagagg

SEQ ID NO: 19930 - DNA, 23 bp, Homo sapiens
tttgtcttatatggctgtacagg

SEQ ID NO: 19931 - DNA, 23 bp, Homo sapiens
aagaagcacggaatgtgaactgg

SEQ ID NO: 19932 - DNA, 23 bp, Homo sapiens
tacagataattccgaaactgtgg

SEQ ID NO: 19933 - DNA, 23 bp, Homo sapiens
tgccttaagcagtcttcctttgg

SEQ ID NO: 19934 - DNA, 23 bp, Homo sapiens
ggggctcagctctgctgctctgg

SEQ ID NO: 19935 - DNA, 23 bp, Homo sapiens
tgtggttgagtgaggagtgaagg

SEQ ID NO: 19936 - DNA, 23 bp, Homo sapiens
tccagaagctctaggtttacggg

SEQ ID NO: 19937 - DNA, 23 bp, Homo sapiens
ggcagctaaagcaggaaaactgg

SEQ ID NO: 19938 - DNA, 23 bp, Homo sapiens
ttgtcaggagagcatagaacagg

SEQ ID NO: 19939 - DNA, 23 bp, Homo sapiens
gagcagcagcatggcctgagggg

SEQ ID NO: 19940 - DNA, 23 bp, Homo sapiens
actcggatccccagtgcataagg

SEQ ID NO: 19941 - DNA, 23 bp, Homo sapiens
aggcatttgctaagtaacgatgg

SEQ ID NO: 19942 - DNA, 23 bp, Homo sapiens
gacgccgcagagactctgagcgg

SEQ ID NO: 19943 - DNA, 23 bp, Homo sapiens
cctatgctggtggtagactaggg

SEQ ID NO: 19944 - DNA, 23 bp, Homo sapiens
acctacgctggcgggcggctggg

SEQ ID NO: 19945 - DNA, 23 bp, Homo sapiens
ctccagggaagggtgtgaggagg

SEQ ID NO: 19946 - DNA, 23 bp, Homo sapiens
tatcgaagcggtcgaaattctgg

SEQ ID NO: 19947 - DNA, 23 bp, Homo sapiens
actgggagcggaggtcttagagg

SEQ ID NO: 19948 - DNA, 23 bp, Homo sapiens
tctacatcctacacggttttagg

SEQ ID NO: 19949 - DNA, 23 bp, Homo sapiens
acagtgttctcaaaggatctggg

SEQ ID NO: 19950 - DNA, 23 bp, Homo sapiens
tgagaagaccctatactcagagg

SEQ ID NO: 19951 - DNA, 23 bp, Homo sapiens
gcaggcacagtgactgttactgg

SEQ ID NO: 19952 - DNA, 23 bp, Homo sapiens
ggtgtgaaggtggcggtcactgg

SEQ ID NO: 19953 - DNA, 23 bp, Homo sapiens
ctgctattgctgtggccccacgg

SEQ ID NO: 19954 - DNA, 23 bp, Homo sapiens
tggttcctccagcacttagatgg

SEQ ID NO: 19955 - DNA, 23 bp, Homo sapiens
atcctgcctttggggcttagcgg

SEQ ID NO: 19956 - DNA, 23 bp, Homo sapiens
ctgtcttcatctagaatctctgg

SEQ ID NO: 19957 - DNA, 23 bp, Homo sapiens
gaatgtcttgaagagtcatgtgg

SEQ ID NO: 19958 - DNA, 23 bp, Homo sapiens
ctcaacacctcccagtagcctgg

SEQ ID NO: 19959 - DNA, 23 bp, Homo sapiens
gatctccgcgggagtctcagggg

SEQ ID NO: 19960 - DNA, 23 bp, Homo sapiens
gtcagaggtggtggctgagctgg

SEQ ID NO: 19961 - DNA, 23 bp, Homo sapiens
agtgcattaatcagattctcagg

SEQ ID NO: 19962 - DNA, 23 bp, Homo sapiens
tcattatctgtgcttgtccgagg

SEQ ID NO: 19963 - DNA, 23 bp, Homo sapiens
gcttcctaatgattcttgagagg

SEQ ID NO: 19964 - DNA, 23 bp, Homo sapiens
tctgcgcgggagatcagcgatgg

SEQ ID NO: 19965 - DNA, 23 bp, Homo sapiens
gggtgtcgtcagagatcagaagg

SEQ ID NO: 19966 - DNA, 23 bp, Homo sapiens
acagatcctaagccatagacagg

SEQ ID NO: 19967 - DNA, 23 bp, Homo sapiens
cccgagccgcaggtctgctgagg

SEQ ID NO: 19968 - DNA, 23 bp, Homo sapiens
aatctgtctcaggaagggtaagg

SEQ ID NO: 19969 - DNA, 23 bp, Homo sapiens
gagcagaagggtcaggaagcagg

SEQ ID NO: 19970 - DNA, 23 bp, Homo sapiens
cctcgaggtctttgaggatcagg

SEQ ID NO: 19971 - DNA, 23 bp, Homo sapiens
ttctggggggcttcagggagagg

SEQ ID NO: 19972 - DNA, 23 bp, Homo sapiens
cgtcaagggtggcccctactcgg

SEQ ID NO: 19973 - DNA, 23 bp, Homo sapiens
tttgttcttggaagtgttcgagg

SEQ ID NO: 19974 - DNA, 23 bp, Homo sapiens
aggaaatgacgggacaagtttgg

SEQ ID NO: 19975 - DNA, 23 bp, Homo sapiens
tacacttagcgtggagaagctgg

SEQ ID NO: 19976 - DNA, 23 bp, Homo sapiens
aggagtgttatctgctccccagg

SEQ ID NO: 19977 - DNA, 23 bp, Homo sapiens
catgtcggcatctccatcatagg

SEQ ID NO: 19978 - DNA, 23 bp, Homo sapiens
catgtctaagtctccatcgtagg

SEQ ID NO: 19979 - DNA, 23 bp, Homo sapiens
ctgaccactgcctgggctagggg

SEQ ID NO: 19980 - DNA, 23 bp, Homo sapiens
ctgtagatacacaatcagcttgg

SEQ ID NO: 19981 - DNA, 23 bp, Homo sapiens
atttgacttggatccttctgtgg

SEQ ID NO: 19982 - DNA, 23 bp, Homo sapiens
ctagactgcaaatgcacatgagg

SEQ ID NO: 19983 - DNA, 23 bp, Homo sapiens
gcactcttctggactgtagcagg

SEQ ID NO: 19984 - DNA, 23 bp, Homo sapiens
tcaacactttctgaaggcaatgg

SEQ ID NO: 19985 - DNA, 23 bp, Homo sapiens
ttggatggaaagcagacttgagg

SEQ ID NO: 19986 - DNA, 23 bp, Homo sapiens
acggagaaagaggaactctttgg

SEQ ID NO: 19987 - DNA, 23 bp, Homo sapiens
ccatgggccccaccagtcacagg

SEQ ID NO: 19988 - DNA, 23 bp, Homo sapiens
gcaaagaggacaaccctaagtgg

SEQ ID NO: 19989 - DNA, 23 bp, Homo sapiens
cagcagtatctcagttaacttgg

SEQ ID NO: 19990 - DNA, 23 bp, Homo sapiens
accgtagcttgtagttagccagg

SEQ ID NO: 19991 - DNA, 23 bp, Homo sapiens
aggatattcatttgttcggtagg

SEQ ID NO: 19992 - DNA, 23 bp, Homo sapiens
attctggagtccttattcactgg

SEQ ID NO: 19993 - DNA, 23 bp, Homo sapiens
tgagatcaccaacaaagacatgg

SEQ ID NO: 19994 - DNA, 23 bp, Homo sapiens
tgagctcagtgagaagtgcatgg

SEQ ID NO: 19995 - DNA, 23 bp, Homo sapiens
ttggagaagaaaaggaaatgtgg

SEQ ID NO: 19996 - DNA, 23 bp, Homo sapiens
agagggaaggcttggggttgagg

SEQ ID NO: 19997 - DNA, 23 bp, Homo sapiens
agttaccaaacacagtgagccgg

SEQ ID NO: 19998 - DNA, 23 bp, Homo sapiens
gatctcagtgttcagtttcctgg

SEQ ID NO: 19999 - DNA, 23 bp, Homo sapiens
ttttatgaaacagagagccacgg

SEQ ID NO: 20000 - DNA, 23 bp, Homo sapiens
gcccgaggacaagacgcaggagg

SEQ ID NO: 20001 - DNA, 23 bp, Homo sapiens
gccttagaggaagaaagtcgtgg

SEQ ID NO: 20002 - DNA, 23 bp, Homo sapiens
gctcatgggaacctggctggagg

SEQ ID NO: 20003 - DNA, 23 bp, Homo sapiens
cattgatgccacagctgaggagg

SEQ ID NO: 20004 - DNA, 23 bp, Homo sapiens
aagcagttctccgacagaaatgg

SEQ ID NO: 20005 - DNA, 23 bp, Homo sapiens
ggcagcctccccctggttcaggg

SEQ ID NO: 20006 - DNA, 23 bp, Homo sapiens
ggactgactgaaactcgctaagg

SEQ ID NO: 20007 - DNA, 23 bp, Homo sapiens
tgattatcaatctgagccttcgg

SEQ ID NO: 20008 - DNA, 23 bp, Homo sapiens
aattggtattaaggaggcttcgg

SEQ ID NO: 20009 - DNA, 23 bp, Homo sapiens
agcagtgaaggcgccttcatagg

SEQ ID NO: 20010 - DNA, 23 bp, Homo sapiens
ccctttaccatcaaaatctgagg

SEQ ID NO: 20011 - DNA, 23 bp, Homo sapiens
ccctatgacggtgtgtgaccagg

SEQ ID NO: 20012 - DNA, 23 bp, Homo sapiens
tcctgcattattttgtttggagg

SEQ ID NO: 20013 - DNA, 23 bp, Homo sapiens
ttcagtgggccttcaacttctgg

SEQ ID NO: 20014 - DNA, 23 bp, Homo sapiens
tgcagcttcttcacagagactgg

SEQ ID NO: 20015 - DNA, 23 bp, Homo sapiens
acatgctactgcgttgttagagg

SEQ ID NO: 20016 - DNA, 23 bp, Homo sapiens
ataccagattgaggatgatgagg

SEQ ID NO: 20017 - DNA, 23 bp, Homo sapiens
tactgacagggacctcatgcagg

SEQ ID NO: 20018 - DNA, 23 bp, Homo sapiens
tccgaggaagagaaactgaaggg

SEQ ID NO: 20019 - DNA, 23 bp, Homo sapiens
ggaacgagccaacatgtgaccgg

SEQ ID NO: 20020 - DNA, 23 bp, Homo sapiens
agactatcgacaatatcagtagg

SEQ ID NO: 20021 - DNA, 23 bp, Homo sapiens
ggtggcagtggcttcctcagtgg

SEQ ID NO: 20022 - DNA, 23 bp, Homo sapiens
aaatcatattcaccacttcctgg

SEQ ID NO: 20023 - DNA, 23 bp, Homo sapiens
ctgcaggcaattactctcaccgg

SEQ ID NO: 20024 - DNA, 23 bp, Homo sapiens
aaaatcttcagagtgactgttgg

SEQ ID NO: 20025 - DNA, 23 bp, Homo sapiens
ccgttctgtgtgctgctgtctgg

SEQ ID NO: 20026 - DNA, 23 bp, Homo sapiens
ggggcctcagggtttcatctcgg

SEQ ID NO: 20027 - DNA, 23 bp, Homo sapiens
ccacactcagagaatctgctcgg

SEQ ID NO: 20028 - DNA, 23 bp, Homo sapiens
gcccagagttcagggctgtttgg

SEQ ID NO: 20029 - DNA, 23 bp, Homo sapiens
gcgtcctcttgcatcctgagtgg

SEQ ID NO: 20030 - DNA, 23 bp, Homo sapiens
aatgctgagatcagtcagaaagg

SEQ ID NO: 20031 - DNA, 23 bp, Homo sapiens
ctcccatccggctaggccacagg

SEQ ID NO: 20032 - DNA, 23 bp, Homo sapiens
tgtacagaaaggagggcagtagg

SEQ ID NO: 20033 - DNA, 23 bp, Homo sapiens
ccatcaggacttctctatcgtgg

SEQ ID NO: 20034 - DNA, 23 bp, Homo sapiens
tctattactgaagggtttctagg

SEQ ID NO: 20035 - DNA, 23 bp, Homo sapiens
cgggcaggattcaggctatctgg

SEQ ID NO: 20036 - DNA, 23 bp, Homo sapiens
gacatcgaggacccataagcagg

SEQ ID NO: 20037 - DNA, 23 bp, Homo sapiens
gggcagggtctggcgctcagggg

SEQ ID NO: 20038 - DNA, 23 bp, Homo sapiens
gacatcgttcagccctagtaggg

SEQ ID NO: 20039 - DNA, 23 bp, Homo sapiens
gttcatcagaactcgtcagttgg

SEQ ID NO: 20040 - DNA, 23 bp, Homo sapiens
gaggacatgggtcatcactgagg

SEQ ID NO: 20041 - DNA, 23 bp, Homo sapiens
agaactgtctctacagtcacagg

SEQ ID NO: 20042 - DNA, 23 bp, Homo sapiens
cacagagcaaaaggagtgagtgg

SEQ ID NO: 20043 - DNA, 23 bp, Homo sapiens
tgacctttatgactcttgtgtgg

SEQ ID NO: 20044 - DNA, 23 bp, Homo sapiens
aaatgaagaggaaacactgctgg

SEQ ID NO: 20045 - DNA, 23 bp, Homo sapiens
gaggatgaacttcatgatcatgg

SEQ ID NO: 20046 - DNA, 23 bp, Homo sapiens
gtacttttttgtgagtctgctgg

SEQ ID NO: 20047 - DNA, 23 bp, Homo sapiens
acaggagggagaaggggaacggg

SEQ ID NO: 20048 - DNA, 23 bp, Homo sapiens
acttgacgaaagccaccatcagg

SEQ ID NO: 20049 - DNA, 23 bp, Homo sapiens
cagggcaacctgctcaactaggg

SEQ ID NO: 20050 - DNA, 23 bp, Homo sapiens
ggagatccaaattatctcgttgg

SEQ ID NO: 20051 - DNA, 23 bp, Homo sapiens
acatctataattctgtgtcccgg

SEQ ID NO: 20052 - DNA, 23 bp, Homo sapiens
ggcagccttcgagaggtcacagg

SEQ ID NO: 20053 - DNA, 23 bp, Homo sapiens
gccctcgcaggtccctcagttgg

SEQ ID NO: 20054 - DNA, 23 bp, Homo sapiens
atagaccttttgcctcctatggg

SEQ ID NO: 20055 - DNA, 23 bp, Homo sapiens
ccccatggcagcccctgttctgg

SEQ ID NO: 20056 - DNA, 23 bp, Homo sapiens
gggtgtgggagcaggttcaaggg

SEQ ID NO: 20057 - DNA, 23 bp, Homo sapiens
tcttcagtttgtgagtgcagtgg

SEQ ID NO: 20058 - DNA, 23 bp, Homo sapiens
ttggaggtcttgcagagctaggg

SEQ ID NO: 20059 - DNA, 23 bp, Homo sapiens
ttggtcacacatagcacagtcgg

SEQ ID NO: 20060 - DNA, 23 bp, Homo sapiens
ctcatcaccaaggcctagggcgg

SEQ ID NO: 20061 - DNA, 23 bp, Homo sapiens
gttcagcaacatgcatttcacgg

SEQ ID NO: 20062 - DNA, 23 bp, Homo sapiens
tacggctgctataatgtgtctgg

SEQ ID NO: 20063 - DNA, 23 bp, Homo sapiens
caagttcttgactgagtgagggg

SEQ ID NO: 20064 - DNA, 23 bp, Homo sapiens
tggcttctctctagtctttcagg

SEQ ID NO: 20065 - DNA, 23 bp, Homo sapiens
gaagtcccggacgatgaatgagg

SEQ ID NO: 20066 - DNA, 23 bp, Homo sapiens
gcatccaggagctggaggcttgg

SEQ ID NO: 20067 - DNA, 23 bp, Homo sapiens
cactggctcgggggacaagaagg

SEQ ID NO: 20068 - DNA, 23 bp, Homo sapiens
gaaggccaccgtgtatgaggtgg

SEQ ID NO: 20069 - DNA, 23 bp, Homo sapiens
ttctggagatgtcacaactcagg

SEQ ID NO: 20070 - DNA, 23 bp, Homo sapiens
caagaaggccacagtttatgagg

SEQ ID NO: 20071 - DNA, 23 bp, Homo sapiens
cactggctctggggataagaagg

SEQ ID NO: 20072 - DNA, 23 bp, Homo sapiens
gtaccagatcacctactgagggg

SEQ ID NO: 20073 - DNA, 23 bp, Homo sapiens
atgcttgaagaagggggtgtagg

SEQ ID NO: 20074 - DNA, 23 bp, Homo sapiens
actgttattggacgccccagagg

SEQ ID NO: 20075 - DNA, 23 bp, Homo sapiens
ttctgtgaccccaggggagaagg

SEQ ID NO: 20076 - DNA, 23 bp, Homo sapiens
tttttggtatgtgtggtatctgg

SEQ ID NO: 20077 - DNA, 23 bp, Homo sapiens
agcactatttcttcatgtgcagg

SEQ ID NO: 20078 - DNA, 23 bp, Homo sapiens
tgctcatctcgaagctctgaagg

SEQ ID NO: 20079 - DNA, 23 bp, Homo sapiens
tgagggaagatgagggctaaagg

SEQ ID NO: 20080 - DNA, 23 bp, Homo sapiens
ggggtgctaattcacagaattgg

SEQ ID NO: 20081 - DNA, 23 bp, Homo sapiens
gccttttttgggctaacttaagg

SEQ ID NO: 20082 - DNA, 23 bp, Homo sapiens
gagttaaatgaagagtctcgagg

SEQ ID NO: 20083 - DNA, 23 bp, Homo sapiens
gagagctgcgataaagtcctagg

SEQ ID NO: 20084 - DNA, 23 bp, Homo sapiens
ccagttcagaaagaacggatagg

SEQ ID NO: 20085 - DNA, 23 bp, Homo sapiens
gaagcaacatctatctgaagagg

SEQ ID NO: 20086 - DNA, 23 bp, Homo sapiens
ttgctcctttgattaggagatgg

SEQ ID NO: 20087 - DNA, 23 bp, Homo sapiens
aagcaaacgtgggctcttttggg

SEQ ID NO: 20088 - DNA, 23 bp, Homo sapiens
tagtcaggtgttcaaggaaacgg

SEQ ID NO: 20089 - DNA, 23 bp, Homo sapiens
ttggcaaactctgagaaatgtgg

SEQ ID NO: 20090 - DNA, 23 bp, Homo sapiens
gattccggctcacggctattcgg

SEQ ID NO: 20091 - DNA, 23 bp, Homo sapiens
agaaccggcggacaaagtggagg

SEQ ID NO: 20092 - DNA, 23 bp, Homo sapiens
gaatgggcaggctcactcgcagg

SEQ ID NO: 20093 - DNA, 23 bp, Homo sapiens
gggcgtcgctcacaccaccgagg

SEQ ID NO: 20094 - DNA, 23 bp, Homo sapiens
cgcgctggtgggctcacaccagg

SEQ ID NO: 20095 - DNA, 23 bp, Homo sapiens
aatactcagtcttgtaagtctgg

SEQ ID NO: 20096 - DNA, 23 bp, Homo sapiens
tgccaagtgatggcagcaactgg

SEQ ID NO: 20097 - DNA, 23 bp, Homo sapiens
atgtacaaagagccatctgctgg

SEQ ID NO: 20098 - DNA, 23 bp, Homo sapiens
cttcatgttcagctcactgttgg

SEQ ID NO: 20099 - DNA, 23 bp, Homo sapiens
ggagtgcttggaggcatatgtgg

SEQ ID NO: 20100 - DNA, 23 bp, Homo sapiens
caactatccaagatactgtgtgg

SEQ ID NO: 20101 - DNA, 23 bp, Homo sapiens
cagcctctgcgagaagtgacagg

SEQ ID NO: 20102 - DNA, 23 bp, Homo sapiens
attactccagggatacctaaagg

SEQ ID NO: 20103 - DNA, 23 bp, Homo sapiens
ggtttccttggctgtctgtgtgg

SEQ ID NO: 20104 - DNA, 23 bp, Homo sapiens
gctcatctcggaggtttaaacgg

SEQ ID NO: 20105 - DNA, 23 bp, Homo sapiens
cggtcagtggagcctcagtgagg

SEQ ID NO: 20106 - DNA, 23 bp, Homo sapiens
aacaaaggcagaagaaaaagtgg

SEQ ID NO: 20107 - DNA, 23 bp, Homo sapiens
caatgtgatgtcaggcatccagg

SEQ ID NO: 20108 - DNA, 23 bp, Homo sapiens
cactctccagcaaggcacggtgg

SEQ ID NO: 20109 - DNA, 23 bp, Homo sapiens
tctctcaatgctgcttcttgtgg

SEQ ID NO: 20110 - DNA, 23 bp, Homo sapiens
atgccctacatctactgaagcgg

SEQ ID NO: 20111 - DNA, 23 bp, Homo sapiens
ctgggcatctacagaagcaaagg

SEQ ID NO: 20112 - DNA, 23 bp, Homo sapiens
acagaactcagtccatcttgagg

SEQ ID NO: 20113 - DNA, 23 bp, Homo sapiens
attccatggctattactgtcagg

SEQ ID NO: 20114 - DNA, 23 bp, Homo sapiens
ttggcttctttgcatgcttttgg

SEQ ID NO: 20115 - DNA, 23 bp, Homo sapiens
acagccttggggataatgtgtgg

SEQ ID NO: 20116 - DNA, 23 bp, Homo sapiens
tgctgtgaagatagactgattgg

SEQ ID NO: 20117 - DNA, 23 bp, Homo sapiens
agatgaggaaatgactgcagtgg

SEQ ID NO: 20118 - DNA, 23 bp, Homo sapiens
acaggtggaattaagaaatctgg

SEQ ID NO: 20119 - DNA, 23 bp, Homo sapiens
gccgcggggaaggggcccttggg

SEQ ID NO: 20120 - DNA, 23 bp, Homo sapiens
ctgatgggggatcgcaattaagg

SEQ ID NO: 20121 - DNA, 23 bp, Homo sapiens
gaattgtgctcctggtgactggg

SEQ ID NO: 20122 - DNA, 23 bp, Homo sapiens
atttcagcaaatttggagcaggg

SEQ ID NO: 20123 - DNA, 23 bp, Homo sapiens
cctgcacctgttacggtttctgg

SEQ ID NO: 20124 - DNA, 23 bp, Homo sapiens
gatcctggccatgaatgaaaagg

SEQ ID NO: 20125 - DNA, 23 bp, Homo sapiens
gctctcaggatacttattactgg

SEQ ID NO: 20126 - DNA, 23 bp, Homo sapiens
cctggagtcctagccatcagtgg

SEQ ID NO: 20127 - DNA, 23 bp, Homo sapiens
gcaggagctgaccgtggatctgg

SEQ ID NO: 20128 - DNA, 23 bp, Homo sapiens
ggctgcgggggtcaaagagccgg

SEQ ID NO: 20129 - DNA, 23 bp, Homo sapiens
caaaagagtcatcaggcccttgg

SEQ ID NO: 20130 - DNA, 23 bp, Homo sapiens
agatgaacaggatgcctaggggg

SEQ ID NO: 20131 - DNA, 23 bp, Homo sapiens
cagaagcccaaagggacatgagg

SEQ ID NO: 20132 - DNA, 23 bp, Homo sapiens
tgaattaatgaagctggacgcgg

SEQ ID NO: 20133 - DNA, 23 bp, Homo sapiens
attccgcttccccagcggcgcgg

SEQ ID NO: 20134 - DNA, 23 bp, Homo sapiens
cttctgtgccagcatcatctagg

SEQ ID NO: 20135 - DNA, 23 bp, Homo sapiens
cgtgttgctgcccagctgagtgg

SEQ ID NO: 20136 - DNA, 23 bp, Homo sapiens
aggaaccagtggcttcatcttgg

SEQ ID NO: 20137 - DNA, 23 bp, Homo sapiens
gttcaagagaacttcccagaagg

SEQ ID NO: 20138 - DNA, 23 bp, Homo sapiens
ggagtccatcacatttcaaatgg

SEQ ID NO: 20139 - DNA, 23 bp, Homo sapiens
aggcagatattcccaagatcagg

SEQ ID NO: 20140 - DNA, 23 bp, Homo sapiens
catcatctccgagccatcagagg

SEQ ID NO: 20141 - DNA, 23 bp, Homo sapiens
ctctgatggctcggagatgatgg

SEQ ID NO: 20142 - DNA, 23 bp, Homo sapiens
ccagggccccagcacggggctgg

SEQ ID NO: 20143 - DNA, 23 bp, Homo sapiens
tgcaggtaaaaacctagcccagg

SEQ ID NO: 20144 - DNA, 23 bp, Homo sapiens
gcagccatcttgccactaaaagg

SEQ ID NO: 20145 - DNA, 23 bp, Homo sapiens
tatttcttagggaatcagtgggg

SEQ ID NO: 20146 - DNA, 23 bp, Homo sapiens
tccagcagacagctcttcaaggg

SEQ ID NO: 20147 - DNA, 23 bp, Homo sapiens
cttccatggcaggggctacgtgg

SEQ ID NO: 20148 - DNA, 23 bp, Homo sapiens
ctacctgcgacgcttcttcaagg

SEQ ID NO: 20149 - DNA, 23 bp, Homo sapiens
aggctttttaaacaactctccgg

SEQ ID NO: 20150 - DNA, 23 bp, Homo sapiens
atcccagatggtgatcacactgg

SEQ ID NO: 20151 - DNA, 23 bp, Homo sapiens
caggatgccggggctaggagtgg

SEQ ID NO: 20152 - DNA, 23 bp, Homo sapiens
cccgctgaaaatctgttaggagg

SEQ ID NO: 20153 - DNA, 23 bp, Homo sapiens
aactgccctctcaaattacaagg

SEQ ID NO: 20154 - DNA, 23 bp, Homo sapiens
ccgcagcctcccaaagtgttggg

SEQ ID NO: 20155 - DNA, 23 bp, Homo sapiens
cttctttgaggccaagaagctgg

SEQ ID NO: 20156 - DNA, 23 bp, Homo sapiens
agagtctgtttgaagataagagg

SEQ ID NO: 20157 - DNA, 23 bp, Homo sapiens
agtccagactaagcaaaagtggg

SEQ ID NO: 20158 - DNA, 23 bp, Homo sapiens
gtcaccttagcttagcatcttgg

SEQ ID NO: 20159 - DNA, 23 bp, Homo sapiens
agaaccaccacaactcgtgttgg

SEQ ID NO: 20160 - DNA, 23 bp, Homo sapiens
tgtcccagcagtccttcagctgg

SEQ ID NO: 20161 - DNA, 23 bp, Homo sapiens
ggacagctacacaagcttcttgg

SEQ ID NO: 20162 - DNA, 23 bp, Homo sapiens
ttcagatacgtcatccagaatgg

SEQ ID NO: 20163 - DNA, 23 bp, Homo sapiens
caggatctggagatggaggtagg

SEQ ID NO: 20164 - DNA, 23 bp, Homo sapiens
gtccacgaggttaatctaaaggg

SEQ ID NO: 20165 - DNA, 23 bp, Homo sapiens
tggtggtcctctgcatcacaagg

SEQ ID NO: 20166 - DNA, 23 bp, Homo sapiens
ggagagtcaaacagctctcgtgg

SEQ ID NO: 20167 - DNA, 23 bp, Homo sapiens
ccataaaactcagccatcagtgg

SEQ ID NO: 20168 - DNA, 23 bp, Homo sapiens
ggtaggaacagcgtctttaatgg

SEQ ID NO: 20169 - DNA, 23 bp, Homo sapiens
atgaggctctggggctcaggtgg

SEQ ID NO: 20170 - DNA, 23 bp, Homo sapiens
tcagcgagaccaagctctgatgg

SEQ ID NO: 20171 - DNA, 23 bp, Homo sapiens
ggggtgcagggattagagggagg

SEQ ID NO: 20172 - DNA, 23 bp, Homo sapiens
ggacagcagacaggtcatggtgg

SEQ ID NO: 20173 - DNA, 23 bp, Homo sapiens
tcttccagtttttactgttgtgg

SEQ ID NO: 20174 - DNA, 23 bp, Homo sapiens
tagcagttgttaaatagctgtgg

SEQ ID NO: 20175 - DNA, 23 bp, Homo sapiens
ccgtcatgaaggtaatcagaagg

SEQ ID NO: 20176 - DNA, 23 bp, Homo sapiens
tgtcaagaaacactgtttgtggg

SEQ ID NO: 20177 - DNA, 23 bp, Homo sapiens
agtgtggaggaggagtgagccgg

SEQ ID NO: 20178 - DNA, 23 bp, Homo sapiens
tcttctttacacagtacaccagg

SEQ ID NO: 20179 - DNA, 23 bp, Homo sapiens
cagcatgggaatgtgtcatacgg

SEQ ID NO: 20180 - DNA, 23 bp, Homo sapiens
acccagcgcccaggctcatatgg

SEQ ID NO: 20181 - DNA, 23 bp, Homo sapiens
tgacagtcagcgaatcgagccgg

SEQ ID NO: 20182 - DNA, 23 bp, Homo sapiens
gtggtctggagttacagcgtcgg

SEQ ID NO: 20183 - DNA, 23 bp, Homo sapiens
aaaatggtagaagtactggcagg

SEQ ID NO: 20184 - DNA, 23 bp, Homo sapiens
taagatccaaaatcaagacgagg

SEQ ID NO: 20185 - DNA, 23 bp, Homo sapiens
tatctccgagtctagttcgtagg

SEQ ID NO: 20186 - DNA, 23 bp, Homo sapiens
ccgggaggactgttagacactgg

SEQ ID NO: 20187 - DNA, 23 bp, Homo sapiens
atgggcgctgtgggccctgaagg

SEQ ID NO: 20188 - DNA, 23 bp, Homo sapiens
cacgggagcaagaaggattgagg

SEQ ID NO: 20189 - DNA, 23 bp, Homo sapiens
gccaagctccagaagaacagagg

SEQ ID NO: 20190 - DNA, 23 bp, Homo sapiens
cgtgtccagggggtcacgcgtgg

SEQ ID NO: 20191 - DNA, 23 bp, Homo sapiens
gaccccctggacacgtgacaggg

SEQ ID NO: 20192 - DNA, 23 bp, Homo sapiens
ctgtggcctctcagaattgaggg

SEQ ID NO: 20193 - DNA, 23 bp, Homo sapiens
attactcaagaagaggcattcgg

SEQ ID NO: 20194 - DNA, 23 bp, Homo sapiens
gcattgccagcctcatctgacgg

SEQ ID NO: 20195 - DNA, 23 bp, Homo sapiens
aatcagtgaatttctttgccagg

SEQ ID NO: 20196 - DNA, 23 bp, Homo sapiens
cctgttcagacgctgcttcaagg

SEQ ID NO: 20197 - DNA, 23 bp, Homo sapiens
tttgacaaagcgtcatccaatgg

SEQ ID NO: 20198 - DNA, 23 bp, Homo sapiens
tggcattagggtgtgtaagcagg

SEQ ID NO: 20199 - DNA, 23 bp, Homo sapiens
gtcatgtttatcacactccttgg

SEQ ID NO: 20200 - DNA, 23 bp, Homo sapiens
gtgtgcaccgtgcgctgagtggg

SEQ ID NO: 20201 - DNA, 23 bp, Homo sapiens
tgtctgcatgcagcctatgcagg

SEQ ID NO: 20202 - DNA, 23 bp, Homo sapiens
ggggagggggagtgctcacacgg

SEQ ID NO: 20203 - DNA, 23 bp, Homo sapiens
ggaaagtgcgaattagaccaagg

SEQ ID NO: 20204 - DNA, 23 bp, Homo sapiens
ctagagactcgagttactgtggg

SEQ ID NO: 20205 - DNA, 23 bp, Homo sapiens
tggagggtcaggagctgccccgg

SEQ ID NO: 20206 - DNA, 23 bp, Homo sapiens
acaggactttagagactatatgg

SEQ ID NO: 20207 - DNA, 23 bp, Homo sapiens
tctggagaaactcaaagataagg

SEQ ID NO: 20208 - DNA, 23 bp, Homo sapiens
agctgcacaactacatggagagg

SEQ ID NO: 20209 - DNA, 23 bp, Homo sapiens
ttctgcgcatgtaattgtgcagg

SEQ ID NO: 20210 - DNA, 23 bp, Homo sapiens
ccgcgatcacttctcgaagtagg

SEQ ID NO: 20211 - DNA, 23 bp, Homo sapiens
tcatcttcaggaaaactctgtgg

SEQ ID NO: 20212 - DNA, 23 bp, Homo sapiens
gaacggcagctgaaacacaacgg

SEQ ID NO: 20213 - DNA, 23 bp, Homo sapiens
caaccgacgttggagtttggagg

SEQ ID NO: 20214 - DNA, 23 bp, Homo sapiens
aggagttcatgcaagttcgaagg

SEQ ID NO: 20215 - DNA, 23 bp, Homo sapiens
atcttgggagagtcatttaaggg

SEQ ID NO: 20216 - DNA, 23 bp, Homo sapiens
gcaagcttgagagctgctaaagg

SEQ ID NO: 20217 - DNA, 23 bp, Homo sapiens
ccgaccctccccacaccctaggg

SEQ ID NO: 20218 - DNA, 23 bp, Homo sapiens
tactcaggagatgttactgctgg

SEQ ID NO: 20219 - DNA, 23 bp, Homo sapiens
gcattttgcatcatcttgactgg

SEQ ID NO: 20220 - DNA, 23 bp, Homo sapiens
ccggagtccagcggggtcagagg

SEQ ID NO: 20221 - DNA, 23 bp, Homo sapiens
cgttgtcaatgtgcactcctagg

SEQ ID NO: 20222 - DNA, 23 bp, Homo sapiens
gcagcaacaagacaagtctcagg

SEQ ID NO: 20223 - DNA, 23 bp, Homo sapiens
gaaatcccagctactcaggaggg

SEQ ID NO: 20224 - DNA, 23 bp, Homo sapiens
caacatacgaactccaactttgg

SEQ ID NO: 20225 - DNA, 23 bp, Homo sapiens
tggaacatgacttctgctaatgg

SEQ ID NO: 20226 - DNA, 23 bp, Homo sapiens
gagagcatcgctatgatctaagg

SEQ ID NO: 20227 - DNA, 23 bp, Homo sapiens
cctgccggtccagctgtagcagg

SEQ ID NO: 20228 - DNA, 23 bp, Homo sapiens
aaaaactgatggtttacacctgg

SEQ ID NO: 20229 - DNA, 23 bp, Homo sapiens
ggctgccagggggatgggcaggg

SEQ ID NO: 20230 - DNA, 23 bp, Homo sapiens
cggggccggaggtcacagtgagg

SEQ ID NO: 20231 - DNA, 23 bp, Homo sapiens
acctaccttgaaggaagagaagg

SEQ ID NO: 20232 - DNA, 23 bp, Homo sapiens
ctggtggtggagtcacagaaagg

SEQ ID NO: 20233 - DNA, 23 bp, Homo sapiens
attggccagaactgtgtcattgg

SEQ ID NO: 20234 - DNA, 23 bp, Homo sapiens
acttatagttctggaattggggg

SEQ ID NO: 20235 - DNA, 23 bp, Homo sapiens
gaggagcggagcgggtcacttgg

SEQ ID NO: 20236 - DNA, 23 bp, Homo sapiens
ctggtgttttgctgtgtcagtgg

SEQ ID NO: 20237 - DNA, 23 bp, Homo sapiens
tctgagcagtcactcattcctgg

SEQ ID NO: 20238 - DNA, 23 bp, Homo sapiens
ccacggccgtgtcgctcactcgg

SEQ ID NO: 20239 - DNA, 23 bp, Homo sapiens
tacttccaccagcacttggcagg

SEQ ID NO: 20240 - DNA, 23 bp, Homo sapiens
ctatcaccagtatctgactgtgg

SEQ ID NO: 20241 - DNA, 23 bp, Homo sapiens
taagatctcaaagaagcacatgg

SEQ ID NO: 20242 - DNA, 23 bp, Homo sapiens
tgcagcacctgaaacctagaagg

SEQ ID NO: 20243 - DNA, 23 bp, Homo sapiens
tacgagatgtttgagtgaagggg

SEQ ID NO: 20244 - DNA, 23 bp, Homo sapiens
cttcagtctattttcttggctgg

SEQ ID NO: 20245 - DNA, 23 bp, Homo sapiens
cagccaagaaaatagactgaagg

SEQ ID NO: 20246 - DNA, 23 bp, Homo sapiens
cataggaggcatcgtttttttgg

SEQ ID NO: 20247 - DNA, 23 bp, Homo sapiens
aaagcattcaagatagtgtctgg

SEQ ID NO: 20248 - DNA, 23 bp, Homo sapiens
tcagctgaactctcctacactgg

SEQ ID NO: 20249 - DNA, 23 bp, Homo sapiens
aagtttctgcttatctgcttagg

SEQ ID NO: 20250 - DNA, 23 bp, Homo sapiens
actgtgctggacacaggacaagg

SEQ ID NO: 20251 - DNA, 23 bp, Homo sapiens
gttgttgggagtttagaccgtgg

SEQ ID NO: 20252 - DNA, 23 bp, Homo sapiens
gaggagacatgagaaggatgagg

SEQ ID NO: 20253 - DNA, 23 bp, Homo sapiens
tcttggtggtctcctttttacgg

SEQ ID NO: 20254 - DNA, 23 bp, Homo sapiens
aggatcctcgctacactttgagg

SEQ ID NO: 20255 - DNA, 23 bp, Homo sapiens
ctagagtccatagtttacggtgg

SEQ ID NO: 20256 - DNA, 23 bp, Homo sapiens
gaaaaggaagaggttactgtggg

SEQ ID NO: 20257 - DNA, 23 bp, Homo sapiens
ggtctcaagagaaatccgtgcgg

SEQ ID NO: 20258 - DNA, 23 bp, Homo sapiens
tatactctctccctcgctagagg

SEQ ID NO: 20259 - DNA, 23 bp, Homo sapiens
tgggctctgtggctgctagcagg

SEQ ID NO: 20260 - DNA, 23 bp, Homo sapiens
aaggaaatgttggaagtgagtgg

SEQ ID NO: 20261 - DNA, 23 bp, Homo sapiens
tggggtctttggcagctcacagg

SEQ ID NO: 20262 - DNA, 23 bp, Homo sapiens
caatccgggccgctcctgatggg

SEQ ID NO: 20263 - DNA, 23 bp, Homo sapiens
cagtgaggacagtcataccgtgg

SEQ ID NO: 20264 - DNA, 23 bp, Homo sapiens
ttagcacactgtcccattctcgg

SEQ ID NO: 20265 - DNA, 23 bp, Homo sapiens
caagggtgctggacatgggtggg

SEQ ID NO: 20266 - DNA, 23 bp, Homo sapiens
ggagaagagcgctgtcatttagg

SEQ ID NO: 20267 - DNA, 23 bp, Homo sapiens
ctccgcttattcttcaggaatgg

SEQ ID NO: 20268 - DNA, 23 bp, Homo sapiens
gagaaggaaagaagactgagggg

SEQ ID NO: 20269 - DNA, 23 bp, Homo sapiens
catccgggccaagtacaaggagg

SEQ ID NO: 20270 - DNA, 23 bp, Homo sapiens
tactatttctggttgttggacgg

SEQ ID NO: 20271 - DNA, 23 bp, Homo sapiens
tcggaaactgcgcagtgaacagg

SEQ ID NO: 20272 - DNA, 23 bp, Homo sapiens
gaagcagtaactacgctctcagg

SEQ ID NO: 20273 - DNA, 23 bp, Homo sapiens
cagtggagtccgggctagagagg

SEQ ID NO: 20274 - DNA, 23 bp, Homo sapiens
cagctctgatgatgaattctagg

SEQ ID NO: 20275 - DNA, 23 bp, Homo sapiens
ccatactgttcaggaatccacgg

SEQ ID NO: 20276 - DNA, 23 bp, Homo sapiens
acaagatcatccactggccctgg

SEQ ID NO: 20277 - DNA, 23 bp, Homo sapiens
cccggaagtggcatctaatctgg

SEQ ID NO: 20278 - DNA, 23 bp, Homo sapiens
tcctctctaggagtttaatctgg

SEQ ID NO: 20279 - DNA, 23 bp, Homo sapiens
gcgtttcacacaggtgtttgggg

SEQ ID NO: 20280 - DNA, 23 bp, Homo sapiens
tcaacgcgtcttcccgccagagg

SEQ ID NO: 20281 - DNA, 23 bp, Homo sapiens
cctgacgggcgagaagcctcggg

SEQ ID NO: 20282 - DNA, 23 bp, Homo sapiens
atgaaataaagttcaccccctgg

SEQ ID NO: 20283 - DNA, 23 bp, Homo sapiens
gcgaggaagaggaggattagggg

SEQ ID NO: 20284 - DNA, 23 bp, Homo sapiens
gcggggcgctgcacttaggttgg

SEQ ID NO: 20285 - DNA, 23 bp, Homo sapiens
tcagccaagtagaacgtgagagg

SEQ ID NO: 20286 - DNA, 23 bp, Homo sapiens
ggaccacagctgatatttaatgg

SEQ ID NO: 20287 - DNA, 23 bp, Homo sapiens
agatatggctatacccgcactgg

SEQ ID NO: 20288 - DNA, 23 bp, Homo sapiens
cgagctgggagaactgtaactgg

SEQ ID NO: 20289 - DNA, 23 bp, Homo sapiens
aagcttgctttagcagttccagg

SEQ ID NO: 20290 - DNA, 23 bp, Homo sapiens
agaggggaacttctgaaacaagg

SEQ ID NO: 20291 - DNA, 23 bp, Homo sapiens
gtctcccctctcttcagacccgg

SEQ ID NO: 20292 - DNA, 23 bp, Homo sapiens
gaagaagaactggaaagcacagg

SEQ ID NO: 20293 - DNA, 23 bp, Homo sapiens
atggctgcttctctgaccttcgg

SEQ ID NO: 20294 - DNA, 23 bp, Homo sapiens
ctccaacggtgggtcagcgcagg

SEQ ID NO: 20295 - DNA, 23 bp, Homo sapiens
gtcaggactgtggtggtgatagg

SEQ ID NO: 20296 - DNA, 23 bp, Homo sapiens
gtgaggctagttgacccgacagg

SEQ ID NO: 20297 - DNA, 23 bp, Homo sapiens
ctgagaagggcgactcagcatgg

SEQ ID NO: 20298 - DNA, 23 bp, Homo sapiens
gaaataaggagcctctagcatgg

SEQ ID NO: 20299 - DNA, 23 bp, Homo sapiens
cgaggtgacttcagcttatgtgg

SEQ ID NO: 20300 - DNA, 23 bp, Homo sapiens
acaatttcttcatatggaggtgg

SEQ ID NO: 20301 - DNA, 23 bp, Homo sapiens
aggagcggcggcagatgaagcgg

SEQ ID NO: 20302 - DNA, 23 bp, Homo sapiens
agagttaatcttggtctatctgg

SEQ ID NO: 20303 - DNA, 23 bp, Homo sapiens
gcccctaccacctgagtagaggg

SEQ ID NO: 20304 - DNA, 23 bp, Homo sapiens
tggcacaaagatgattctctcgg

SEQ ID NO: 20305 - DNA, 23 bp, Homo sapiens
aaagggtttgggttcccagcagg

SEQ ID NO: 20306 - DNA, 23 bp, Homo sapiens
gtctcacgcttgcaagtccttgg

SEQ ID NO: 20307 - DNA, 23 bp, Homo sapiens
aggaaggcagggcctactgctgg

SEQ ID NO: 20308 - DNA, 23 bp, Homo sapiens
tgtaggcagagattagacgatgg

SEQ ID NO: 20309 - DNA, 23 bp, Homo sapiens
tcaccttggctgctttctccagg

SEQ ID NO: 20310 - DNA, 23 bp, Homo sapiens
tttacttgaggtgctcaccttgg

SEQ ID NO: 20311 - DNA, 23 bp, Homo sapiens
ctttgagaggcagaggtaggtgg

SEQ ID NO: 20312 - DNA, 23 bp, Homo sapiens
agtactttgagaggcagaggagg

SEQ ID NO: 20313 - DNA, 23 bp, Homo sapiens
tattgtgtatctacaggtgctgg

SEQ ID NO: 20314 - DNA, 23 bp, Homo sapiens
tttcctgaagagtggtcagtagg

SEQ ID NO: 20315 - DNA, 23 bp, Homo sapiens
ggtctagaacccggctctgaggg

SEQ ID NO: 20316 - DNA, 23 bp, Homo sapiens
attactgtcttgcagtgagttgg

SEQ ID NO: 20317 - DNA, 23 bp, Homo sapiens
tccctgggctcacaccagtgtgg

SEQ ID NO: 20318 - DNA, 23 bp, Homo sapiens
ggccaccgagcagccatcaccgg

SEQ ID NO: 20319 - DNA, 23 bp, Homo sapiens
ggtcatttcttcacaagctccgg

SEQ ID NO: 20320 - DNA, 23 bp, Homo sapiens
gtaacctgggctctgtgatttgg

SEQ ID NO: 20321 - DNA, 23 bp, Homo sapiens
ctcagtacaaaaggagacacagg

SEQ ID NO: 20322 - DNA, 23 bp, Homo sapiens
aatttccaacgtgttgtggaggg

SEQ ID NO: 20323 - DNA, 23 bp, Homo sapiens
catgtcaagactgactgagcagg

SEQ ID NO: 20324 - DNA, 23 bp, Homo sapiens
gggtgctagtcatcaaagtctgg

SEQ ID NO: 20325 - DNA, 23 bp, Homo sapiens
tagaggcaccaacctcagtcagg

SEQ ID NO: 20326 - DNA, 23 bp, Homo sapiens
aaggagcacttatcctagaaagg

SEQ ID NO: 20327 - DNA, 23 bp, Homo sapiens
agccctatgaacttccttatagg

SEQ ID NO: 20328 - DNA, 23 bp, Homo sapiens
cttgtgcagttcacttcacaagg

SEQ ID NO: 20329 - DNA, 23 bp, Homo sapiens
caacagtctaccctttgagtggg

SEQ ID NO: 20330 - DNA, 23 bp, Homo sapiens
atttgcaggggtggggggcaagg

SEQ ID NO: 20331 - DNA, 23 bp, Homo sapiens
ggagacgtccaggctctcactgg

SEQ ID NO: 20332 - DNA, 23 bp, Homo sapiens
ggcagaaaaaatcctgattctgg

SEQ ID NO: 20333 - DNA, 23 bp, Homo sapiens
ggtgagctggtattatgaagagg

SEQ ID NO: 20334 - DNA, 23 bp, Homo sapiens
gcgggcgcgggcagcgagtgagg

SEQ ID NO: 20335 - DNA, 23 bp, Homo sapiens
tcaggatttggatcaatagaagg

SEQ ID NO: 20336 - DNA, 23 bp, Homo sapiens
taagtccccgtgcggctcacagg

SEQ ID NO: 20337 - DNA, 23 bp, Homo sapiens
ccttgctggttttctcagagcgg

SEQ ID NO: 20338 - DNA, 23 bp, Homo sapiens
tcatccatgctcatctcatttgg

SEQ ID NO: 20339 - DNA, 23 bp, Homo sapiens
ttccatgatgtgggaaggtgagg

SEQ ID NO: 20340 - DNA, 23 bp, Homo sapiens
tcacattggtgggctgctttagg

SEQ ID NO: 20341 - DNA, 23 bp, Homo sapiens
aaatcttcagtaggttgatgtgg

SEQ ID NO: 20342 - DNA, 23 bp, Homo sapiens
ggcatctcttggcaccctagagg

SEQ ID NO: 20343 - DNA, 23 bp, Homo sapiens
aaatggctgcaatgcagaatagg

SEQ ID NO: 20344 - DNA, 23 bp, Homo sapiens
tcctgaattttgtcccgagaagg

SEQ ID NO: 20345 - DNA, 23 bp, Homo sapiens
gccctcagagtcacacctccagg

SEQ ID NO: 20346 - DNA, 23 bp, Homo sapiens
ccacctcgggactgtgttctcgg

SEQ ID NO: 20347 - DNA, 23 bp, Homo sapiens
caacagtgtggaagctttagggg

SEQ ID NO: 20348 - DNA, 23 bp, Homo sapiens
gcgtgagcagtgatgagatctgg

SEQ ID NO: 20349 - DNA, 23 bp, Homo sapiens
ggcggcctcctcaccagccaagg

SEQ ID NO: 20350 - DNA, 23 bp, Homo sapiens
cacttgcccccaaagtcacacgg

SEQ ID NO: 20351 - DNA, 23 bp, Homo sapiens
tcgccaccaggcatttgtcaagg

SEQ ID NO: 20352 - DNA, 23 bp, Homo sapiens
aggcgaggccaagagtgctgagg

SEQ ID NO: 20353 - DNA, 23 bp, Homo sapiens
tggagagcattctctcagggtgg

SEQ ID NO: 20354 - DNA, 23 bp, Homo sapiens
ccgtttgtaagcaatcaagatgg

SEQ ID NO: 20355 - DNA, 23 bp, Homo sapiens
ctctcccacatgaatcagccagg

SEQ ID NO: 20356 - DNA, 23 bp, Homo sapiens
gcacaatactatggcatacaagg

SEQ ID NO: 20357 - DNA, 23 bp, Homo sapiens
ccaccttacagtccctaaagagg

SEQ ID NO: 20358 - DNA, 23 bp, Homo sapiens
acgcctctatcagggtgcgtagg

SEQ ID NO: 20359 - DNA, 23 bp, Homo sapiens
aaagggagctcaaagagccaagg

SEQ ID NO: 20360 - DNA, 23 bp, Homo sapiens
ctcttcctgctgctctgggttgg

SEQ ID NO: 20361 - DNA, 23 bp, Homo sapiens
ccagcaccagcaagcggcattgg

SEQ ID NO: 20362 - DNA, 23 bp, Homo sapiens
cggaggcgccctcggaggtgggg

SEQ ID NO: 20363 - DNA, 23 bp, Homo sapiens
caatcaataactaaggggtgtgg

SEQ ID NO: 20364 - DNA, 23 bp, Homo sapiens
aactgcaaagtctgagaaatagg

SEQ ID NO: 20365 - DNA, 23 bp, Homo sapiens
gagtcggaacagggctaaggagg

SEQ ID NO: 20366 - DNA, 23 bp, Homo sapiens
tccgactccccaggcctcagtgg

SEQ ID NO: 20367 - DNA, 23 bp, Homo sapiens
gtaaacaaagtgcccttaacagg

SEQ ID NO: 20368 - DNA, 23 bp, Homo sapiens
aaagtgcttagaacacagcctgg

SEQ ID NO: 20369 - DNA, 23 bp, Homo sapiens
catggcaggctctaggcctcagg

SEQ ID NO: 20370 - DNA, 23 bp, Homo sapiens
ggagttcgtattgatgtctgagg

SEQ ID NO: 20371 - DNA, 23 bp, Homo sapiens
catccctaggtcacctcgccagg

SEQ ID NO: 20372 - DNA, 23 bp, Homo sapiens
tgtctttcgccacagcactgagg

SEQ ID NO: 20373 - DNA, 23 bp, Homo sapiens
gaggctcacccctctctgaaggg

SEQ ID NO: 20374 - DNA, 23 bp, Homo sapiens
atggggatacatttattctctgg

SEQ ID NO: 20375 - DNA, 23 bp, Homo sapiens
aggcagctgtcagtcttcatcgg

SEQ ID NO: 20376 - DNA, 23 bp, Homo sapiens
ccaagcattggctaagtgactgg

SEQ ID NO: 20377 - DNA, 23 bp, Homo sapiens
ctagcagtacaactcccagaagg

SEQ ID NO: 20378 - DNA, 23 bp, Homo sapiens
ggaccaggacgacgacgacgagg

SEQ ID NO: 20379 - DNA, 23 bp, Homo sapiens
aaagggaaagaattgtaggaagg

SEQ ID NO: 20380 - DNA, 23 bp, Homo sapiens
tggtgccaatctgcttataaagg

SEQ ID NO: 20381 - DNA, 23 bp, Homo sapiens
ggcccctcagggcaaagtgaagg

SEQ ID NO: 20382 - DNA, 23 bp, Homo sapiens
gacagagatgctctacttccagg

SEQ ID NO: 20383 - DNA, 23 bp, Homo sapiens
aaatttccacggtcattcccagg

SEQ ID NO: 20384 - DNA, 23 bp, Homo sapiens
ggccaagaaggcggattaggggg

SEQ ID NO: 20385 - DNA, 23 bp, Homo sapiens
ttatctgaggcaacatctaccgg

SEQ ID NO: 20386 - DNA, 23 bp, Homo sapiens
actcaacagttatgaactcaagg

SEQ ID NO: 20387 - DNA, 23 bp, Homo sapiens
accccagggctcaggagaaacgg

SEQ ID NO: 20388 - DNA, 23 bp, Homo sapiens
gggttcaggaagactgactgagg

SEQ ID NO: 20389 - DNA, 23 bp, Homo sapiens
agtagaaaagacacatgatctgg

SEQ ID NO: 20390 - DNA, 23 bp, Homo sapiens
agttttttttggaagatggctgg

SEQ ID NO: 20391 - DNA, 23 bp, Homo sapiens
atggatgatgccaaggctctagg

SEQ ID NO: 20392 - DNA, 23 bp, Homo sapiens
tggtgctactgctgcttgtgtgg

SEQ ID NO: 20393 - DNA, 23 bp, Homo sapiens
acgggtgccagccaaaaagttgg

SEQ ID NO: 20394 - DNA, 23 bp, Homo sapiens
ccttcgaggttcacatcttcagg

SEQ ID NO: 20395 - DNA, 23 bp, Homo sapiens
ggtgttaatcatcatcactcagg

SEQ ID NO: 20396 - DNA, 23 bp, Homo sapiens
aggctctgctcctcagaagttgg

SEQ ID NO: 20397 - DNA, 23 bp, Homo sapiens
cctcttgagtggctcagatgagg

SEQ ID NO: 20398 - DNA, 23 bp, Homo sapiens
cttcatagttcttagggttcagg

SEQ ID NO: 20399 - DNA, 23 bp, Homo sapiens
aaagataaagggagcacccatgg

SEQ ID NO: 20400 - DNA, 23 bp, Homo sapiens
ttggccgcactgaagacttatgg

SEQ ID NO: 20401 - DNA, 23 bp, Homo sapiens
ttggaagaaccgaagagctatgg

SEQ ID NO: 20402 - DNA, 23 bp, Homo sapiens
gtactatgttcccagctacgagg

SEQ ID NO: 20403 - DNA, 23 bp, Homo sapiens
cacccggccgcccgactgaatgg

SEQ ID NO: 20404 - DNA, 23 bp, Homo sapiens
cgttctcctacctccttcaaggg

SEQ ID NO: 20405 - DNA, 23 bp, Homo sapiens
cgactcgaatagttgactcttgg

SEQ ID NO: 20406 - DNA, 23 bp, Homo sapiens
cgcaactgcgtccgctgctgagg

SEQ ID NO: 20407 - DNA, 23 bp, Homo sapiens
ggcaggacatcatctctcagagg

SEQ ID NO: 20408 - DNA, 23 bp, Homo sapiens
tggatgtgatgaatgtcatgtgg

SEQ ID NO: 20409 - DNA, 23 bp, Homo sapiens
agaattcacacaaaagctgaagg

SEQ ID NO: 20410 - DNA, 23 bp, Homo sapiens
accagcccctgaagaaatgaagg

SEQ ID NO: 20411 - DNA, 23 bp, Homo sapiens
tgagcaagattcacttttgtagg

SEQ ID NO: 20412 - DNA, 23 bp, Homo sapiens
ttcaaactagcctgcttagatgg

SEQ ID NO: 20413 - DNA, 23 bp, Homo sapiens
gctggacctgaccaagctgtagg

SEQ ID NO: 20414 - DNA, 23 bp, Homo sapiens
gctggggctttaacagaactcgg

SEQ ID NO: 20415 - DNA, 23 bp, Homo sapiens
ctgcacggggaggaagttaaagg

SEQ ID NO: 20416 - DNA, 23 bp, Homo sapiens
aaagccacctgagctcctgaagg

SEQ ID NO: 20417 - DNA, 23 bp, Homo sapiens
gctgccccccaggaggcctgagg

SEQ ID NO: 20418 - DNA, 23 bp, Homo sapiens
gggcccctccctccccttactgg

SEQ ID NO: 20419 - DNA, 23 bp, Homo sapiens
cagaaccagtaccactgaccggg

SEQ ID NO: 20420 - DNA, 23 bp, Homo sapiens
accctaacattttctggaggtgg

SEQ ID NO: 20421 - DNA, 23 bp, Homo sapiens
aggtgaagaagatgaaaaactgg

SEQ ID NO: 20422 - DNA, 23 bp, Homo sapiens
tttggcatccaaaacattggtgg

SEQ ID NO: 20423 - DNA, 23 bp, Homo sapiens
aaagcactcataatgtttcctgg

SEQ ID NO: 20424 - DNA, 23 bp, Homo sapiens
gaaggatttagatcacttggagg

SEQ ID NO: 20425 - DNA, 23 bp, Homo sapiens
gccattcatgtgtgctgcattgg

SEQ ID NO: 20426 - DNA, 23 bp, Homo sapiens
gaaaaaggacataagagacctgg

SEQ ID NO: 20427 - DNA, 23 bp, Homo sapiens
aagaaaccagtgaagagaaacgg

SEQ ID NO: 20428 - DNA, 23 bp, Homo sapiens
ccatcttctgatttgtcagatgg

SEQ ID NO: 20429 - DNA, 23 bp, Homo sapiens
tcaaaaccactgcctgtgctcgg

SEQ ID NO: 20430 - DNA, 23 bp, Homo sapiens
ctggagcaagcgctcagaacagg

SEQ ID NO: 20431 - DNA, 23 bp, Homo sapiens
tctggaactgtccttggtagagg

SEQ ID NO: 20432 - DNA, 23 bp, Homo sapiens
gggctagttcttaagacctctgg

SEQ ID NO: 20433 - DNA, 23 bp, Homo sapiens
gggcggagaggctcagccccagg

SEQ ID NO: 20434 - DNA, 23 bp, Homo sapiens
cccgggtgtccgtagctacctgg

SEQ ID NO: 20435 - DNA, 23 bp, Homo sapiens
ccggtgcaagagtggactctggg

SEQ ID NO: 20436 - DNA, 23 bp, Homo sapiens
cctgttgccttcatggttaatgg

SEQ ID NO: 20437 - DNA, 23 bp, Homo sapiens
cttgaagctgtcactgctgcagg

SEQ ID NO: 20438 - DNA, 23 bp, Homo sapiens
cctccctgaggcaggtcaagagg

SEQ ID NO: 20439 - DNA, 23 bp, Homo sapiens
ccagaccctggcacctcagttgg

SEQ ID NO: 20440 - DNA, 23 bp, Homo sapiens
gtgcccaagactgactgactagg

SEQ ID NO: 20441 - DNA, 23 bp, Homo sapiens
gaaaggtccaaaatggagtaagg

SEQ ID NO: 20442 - DNA, 23 bp, Homo sapiens
tcttttaggagaaaaacaggagg

SEQ ID NO: 20443 - DNA, 23 bp, Homo sapiens
aatcatgaccagatctgaaatgg

SEQ ID NO: 20444 - DNA, 23 bp, Homo sapiens
tcaatcctgaacatctaggctgg

SEQ ID NO: 20445 - DNA, 23 bp, Homo sapiens
tcccacatcaggaaaggtctggg

SEQ ID NO: 20446 - DNA, 23 bp, Homo sapiens
ggacgagcaactctgcgcctggg

SEQ ID NO: 20447 - DNA, 23 bp, Homo sapiens
acatgttcggtcacccactctgg

SEQ ID NO: 20448 - DNA, 23 bp, Homo sapiens
gatctgcaagaacgatcgggagg

SEQ ID NO: 20449 - DNA, 23 bp, Homo sapiens
agcatctgtgccagctgagaggg

SEQ ID NO: 20450 - DNA, 23 bp, Homo sapiens
gtctgtagaagacacagtgaagg

SEQ ID NO: 20451 - DNA, 23 bp, Homo sapiens
cacaagatgctcagctagatggg

SEQ ID NO: 20452 - DNA, 23 bp, Homo sapiens
agccctcactgtgaaccctgagg

SEQ ID NO: 20453 - DNA, 23 bp, Homo sapiens
aggtgctacgtatctgcttttgg

SEQ ID NO: 20454 - DNA, 23 bp, Homo sapiens
cggcctcagggttcacagtgagg

SEQ ID NO: 20455 - DNA, 23 bp, Homo sapiens
ggctgtaggggcaactagggcgg

SEQ ID NO: 20456 - DNA, 23 bp, Homo sapiens
caggcaggaggtgactcagaagg

SEQ ID NO: 20457 - DNA, 23 bp, Homo sapiens
accacagccagtggctcagaagg

SEQ ID NO: 20458 - DNA, 23 bp, Homo sapiens
caccacctccaagcaaaaagtgg

SEQ ID NO: 20459 - DNA, 23 bp, Homo sapiens
gtctttggagctgggactaaggg

SEQ ID NO: 20460 - DNA, 23 bp, Homo sapiens
ggggtgtgggctaggttataagg

SEQ ID NO: 20461 - DNA, 23 bp, Homo sapiens
aaattgcagactgctcctgcagg

SEQ ID NO: 20462 - DNA, 23 bp, Homo sapiens
tctacgtttacctcaacataagg

SEQ ID NO: 20463 - DNA, 23 bp, Homo sapiens
catgttgtcctcagctaattggg

SEQ ID NO: 20464 - DNA, 23 bp, Homo sapiens
gtatggagaaaaagcagaagagg

SEQ ID NO: 20465 - DNA, 23 bp, Homo sapiens
agaggaggatgagaagaatgagg

SEQ ID NO: 20466 - DNA, 23 bp, Homo sapiens
atctctgaaaacggagagcttgg

SEQ ID NO: 20467 - DNA, 23 bp, Homo sapiens
atctttctgacattgtgctttgg

SEQ ID NO: 20468 - DNA, 23 bp, Homo sapiens
agggttccccaaagtgggagagg

SEQ ID NO: 20469 - DNA, 23 bp, Homo sapiens
tttttgtgtgtacctatgggtgg

SEQ ID NO: 20470 - DNA, 23 bp, Homo sapiens
ttcagtcacatctgttcagtagg

SEQ ID NO: 20471 - DNA, 23 bp, Homo sapiens
gggacaagtattgaacatagggg

SEQ ID NO: 20472 - DNA, 23 bp, Homo sapiens
tgctcgcctcttggggcttcagg

SEQ ID NO: 20473 - DNA, 23 bp, Homo sapiens
ccacacactagacaccactccgg

SEQ ID NO: 20474 - DNA, 23 bp, Homo sapiens
tcctcaaggaagtttaccttcgg

SEQ ID NO: 20475 - DNA, 23 bp, Homo sapiens
ttacacctttgcagacttactgg

SEQ ID NO: 20476 - DNA, 23 bp, Homo sapiens
agtgttatctcttcttttgctgg

SEQ ID NO: 20477 - DNA, 23 bp, Homo sapiens
aaaggtggaacattatttggagg

SEQ ID NO: 20478 - DNA, 23 bp, Homo sapiens
ccctagaaaatccaactgaatgg

SEQ ID NO: 20479 - DNA, 23 bp, Homo sapiens
ctgcagcggtctccctgaactgg

SEQ ID NO: 20480 - DNA, 23 bp, Homo sapiens
aactggattgcttcaaaaacagg

SEQ ID NO: 20481 - DNA, 23 bp, Homo sapiens
tttttttcagagtccagtcttgg

SEQ ID NO: 20482 - DNA, 23 bp, Homo sapiens
actggattaggcaacaaactggg

SEQ ID NO: 20483 - DNA, 23 bp, Homo sapiens
gagttacggccttgcgggactgg

SEQ ID NO: 20484 - DNA, 23 bp, Homo sapiens
tcaaagactggtatgtagtgtgg

SEQ ID NO: 20485 - DNA, 23 bp, Homo sapiens
aacataaagctatgaggatctgg

SEQ ID NO: 20486 - DNA, 23 bp, Homo sapiens
tccctggatttacagcaagatgg

SEQ ID NO: 20487 - DNA, 23 bp, Homo sapiens
ttagggaaactgaagcccaaggg

SEQ ID NO: 20488 - DNA, 23 bp, Homo sapiens
gggtctcaaggtttaccgaatgg

SEQ ID NO: 20489 - DNA, 23 bp, Homo sapiens
actggatttatcgacaaatgagg

SEQ ID NO: 20490 - DNA, 23 bp, Homo sapiens
agagacctaaaaacctgaagagg

SEQ ID NO: 20491 - DNA, 23 bp, Homo sapiens
agctcttcctttgtttcaagagg

SEQ ID NO: 20492 - DNA, 23 bp, Homo sapiens
ctggatctacaatgtctggaagg

SEQ ID NO: 20493 - DNA, 23 bp, Homo sapiens
gaggaaacagcaggactcagagg

SEQ ID NO: 20494 - DNA, 23 bp, Homo sapiens
atccagcaagtggtgacctgagg

SEQ ID NO: 20495 - DNA, 23 bp, Homo sapiens
agggacatatttatgaatccagg

SEQ ID NO: 20496 - DNA, 23 bp, Homo sapiens
agtcacgtggtggtcactcctgg

SEQ ID NO: 20497 - DNA, 23 bp, Homo sapiens
caaattctccggtttgccccggg

SEQ ID NO: 20498 - DNA, 23 bp, Homo sapiens
gaacacactctttctcttgctgg

SEQ ID NO: 20499 - DNA, 23 bp, Homo sapiens
ctggggcggcgcctgctagaagg

SEQ ID NO: 20500 - DNA, 23 bp, Homo sapiens
ataccaaatttagcctggcttgg

SEQ ID NO: 20501 - DNA, 23 bp, Homo sapiens
gaacacactctttctcctgctgg

SEQ ID NO: 20502 - DNA, 23 bp, Homo sapiens
tggggtggaagaagtggggtggg

SEQ ID NO: 20503 - DNA, 23 bp, Homo sapiens
ttctcgatctcagccataccagg

SEQ ID NO: 20504 - DNA, 23 bp, Homo sapiens
tttttctaggcgatccaatttgg

SEQ ID NO: 20505 - DNA, 23 bp, Homo sapiens
tggaacatcatggaaaaacaagg

SEQ ID NO: 20506 - DNA, 23 bp, Homo sapiens
actgagactggatcagaacaagg

SEQ ID NO: 20507 - DNA, 23 bp, Homo sapiens
agtaagatttcaagtgtggaagg

SEQ ID NO: 20508 - DNA, 23 bp, Homo sapiens
tcaggaactaaggagaattacgg

SEQ ID NO: 20509 - DNA, 23 bp, Homo sapiens
agcgcccgcggaggcactacggg

SEQ ID NO: 20510 - DNA, 23 bp, Homo sapiens
ttgcttctggggctattggaggg

SEQ ID NO: 20511 - DNA, 23 bp, Homo sapiens
tttgggatgtatggacgataagg

SEQ ID NO: 20512 - DNA, 23 bp, Homo sapiens
gatttatctgtggccaatgatgg

SEQ ID NO: 20513 - DNA, 23 bp, Homo sapiens
cgtcctttcttgtcaatctgtgg

SEQ ID NO: 20514 - DNA, 23 bp, Homo sapiens
gtcagatggggaaaacaagaagg

SEQ ID NO: 20515 - DNA, 23 bp, Homo sapiens
ctcagaagaagtggttcctgagg

SEQ ID NO: 20516 - DNA, 23 bp, Homo sapiens
gcctacagtgcaggagcccaagg

SEQ ID NO: 20517 - DNA, 23 bp, Homo sapiens
tctttgaaaacaagcacagctgg

SEQ ID NO: 20518 - DNA, 23 bp, Homo sapiens
aaaagtcagcatgctgacaaggg

SEQ ID NO: 20519 - DNA, 23 bp, Homo sapiens
tcttgaaggcaggcgcaaacggg

SEQ ID NO: 20520 - DNA, 23 bp, Homo sapiens
gggatcattgccctgtgaggagg

SEQ ID NO: 20521 - DNA, 23 bp, Homo sapiens
gagggtctggtcagtcgcgatgg

SEQ ID NO: 20522 - DNA, 23 bp, Homo sapiens
gcccctattttcccttataaagg

SEQ ID NO: 20523 - DNA, 23 bp, Homo sapiens
caagcagatgtatggctaaccgg

SEQ ID NO: 20524 - DNA, 23 bp, Homo sapiens
cctgtatccaaatccagtcaagg

SEQ ID NO: 20525 - DNA, 23 bp, Homo sapiens
tggggtttaaaattcccaaaagg

SEQ ID NO: 20526 - DNA, 23 bp, Homo sapiens
tgggcggcgccggggttcagagg

SEQ ID NO: 20527 - DNA, 23 bp, Homo sapiens
tcaggaagctgctagacgaaggg

SEQ ID NO: 20528 - DNA, 23 bp, Homo sapiens
gtaggagggaaggcatttaaagg

SEQ ID NO: 20529 - DNA, 23 bp, Homo sapiens
aaaaagagtctttcactccaagg

SEQ ID NO: 20530 - DNA, 23 bp, Homo sapiens
agagaatcacacttaggacatgg

SEQ ID NO: 20531 - DNA, 23 bp, Homo sapiens
tagaactatgatccctacgatgg

SEQ ID NO: 20532 - DNA, 23 bp, Homo sapiens
tcctgaagagattctttcacagg

SEQ ID NO: 20533 - DNA, 23 bp, Homo sapiens
catggggggcgctcaagccttgg

SEQ ID NO: 20534 - DNA, 23 bp, Homo sapiens
tggccgcctaagtggagataagg

SEQ ID NO: 20535 - DNA, 23 bp, Homo sapiens
tgtacattgtgaagctgtgaagg

SEQ ID NO: 20536 - DNA, 23 bp, Homo sapiens
ggcagggggcacattgtcactgg

SEQ ID NO: 20537 - DNA, 23 bp, Homo sapiens
gggggcccaggtgcataaatggg

SEQ ID NO: 20538 - DNA, 23 bp, Homo sapiens
ggccctgagcaacaatagcaggg

SEQ ID NO: 20539 - DNA, 23 bp, Homo sapiens
gtgcagagtctgtgggtcagtgg

SEQ ID NO: 20540 - DNA, 23 bp, Homo sapiens
tctggtgctgacattcctccagg

SEQ ID NO: 20541 - DNA, 23 bp, Homo sapiens
gccagctgctttgagtgctacgg

SEQ ID NO: 20542 - DNA, 23 bp, Homo sapiens
acggccaggctcacacccacagg

SEQ ID NO: 20543 - DNA, 23 bp, Homo sapiens
gatggggtggggtcttaggacgg

SEQ ID NO: 20544 - DNA, 23 bp, Homo sapiens
agccactcagacgtccctccagg

SEQ ID NO: 20545 - DNA, 23 bp, Homo sapiens
taagtcagtgctgtgttcacagg

SEQ ID NO: 20546 - DNA, 23 bp, Homo sapiens
gcgcccagtcttctcagatgagg

SEQ ID NO: 20547 - DNA, 23 bp, Homo sapiens
gggatgaagcccagttaaccagg

SEQ ID NO: 20548 - DNA, 23 bp, Homo sapiens
gtatccctatgttctacagcagg

SEQ ID NO: 20549 - DNA, 23 bp, Homo sapiens
cacgacagctaggaattacgtgg

SEQ ID NO: 20550 - DNA, 23 bp, Homo sapiens
ctgcagcgcggcccgtgacacgg

SEQ ID NO: 20551 - DNA, 23 bp, Homo sapiens
accctggccaagatctgacctgg

SEQ ID NO: 20552 - DNA, 23 bp, Homo sapiens
gggggccaggatcagtgcacagg

SEQ ID NO: 20553 - DNA, 23 bp, Homo sapiens
acagctgcctctggaaagtgagg

SEQ ID NO: 20554 - DNA, 23 bp, Homo sapiens
ggaggatgtgaactgtgaaatgg

SEQ ID NO: 20555 - DNA, 23 bp, Homo sapiens
attcccaggagtttattttgcgg

SEQ ID NO: 20556 - DNA, 23 bp, Homo sapiens
cagcaaggtagacttcaagatgg

SEQ ID NO: 20557 - DNA, 23 bp, Homo sapiens
ttttttggggcctttttagttgg

SEQ ID NO: 20558 - DNA, 23 bp, Homo sapiens
tcaggatgcaacatactttgggg

SEQ ID NO: 20559 - DNA, 23 bp, Homo sapiens
actcttccaggttcactgagggg

SEQ ID NO: 20560 - DNA, 23 bp, Homo sapiens
tctccacatggaaccttcctggg

SEQ ID NO: 20561 - DNA, 23 bp, Homo sapiens
atcacagtttcacaaaccccagg

SEQ ID NO: 20562 - DNA, 23 bp, Homo sapiens
aatgcacaaatatcactggatgg

SEQ ID NO: 20563 - DNA, 23 bp, Homo sapiens
tcggggctttcatggtgtgaagg

SEQ ID NO: 20564 - DNA, 23 bp, Homo sapiens
tggagccttcttactataggagg

SEQ ID NO: 20565 - DNA, 23 bp, Homo sapiens
caagtctctaggagatgaattgg

SEQ ID NO: 20566 - DNA, 23 bp, Homo sapiens
tattgccatcagcccctcaaagg

SEQ ID NO: 20567 - DNA, 23 bp, Homo sapiens
atggacaacacattctcaagagg

SEQ ID NO: 20568 - DNA, 23 bp, Homo sapiens
ttcagggttgtagagtttcaagg

SEQ ID NO: 20569 - DNA, 23 bp, Homo sapiens
gctggacgttattccgacctcgg

SEQ ID NO: 20570 - DNA, 23 bp, Homo sapiens
acagaaattccatgatgaactgg

SEQ ID NO: 20571 - DNA, 23 bp, Homo sapiens
ctgtgggagggtccatcacttgg

SEQ ID NO: 20572 - DNA, 23 bp, Homo sapiens
cttggcaatctgagatcagctgg

SEQ ID NO: 20573 - DNA, 23 bp, Homo sapiens
gacacaatctggtctcactgagg

SEQ ID NO: 20574 - DNA, 23 bp, Homo sapiens
gcaagtggcttctagtttcttgg

SEQ ID NO: 20575 - DNA, 23 bp, Homo sapiens
cacgggtgagtctcggtcactgg

SEQ ID NO: 20576 - DNA, 23 bp, Homo sapiens
cggatggactttctttactgagg

SEQ ID NO: 20577 - DNA, 23 bp, Homo sapiens
ttagtgtgtacttctacggatgg

SEQ ID NO: 20578 - DNA, 23 bp, Homo sapiens
cagaagctgagctcagggcctgg

SEQ ID NO: 20579 - DNA, 23 bp, Homo sapiens
cttgtggtgggcagggccccagg

SEQ ID NO: 20580 - DNA, 23 bp, Homo sapiens
tcactaggtcttctgctctgcgg

SEQ ID NO: 20581 - DNA, 23 bp, Homo sapiens
cctgaaactgaagaagaagaagg

SEQ ID NO: 20582 - DNA, 23 bp, Homo sapiens
aggcctgaaggtatggtcgatgg

SEQ ID NO: 20583 - DNA, 23 bp, Homo sapiens
catgctggggagggtctaatagg

SEQ ID NO: 20584 - DNA, 23 bp, Homo sapiens
gaaggctgcgaacgttctgatgg

SEQ ID NO: 20585 - DNA, 23 bp, Homo sapiens
cctggagttcatgaagggtgtgg

SEQ ID NO: 20586 - DNA, 23 bp, Homo sapiens
atgatggagggcgtgcagtaagg

SEQ ID NO: 20587 - DNA, 23 bp, Homo sapiens
agtctccgacctcacaatagagg

SEQ ID NO: 20588 - DNA, 23 bp, Homo sapiens
gatgtttgagtccgagtcctagg

SEQ ID NO: 20589 - DNA, 23 bp, Homo sapiens
agctctcaaactttttcttgcgg

SEQ ID NO: 20590 - DNA, 23 bp, Homo sapiens
ccgaaatagtagcagctttgagg

SEQ ID NO: 20591 - DNA, 23 bp, Homo sapiens
gttggaggccgctggaagtgagg

SEQ ID NO: 20592 - DNA, 23 bp, Homo sapiens
caggctctatttccagcgcccgg

SEQ ID NO: 20593 - DNA, 23 bp, Homo sapiens
ggcgggcgctggaagtagagagg

SEQ ID NO: 20594 - DNA, 23 bp, Homo sapiens
atgccagttgtgacgaaatgagg

SEQ ID NO: 20595 - DNA, 23 bp, Homo sapiens
aggagtgcggtctcattagttgg

SEQ ID NO: 20596 - DNA, 23 bp, Homo sapiens
gagcgtcttgcagctttttatgg

SEQ ID NO: 20597 - DNA, 23 bp, Homo sapiens
ggcggctttctatggggtctagg

SEQ ID NO: 20598 - DNA, 23 bp, Homo sapiens
tgtgagctatcgaaacaacctgg

SEQ ID NO: 20599 - DNA, 23 bp, Homo sapiens
gcccactgctcagaactgtaagg

SEQ ID NO: 20600 - DNA, 23 bp, Homo sapiens
ccggcgggctcagcagagcacgg

SEQ ID NO: 20601 - DNA, 23 bp, Homo sapiens
tctgcatctacactgttacatgg

SEQ ID NO: 20602 - DNA, 23 bp, Homo sapiens
tgaccttctgggaggagggtcgg

SEQ ID NO: 20603 - DNA, 23 bp, Homo sapiens
ctgatgatggcagagcctacagg

SEQ ID NO: 20604 - DNA, 23 bp, Homo sapiens
ggggcagggttcatctcttttgg

SEQ ID NO: 20605 - DNA, 23 bp, Homo sapiens
tactgggccagagaaaatgaagg

SEQ ID NO: 20606 - DNA, 23 bp, Homo sapiens
gggagttctcagaccttctttgg

SEQ ID NO: 20607 - DNA, 23 bp, Homo sapiens
aggacgcagaaaggatgtagggg

SEQ ID NO: 20608 - DNA, 23 bp, Homo sapiens
tttcgctccccagcggggggagg

SEQ ID NO: 20609 - DNA, 23 bp, Homo sapiens
ccagcaattccagcctgttatgg

SEQ ID NO: 20610 - DNA, 23 bp, Homo sapiens
cgggcaggtagatggtcagttgg

SEQ ID NO: 20611 - DNA, 23 bp, Homo sapiens
cagaagatgaagctcacttgggg

SEQ ID NO: 20612 - DNA, 23 bp, Homo sapiens
gggtcagaatctgttaaatcagg

SEQ ID NO: 20613 - DNA, 23 bp, Homo sapiens
cagctcatacccttttcagctgg

SEQ ID NO: 20614 - DNA, 23 bp, Homo sapiens
acatcacaaaatgccatgaatgg

SEQ ID NO: 20615 - DNA, 23 bp, Homo sapiens
ctccctgctgcagatgggggagg

SEQ ID NO: 20616 - DNA, 23 bp, Homo sapiens
tgccagaccccacactcataagg

SEQ ID NO: 20617 - DNA, 23 bp, Homo sapiens
cacaaaggagctcaaaatgatgg

SEQ ID NO: 20618 - DNA, 23 bp, Homo sapiens
ggtgttgagttctcccagagtgg

SEQ ID NO: 20619 - DNA, 23 bp, Homo sapiens
caaaccacagagctgctcacagg

SEQ ID NO: 20620 - DNA, 23 bp, Homo sapiens
gagcttggctgaagatgatgtgg

SEQ ID NO: 20621 - DNA, 23 bp, Homo sapiens
gaatgaacaggactgcttggagg

SEQ ID NO: 20622 - DNA, 23 bp, Homo sapiens
ggggctctaccctcacttcctgg

SEQ ID NO: 20623 - DNA, 23 bp, Homo sapiens
ccctgttgggtttttagtgtagg

SEQ ID NO: 20624 - DNA, 23 bp, Homo sapiens
ggccaggagggctcagccgatgg

SEQ ID NO: 20625 - DNA, 23 bp, Homo sapiens
ttcagcatcactgtgggctgagg

SEQ ID NO: 20626 - DNA, 23 bp, Homo sapiens
acggaactttctcatctacgtgg

SEQ ID NO: 20627 - DNA, 23 bp, Homo sapiens
gaaggcgacgggcatatgcgcgg

SEQ ID NO: 20628 - DNA, 23 bp, Homo sapiens
ttaactctaaggggtcatcgggg

SEQ ID NO: 20629 - DNA, 23 bp, Homo sapiens
cctcatggcacctcagccagggg

SEQ ID NO: 20630 - DNA, 23 bp, Homo sapiens
tgagcctactttggggataaagg

SEQ ID NO: 20631 - DNA, 23 bp, Homo sapiens
ttccccctgttttataatgttgg

SEQ ID NO: 20632 - DNA, 23 bp, Homo sapiens
aaaggcagcgccagggtcagagg

SEQ ID NO: 20633 - DNA, 23 bp, Homo sapiens
gtttgcctgggccattgacatgg

SEQ ID NO: 20634 - DNA, 23 bp, Homo sapiens
ttcaaagtcttctcctgccatgg

SEQ ID NO: 20635 - DNA, 23 bp, Homo sapiens
catcttcatctgactcttccagg

SEQ ID NO: 20636 - DNA, 23 bp, Homo sapiens
tgccacgaaccggtcgggctagg

SEQ ID NO: 20637 - DNA, 23 bp, Homo sapiens
ccctgagctcatctgttctgagg

SEQ ID NO: 20638 - DNA, 23 bp, Homo sapiens
acagggtcatcatacaaagtagg

SEQ ID NO: 20639 - DNA, 23 bp, Homo sapiens
gcaccaggctggactctgagggg

SEQ ID NO: 20640 - DNA, 23 bp, Homo sapiens
tgaagtgggctggaaaggtttgg

SEQ ID NO: 20641 - DNA, 23 bp, Homo sapiens
agatgcgattagtgtactctagg

SEQ ID NO: 20642 - DNA, 23 bp, Homo sapiens
actgacattaatgatgtccgtgg

SEQ ID NO: 20643 - DNA, 23 bp, Homo sapiens
ctcagataaaggctgcaaaacgg

SEQ ID NO: 20644 - DNA, 23 bp, Homo sapiens
cctgaaaatgccctgaaaagggg

SEQ ID NO: 20645 - DNA, 23 bp, Homo sapiens
tctgtgcttagctttagaaaagg

SEQ ID NO: 20646 - DNA, 23 bp, Homo sapiens
ttggcccagttttttgtttaagg

SEQ ID NO: 20647 - DNA, 23 bp, Homo sapiens
agttttatcttctgctcatgagg

SEQ ID NO: 20648 - DNA, 23 bp, Homo sapiens
ccatctggataggagctcagtgg

SEQ ID NO: 20649 - DNA, 23 bp, Homo sapiens
gaaagatgaagatggctttgcgg

SEQ ID NO: 20650 - DNA, 23 bp, Homo sapiens
gacaccactcagagagtcagagg

SEQ ID NO: 20651 - DNA, 23 bp, Homo sapiens
gggcctggagccaagggatgagg

SEQ ID NO: 20652 - DNA, 23 bp, Homo sapiens
tgtccaaagggaaatcaaccagg

SEQ ID NO: 20653 - DNA, 23 bp, Homo sapiens
ttaactacttcctgtcatgaagg

SEQ ID NO: 20654 - DNA, 23 bp, Homo sapiens
ccgtcctgcgcctccactacagg

SEQ ID NO: 20655 - DNA, 23 bp, Homo sapiens
ggtgttcagattctcaagtaagg

SEQ ID NO: 20656 - DNA, 23 bp, Homo sapiens
tagggaggcgggattaggtgagg

SEQ ID NO: 20657 - DNA, 23 bp, Homo sapiens
acagactcaagtattatcgcagg

SEQ ID NO: 20658 - DNA, 23 bp, Homo sapiens
tgaatttctagaggctacccagg

SEQ ID NO: 20659 - DNA, 23 bp, Homo sapiens
caacttacgacgagtttatcagg

SEQ ID NO: 20660 - DNA, 23 bp, Homo sapiens
ggagaatgtcagtctgagtcagg

SEQ ID NO: 20661 - DNA, 23 bp, Homo sapiens
tttctttttgaaagctggtctgg

SEQ ID NO: 20662 - DNA, 23 bp, Homo sapiens
cttggtcctcagcaactgtctgg

SEQ ID NO: 20663 - DNA, 23 bp, Homo sapiens
tcagagcattggacagagctggg

SEQ ID NO: 20664 - DNA, 23 bp, Homo sapiens
tcggctcactgcaacctcaacgg

SEQ ID NO: 20665 - DNA, 23 bp, Homo sapiens
ctcattgttggggagagaattgg

SEQ ID NO: 20666 - DNA, 23 bp, Homo sapiens
taaaccaagacaaaggagcttgg

SEQ ID NO: 20667 - DNA, 23 bp, Homo sapiens
agcgggcaactaggccttcttgg

SEQ ID NO: 20668 - DNA, 23 bp, Homo sapiens
cagtgtaggagtcaggttctcgg

SEQ ID NO: 20669 - DNA, 23 bp, Homo sapiens
ggtagcaagagacagatgccagg

SEQ ID NO: 20670 - DNA, 23 bp, Homo sapiens
aaggcgagagctcggagtgacgg

SEQ ID NO: 20671 - DNA, 23 bp, Homo sapiens
cctgccccatcctccttcactgg

SEQ ID NO: 20672 - DNA, 23 bp, Homo sapiens
gttggcctccatgtacttatggg

SEQ ID NO: 20673 - DNA, 23 bp, Homo sapiens
attagtaattgtactgacgcggg

SEQ ID NO: 20674 - DNA, 23 bp, Homo sapiens
gtcttataagcagcttttcctgg

SEQ ID NO: 20675 - DNA, 23 bp, Homo sapiens
tggacgctcagtagttgaactgg

SEQ ID NO: 20676 - DNA, 23 bp, Homo sapiens
cacattcttctacccaaccatgg

SEQ ID NO: 20677 - DNA, 23 bp, Homo sapiens
ctctcactgcctccgcggcaggg

SEQ ID NO: 20678 - DNA, 23 bp, Homo sapiens
agctgaaggggaggaatgggtgg

SEQ ID NO: 20679 - DNA, 23 bp, Homo sapiens
acaaccattcctgatggcatggg

SEQ ID NO: 20680 - DNA, 23 bp, Homo sapiens
acagcgcatcaaagaggaggggg

SEQ ID NO: 20681 - DNA, 23 bp, Homo sapiens
atatagagatagggctctatggg

SEQ ID NO: 20682 - DNA, 23 bp, Homo sapiens
ccacagattgcagcattgtcagg

SEQ ID NO: 20683 - DNA, 23 bp, Homo sapiens
cagccaggcgaggccctcagtgg

SEQ ID NO: 20684 - DNA, 23 bp, Homo sapiens
cctgcagaacctgaccattgagg

SEQ ID NO: 20685 - DNA, 23 bp, Homo sapiens
cggggatcttcagggcccccagg

SEQ ID NO: 20686 - DNA, 23 bp, Homo sapiens
aacgaacctcagttctaactcgg

SEQ ID NO: 20687 - DNA, 23 bp, Homo sapiens
cccgggctcggggctctgagcgg

SEQ ID NO: 20688 - DNA, 23 bp, Homo sapiens
tcgggcgctgggctaggtaacgg

SEQ ID NO: 20689 - DNA, 23 bp, Homo sapiens
acccgcacctgtggctgtgcagg

SEQ ID NO: 20690 - DNA, 23 bp, Homo sapiens
aacaaaggtaggaatctcacagg

SEQ ID NO: 20691 - DNA, 23 bp, Homo sapiens
ctcagtcatcaccaaaaagctgg

SEQ ID NO: 20692 - DNA, 23 bp, Homo sapiens
acggccatcagcaagaagttcgg

SEQ ID NO: 20693 - DNA, 23 bp, Homo sapiens
ctcccggcggaccaaggaggagg

SEQ ID NO: 20694 - DNA, 23 bp, Homo sapiens
tagcaggcatacttatggaatgg

SEQ ID NO: 20695 - DNA, 23 bp, Homo sapiens
aagcaaccacaggcttagaaagg

SEQ ID NO: 20696 - DNA, 23 bp, Homo sapiens
ccggctctgctcatccgccctgg

SEQ ID NO: 20697 - DNA, 23 bp, Homo sapiens
attctgcttccttctcctttagg

SEQ ID NO: 20698 - DNA, 23 bp, Homo sapiens
gcttggaggcgtgaagaagtcgg

SEQ ID NO: 20699 - DNA, 23 bp, Homo sapiens
tctcagggggcaaaagagcttgg

SEQ ID NO: 20700 - DNA, 23 bp, Homo sapiens
aaggtcaagccggtgggctgagg

SEQ ID NO: 20701 - DNA, 23 bp, Homo sapiens
gagggaggggtgctcacttccgg

SEQ ID NO: 20702 - DNA, 23 bp, Homo sapiens
ataccatagtttacaatggcagg

SEQ ID NO: 20703 - DNA, 23 bp, Homo sapiens
cttcatgtgtatcgtcctccagg

SEQ ID NO: 20704 - DNA, 23 bp, Homo sapiens
gaacaggaatccggagcagaagg

SEQ ID NO: 20705 - DNA, 23 bp, Homo sapiens
tccaagcgagggtgcttctgagg

SEQ ID NO: 20706 - DNA, 23 bp, Homo sapiens
tcgcaatcattcctcagttatgg

SEQ ID NO: 20707 - DNA, 23 bp, Homo sapiens
tgctgctgactctttgcttgtgg

SEQ ID NO: 20708 - DNA, 23 bp, Homo sapiens
actggctactgttagatactcgg

SEQ ID NO: 20709 - DNA, 23 bp, Homo sapiens
ggcatcaaatccccagatattgg

SEQ ID NO: 20710 - DNA, 23 bp, Homo sapiens
gatggatggggctcattgtttgg

SEQ ID NO: 20711 - DNA, 23 bp, Homo sapiens
gtcaacaggttagcttttgatgg

SEQ ID NO: 20712 - DNA, 23 bp, Homo sapiens
taatctgattagtcttgggacgg

SEQ ID NO: 20713 - DNA, 23 bp, Homo sapiens
aagtcatatcgttgagagcgtgg

SEQ ID NO: 20714 - DNA, 23 bp, Homo sapiens
actaaagctggccctgaatgagg

SEQ ID NO: 20715 - DNA, 23 bp, Homo sapiens
agagtggatgaacgtttacatgg

SEQ ID NO: 20716 - DNA, 23 bp, Homo sapiens
gatgctggatcagactttactgg

SEQ ID NO: 20717 - DNA, 23 bp, Homo sapiens
cacgctggcgtggggctcagagg

SEQ ID NO: 20718 - DNA, 23 bp, Homo sapiens
ggggtggggctggccctcacagg

SEQ ID NO: 20719 - DNA, 23 bp, Homo sapiens
aggtcatgtcattgagggcgtgg

SEQ ID NO: 20720 - DNA, 23 bp, Homo sapiens
gcatgatctgtgtgactgatggg

SEQ ID NO: 20721 - DNA, 23 bp, Homo sapiens
gggcgttctacatctcattcagg

SEQ ID NO: 20722 - DNA, 23 bp, Homo sapiens
cgtgggcttacatcagacactgg

SEQ ID NO: 20723 - DNA, 23 bp, Homo sapiens
tatgatccaactaaacatccagg

SEQ ID NO: 20724 - DNA, 23 bp, Homo sapiens
ttccacatgctgaaattgaaagg

SEQ ID NO: 20725 - DNA, 23 bp, Homo sapiens
tcctgccactttgccctcagagg

SEQ ID NO: 20726 - DNA, 23 bp, Homo sapiens
tcctgataggaaagggtcagggg

SEQ ID NO: 20727 - DNA, 23 bp, Homo sapiens
tagaatacgcaataatcgggagg

SEQ ID NO: 20728 - DNA, 23 bp, Homo sapiens
aggctcgccaggccctgatccgg

SEQ ID NO: 20729 - DNA, 23 bp, Homo sapiens
gataagaagaccaagtagagagg

SEQ ID NO: 20730 - DNA, 23 bp, Homo sapiens
gatgccaaggtgaagaagtgagg

SEQ ID NO: 20731 - DNA, 23 bp, Homo sapiens
gggagaggaggaataaacagagg

SEQ ID NO: 20732 - DNA, 23 bp, Homo sapiens
gcatggaagcgatgtcatccagg

SEQ ID NO: 20733 - DNA, 23 bp, Homo sapiens
ggaaggccatcaatgcctgaggg

SEQ ID NO: 20734 - DNA, 23 bp, Homo sapiens
tcccttgcccgtgggagtattgg

SEQ ID NO: 20735 - DNA, 23 bp, Homo sapiens
tccatgaccaggggcaaaatagg

SEQ ID NO: 20736 - DNA, 23 bp, Homo sapiens
atctcaagtagaaggtcatcagg

SEQ ID NO: 20737 - DNA, 23 bp, Homo sapiens
agtgctgggctcagaaatacagg

SEQ ID NO: 20738 - DNA, 23 bp, Homo sapiens
ctcaggccccaggttattactgg

SEQ ID NO: 20739 - DNA, 23 bp, Homo sapiens
aggcctgactcacggctttttgg

SEQ ID NO: 20740 - DNA, 23 bp, Homo sapiens
cccctggtctgcaaggtgaatgg

SEQ ID NO: 20741 - DNA, 23 bp, Homo sapiens
ccttccccgcccctgactgatgg

SEQ ID NO: 20742 - DNA, 23 bp, Homo sapiens
ggatcaggttttccgtagttagg

SEQ ID NO: 20743 - DNA, 23 bp, Homo sapiens
gaaatcacgagcttcctaagtgg

SEQ ID NO: 20744 - DNA, 23 bp, Homo sapiens
ctattggactaccgtgaggatgg

SEQ ID NO: 20745 - DNA, 23 bp, Homo sapiens
tggggaatacatctttagcctgg

SEQ ID NO: 20746 - DNA, 23 bp, Homo sapiens
aagggggagctatacttaatcgg

SEQ ID NO: 20747 - DNA, 23 bp, Homo sapiens
tttgctgtggagatactttttgg

SEQ ID NO: 20748 - DNA, 23 bp, Homo sapiens
ctcacagctgagtttagcagtgg

SEQ ID NO: 20749 - DNA, 23 bp, Homo sapiens
atgatagaggatatgatcgtggg

SEQ ID NO: 20750 - DNA, 23 bp, Homo sapiens
aggtgagtatgatcgagatctgg

SEQ ID NO: 20751 - DNA, 23 bp, Homo sapiens
gaccgaggcccggcacaagtagg

SEQ ID NO: 20752 - DNA, 23 bp, Homo sapiens
tgcagagggtgaccgaggcccgg

SEQ ID NO: 20753 - DNA, 23 bp, Homo sapiens
aaaggcttcttctttgcctttgg

SEQ ID NO: 20754 - DNA, 23 bp, Homo sapiens
ctggtgcttccagtcgttacagg

SEQ ID NO: 20755 - DNA, 23 bp, Homo sapiens
ttggggtggccgaggtcaggagg

SEQ ID NO: 20756 - DNA, 23 bp, Homo sapiens
ctgcacccctggtctaggccagg

SEQ ID NO: 20757 - DNA, 23 bp, Homo sapiens
gtggagaccagcacttagggtgg

SEQ ID NO: 20758 - DNA, 23 bp, Homo sapiens
ggggcagttagagccctgtcagg

SEQ ID NO: 20759 - DNA, 23 bp, Homo sapiens
cccagctacttatcagggatcgg

SEQ ID NO: 20760 - DNA, 23 bp, Homo sapiens
ttcttcattcttgaggatgttgg

SEQ ID NO: 20761 - DNA, 23 bp, Homo sapiens
tggggatgaacggtgtcacaagg

SEQ ID NO: 20762 - DNA, 23 bp, Homo sapiens
atccttacagcttcaagaacagg

SEQ ID NO: 20763 - DNA, 23 bp, Homo sapiens
tcaggttgtctttattggccagg

SEQ ID NO: 20764 - DNA, 23 bp, Homo sapiens
accccacctgcactcagctgagg

SEQ ID NO: 20765 - DNA, 23 bp, Homo sapiens
acagtgactagagatcctccagg

SEQ ID NO: 20766 - DNA, 23 bp, Homo sapiens
gccacgaagtactgatgcagggg

SEQ ID NO: 20767 - DNA, 23 bp, Homo sapiens
ggctgtggatagcactgtgaagg

SEQ ID NO: 20768 - DNA, 23 bp, Homo sapiens
aagaggaagaggaggagtaatgg

SEQ ID NO: 20769 - DNA, 23 bp, Homo sapiens
ctcactgttctcacgaccacagg

SEQ ID NO: 20770 - DNA, 23 bp, Homo sapiens
aggctgagcaccaccctcagagg

SEQ ID NO: 20771 - DNA, 23 bp, Homo sapiens
aaacaaactagcttacggtgagg

SEQ ID NO: 20772 - DNA, 23 bp, Homo sapiens
tagcttccgctcgtctgtgtggg

SEQ ID NO: 20773 - DNA, 23 bp, Homo sapiens
ttgagctgagaggagatataggg

SEQ ID NO: 20774 - DNA, 23 bp, Homo sapiens
ggtgtcctgaaggaggactgagg

SEQ ID NO: 20775 - DNA, 23 bp, Homo sapiens
caaatgtagcagactctccccgg

SEQ ID NO: 20776 - DNA, 23 bp, Homo sapiens
gagtagactgtccgccaaagagg

SEQ ID NO: 20777 - DNA, 23 bp, Homo sapiens
aagaaactcaagtctccctaagg

SEQ ID NO: 20778 - DNA, 23 bp, Homo sapiens
agaaggcgttctcggaaatgtgg

SEQ ID NO: 20779 - DNA, 23 bp, Homo sapiens
ctggctgtcagtgtcgctccagg

SEQ ID NO: 20780 - DNA, 23 bp, Homo sapiens
gtaggttgcttcagccagcccgg

SEQ ID NO: 20781 - DNA, 23 bp, Homo sapiens
gtcatgttacactgacttccagg

SEQ ID NO: 20782 - DNA, 23 bp, Homo sapiens
acatcatgcagcagcaatagagg

SEQ ID NO: 20783 - DNA, 23 bp, Homo sapiens
tcatccatgagtcgaccctgtgg

SEQ ID NO: 20784 - DNA, 23 bp, Homo sapiens
gaggcagctaggccagcttgagg

SEQ ID NO: 20785 - DNA, 23 bp, Homo sapiens
ccattaaagtggaaagctgaagg

SEQ ID NO: 20786 - DNA, 23 bp, Homo sapiens
tcaaatgcacttgatcgaatagg

SEQ ID NO: 20787 - DNA, 23 bp, Homo sapiens
ggtgacgtcgatgatgatacagg

SEQ ID NO: 20788 - DNA, 23 bp, Homo sapiens
ggacaatcttccagctggagagg

SEQ ID NO: 20789 - DNA, 23 bp, Homo sapiens
ggtgacagtgtgacagaaatagg

SEQ ID NO: 20790 - DNA, 23 bp, Homo sapiens
ggagacgggggacttacgagtgg

SEQ ID NO: 20791 - DNA, 23 bp, Homo sapiens
aacttttggacctgggtcatagg

SEQ ID NO: 20792 - DNA, 23 bp, Homo sapiens
ttgtggttctagcagatcctagg

SEQ ID NO: 20793 - DNA, 23 bp, Homo sapiens
tttatctccggcagggtcagcgg

SEQ ID NO: 20794 - DNA, 23 bp, Homo sapiens
gcgaggcaggcttaggatttcgg

SEQ ID NO: 20795 - DNA, 23 bp, Homo sapiens
tgaccacgctctcaatgcccagg

SEQ ID NO: 20796 - DNA, 23 bp, Homo sapiens
agaggtggcttatcaaacttggg

SEQ ID NO: 20797 - DNA, 23 bp, Homo sapiens
acacattactgatgatgatcagg

SEQ ID NO: 20798 - DNA, 23 bp, Homo sapiens
cgtgtgtgccctggaggcgcagg

SEQ ID NO: 20799 - DNA, 23 bp, Homo sapiens
gagagaacctataaactagctgg

SEQ ID NO: 20800 - DNA, 23 bp, Homo sapiens
cgaactctggaggaaatccaagg

SEQ ID NO: 20801 - DNA, 23 bp, Homo sapiens
cgttgagactatttccaagtagg

SEQ ID NO: 20802 - DNA, 23 bp, Homo sapiens
acaaccaagacagtggagcaagg

SEQ ID NO: 20803 - DNA, 23 bp, Homo sapiens
ccggcatcacctgcccttgaagg

SEQ ID NO: 20804 - DNA, 23 bp, Homo sapiens
cggaggttctaagagaatattgg

SEQ ID NO: 20805 - DNA, 23 bp, Homo sapiens
ggtgacgaagatactgataaagg

SEQ ID NO: 20806 - DNA, 23 bp, Homo sapiens
tctccaggacagaagcaacaagg

SEQ ID NO: 20807 - DNA, 23 bp, Homo sapiens
ggagaggagggctgtcaccatgg

SEQ ID NO: 20808 - DNA, 23 bp, Homo sapiens
attgtcattctcctggctggtgg

SEQ ID NO: 20809 - DNA, 23 bp, Homo sapiens
gctgaggtcatttgtaccctagg

SEQ ID NO: 20810 - DNA, 23 bp, Homo sapiens
ttcccagtctgtgtgctgagagg

SEQ ID NO: 20811 - DNA, 23 bp, Homo sapiens
cagggctgagagacacgtgaagg

SEQ ID NO: 20812 - DNA, 23 bp, Homo sapiens
tggaagcagggactggttgaggg

SEQ ID NO: 20813 - DNA, 23 bp, Homo sapiens
agtgtgatgagcagcttagctgg

SEQ ID NO: 20814 - DNA, 23 bp, Homo sapiens
ccggtccagagtcactgacgtgg

SEQ ID NO: 20815 - DNA, 23 bp, Homo sapiens
gtggaagtctacttgatctgagg

SEQ ID NO: 20816 - DNA, 23 bp, Homo sapiens
ctaacaggactcacaacatcagg

SEQ ID NO: 20817 - DNA, 23 bp, Homo sapiens
caagattcagtcttgcttcaggg

SEQ ID NO: 20818 - DNA, 23 bp, Homo sapiens
cctggccacacctggggagtagg

SEQ ID NO: 20819 - DNA, 23 bp, Homo sapiens
gcctgatgaccccagcctggagg

SEQ ID NO: 20820 - DNA, 23 bp, Homo sapiens
aaaactgggttcactcctccagg

SEQ ID NO: 20821 - DNA, 23 bp, Homo sapiens
gacgagcttttccaatggttagg

SEQ ID NO: 20822 - DNA, 23 bp, Homo sapiens
tgacacctgcttggcttctgagg

SEQ ID NO: 20823 - DNA, 23 bp, Homo sapiens
tttcaggcttttctttgccatgg

SEQ ID NO: 20824 - DNA, 23 bp, Homo sapiens
ttttggggattagcagaagaagg

SEQ ID NO: 20825 - DNA, 23 bp, Homo sapiens
gcatgagctcagttaaagaaagg

SEQ ID NO: 20826 - DNA, 23 bp, Homo sapiens
agaagtggttctgtatggctagg

SEQ ID NO: 20827 - DNA, 23 bp, Homo sapiens
ctatatgccctggacctagtcgg

SEQ ID NO: 20828 - DNA, 23 bp, Homo sapiens
acagaagtagctgcatagaaagg

SEQ ID NO: 20829 - DNA, 23 bp, Homo sapiens
ttctccctgagctcctgagaagg

SEQ ID NO: 20830 - DNA, 23 bp, Homo sapiens
accctggctccccagtgactcgg

SEQ ID NO: 20831 - DNA, 23 bp, Homo sapiens
tttggtggtactgaacaatgtgg

SEQ ID NO: 20832 - DNA, 23 bp, Homo sapiens
gcatcccccggctgccctagggg

SEQ ID NO: 20833 - DNA, 23 bp, Homo sapiens
cttacgctgaaaggctgaagtgg

SEQ ID NO: 20834 - DNA, 23 bp, Homo sapiens
ctagggagcagtccccaccaagg

SEQ ID NO: 20835 - DNA, 23 bp, Homo sapiens
tttgcaggtcaggccaacatagg

SEQ ID NO: 20836 - DNA, 23 bp, Homo sapiens
gccgaggcgggcagatcacgagg

SEQ ID NO: 20837 - DNA, 23 bp, Homo sapiens
acagtgaccatgtgggtgaaagg

SEQ ID NO: 20838 - DNA, 23 bp, Homo sapiens
ttcactgtgccttcgtagggcgg

SEQ ID NO: 20839 - DNA, 23 bp, Homo sapiens
catgttgtggttgcagactctgg

SEQ ID NO: 20840 - DNA, 23 bp, Homo sapiens
ggccacagtagtcatgctcccgg

SEQ ID NO: 20841 - DNA, 23 bp, Homo sapiens
aaggatccactgactattgatgg

SEQ ID NO: 20842 - DNA, 23 bp, Homo sapiens
aatgagaacactcaggagctcgg

SEQ ID NO: 20843 - DNA, 23 bp, Homo sapiens
aagaggtagtcacagagaaaggg

SEQ ID NO: 20844 - DNA, 23 bp, Homo sapiens
acttgtagctgctggagtattgg

SEQ ID NO: 20845 - DNA, 23 bp, Homo sapiens
agtctccataaattatgctgtgg

SEQ ID NO: 20846 - DNA, 23 bp, Homo sapiens
ggcgttcttcaatgcttttgagg

SEQ ID NO: 20847 - DNA, 23 bp, Homo sapiens
atctgctcccccaagtaggcagg

SEQ ID NO: 20848 - DNA, 23 bp, Homo sapiens
tcagggctcagggtcttagcagg

SEQ ID NO: 20849 - DNA, 23 bp, Homo sapiens
atggagacctccccttgaggagg

SEQ ID NO: 20850 - DNA, 23 bp, Homo sapiens
catgggggctccagcctcagggg

SEQ ID NO: 20851 - DNA, 23 bp, Homo sapiens
tccttccgccaggagctcatggg

SEQ ID NO: 20852 - DNA, 23 bp, Homo sapiens
cagggcctctgtacagctactgg

SEQ ID NO: 20853 - DNA, 23 bp, Homo sapiens
tctgagctggcttagcttgaagg

SEQ ID NO: 20854 - DNA, 23 bp, Homo sapiens
ataatttctcatcccctatgggg

SEQ ID NO: 20855 - DNA, 23 bp, Homo sapiens
ctggtctctcatctgactttagg

SEQ ID NO: 20856 - DNA, 23 bp, Homo sapiens
taactcacaagcaccactcctgg

SEQ ID NO: 20857 - DNA, 23 bp, Homo sapiens
gaagaactggatggctgagctgg

SEQ ID NO: 20858 - DNA, 23 bp, Homo sapiens
ggtgttggggtcaaagctgaagg

SEQ ID NO: 20859 - DNA, 23 bp, Homo sapiens
gaggccgtgaaaccctcaccagg

SEQ ID NO: 20860 - DNA, 23 bp, Homo sapiens
gtttcaactacatgtcctcttgg

SEQ ID NO: 20861 - DNA, 23 bp, Homo sapiens
gtattgaagctgagatcttcagg

SEQ ID NO: 20862 - DNA, 23 bp, Homo sapiens
ctgcctcccccaggtgactaagg

SEQ ID NO: 20863 - DNA, 23 bp, Homo sapiens
cccaacagattgggagtgacagg

SEQ ID NO: 20864 - DNA, 23 bp, Homo sapiens
ccagtgactgataggaaatgagg

SEQ ID NO: 20865 - DNA, 23 bp, Homo sapiens
tgaacaggtcagagcttctgagg

SEQ ID NO: 20866 - DNA, 23 bp, Homo sapiens
gcgggtggcaggataatcaaggg

SEQ ID NO: 20867 - DNA, 23 bp, Homo sapiens
tctcaagtgaagctaaattctgg

SEQ ID NO: 20868 - DNA, 23 bp, Homo sapiens
aaggggctcagaagtgcttctgg

SEQ ID NO: 20869 - DNA, 23 bp, Homo sapiens
tacactggccacagatgatcagg

SEQ ID NO: 20870 - DNA, 23 bp, Homo sapiens
gtgaagaagaggacacatgaagg

SEQ ID NO: 20871 - DNA, 23 bp, Homo sapiens
taggactgtggctctctgatggg

SEQ ID NO: 20872 - DNA, 23 bp, Homo sapiens
ctggaaggctcagtccagcttgg

SEQ ID NO: 20873 - DNA, 23 bp, Homo sapiens
tacaattccagctactcgggagg

SEQ ID NO: 20874 - DNA, 23 bp, Homo sapiens
gcatatccgtgctgaagaggagg

SEQ ID NO: 20875 - DNA, 23 bp, Homo sapiens
ctcagggcagggcccatcactgg

SEQ ID NO: 20876 - DNA, 23 bp, Homo sapiens
gctctttctcacctcctctcagg

SEQ ID NO: 20877 - DNA, 23 bp, Homo sapiens
tctgatttgtctctggtcagagg

SEQ ID NO: 20878 - DNA, 23 bp, Homo sapiens
acagatgtccgacgctactgggg

SEQ ID NO: 20879 - DNA, 23 bp, Homo sapiens
ggggtaagttatgtgtgtcttgg

SEQ ID NO: 20880 - DNA, 23 bp, Homo sapiens
tgtaagaaggttcaagagcttgg

SEQ ID NO: 20881 - DNA, 23 bp, Homo sapiens
gagcagcccaccaagctgtaggg

SEQ ID NO: 20882 - DNA, 23 bp, Homo sapiens
aagtgactacagcaaaagatagg

SEQ ID NO: 20883 - DNA, 23 bp, Homo sapiens
ggaggtggtgcaggagtaccagg

SEQ ID NO: 20884 - DNA, 23 bp, Homo sapiens
agctcgcaagaggctgaggcagg

SEQ ID NO: 20885 - DNA, 23 bp, Homo sapiens
gcaagaaagcattcacagcaagg

SEQ ID NO: 20886 - DNA, 23 bp, Homo sapiens
gcctttggaggaggtggtgcagg

SEQ ID NO: 20887 - DNA, 23 bp, Homo sapiens
tcaagacgaactctaactcatgg

SEQ ID NO: 20888 - DNA, 23 bp, Homo sapiens
gagcggccggatgggccttaagg

SEQ ID NO: 20889 - DNA, 23 bp, Homo sapiens
agtaatctgcctagcgcttttgg

SEQ ID NO: 20890 - DNA, 23 bp, Homo sapiens
ttcatttagggagttcaaccagg

SEQ ID NO: 20891 - DNA, 23 bp, Homo sapiens
cgttctccggacagttaaagggg

SEQ ID NO: 20892 - DNA, 23 bp, Homo sapiens
tcatctcttacatcagaagcagg

SEQ ID NO: 20893 - DNA, 23 bp, Homo sapiens
actttggtaaacagatagagagg

SEQ ID NO: 20894 - DNA, 23 bp, Homo sapiens
ttcaagagcttggacgacgcagg

SEQ ID NO: 20895 - DNA, 23 bp, Homo sapiens
gagaaaattcaagagcttggtgg

SEQ ID NO: 20896 - DNA, 23 bp, Homo sapiens
tgagcagattttaagaggttcgg

SEQ ID NO: 20897 - DNA, 23 bp, Homo sapiens
cccagctactcaggagccagagg

SEQ ID NO: 20898 - DNA, 23 bp, Homo sapiens
ccttctgcctggactagatgcgg

SEQ ID NO: 20899 - DNA, 23 bp, Homo sapiens
tcattcatccagctccttactgg

SEQ ID NO: 20900 - DNA, 23 bp, Homo sapiens
ctgaggcctttcttttgctttgg

SEQ ID NO: 20901 - DNA, 23 bp, Homo sapiens
ttcagctgagcacctcttcctgg

SEQ ID NO: 20902 - DNA, 23 bp, Homo sapiens
cctggccaacagcatctctcagg

SEQ ID NO: 20903 - DNA, 23 bp, Homo sapiens
ctggggcggccaaagctgtcagg

SEQ ID NO: 20904 - DNA, 23 bp, Homo sapiens
catctgctccctggatggggagg

SEQ ID NO: 20905 - DNA, 23 bp, Homo sapiens
tgtggatgtaagatgtgcaatgg

SEQ ID NO: 20906 - DNA, 23 bp, Homo sapiens
ccccccgtgggacattacagagg

SEQ ID NO: 20907 - DNA, 23 bp, Homo sapiens
cttgcgaatctggccttgagggg

SEQ ID NO: 20908 - DNA, 23 bp, Homo sapiens
ggaaatgcaattagaagacgagg

SEQ ID NO: 20909 - DNA, 23 bp, Homo sapiens
ccgtccggcggctcaggcctcgg

SEQ ID NO: 20910 - DNA, 23 bp, Homo sapiens
ctctctccaaggttattacctgg

SEQ ID NO: 20911 - DNA, 23 bp, Homo sapiens
ctcagacctttcatttgccacgg

SEQ ID NO: 20912 - DNA, 23 bp, Homo sapiens
ttagctcgtcacgtagtgtttgg

SEQ ID NO: 20913 - DNA, 23 bp, Homo sapiens
agcagagcatcaatagcctaagg

SEQ ID NO: 20914 - DNA, 23 bp, Homo sapiens
gaactgcgtggcatctaaagtgg

SEQ ID NO: 20915 - DNA, 23 bp, Homo sapiens
actgaacagccacgtctgagggg

SEQ ID NO: 20916 - DNA, 23 bp, Homo sapiens
ctaacagtagcatcacaagaagg

SEQ ID NO: 20917 - DNA, 23 bp, Homo sapiens
ttctggataggtcaaactctagg

SEQ ID NO: 20918 - DNA, 23 bp, Homo sapiens
cgcctgcaggtctcaaaggtggg

SEQ ID NO: 20919 - DNA, 23 bp, Homo sapiens
gcaacagcctggctgagtagagg

SEQ ID NO: 20920 - DNA, 23 bp, Homo sapiens
gagggggcagcaggttacacagg

SEQ ID NO: 20921 - DNA, 23 bp, Homo sapiens
gggttcaattgagcgtgactcgg

SEQ ID NO: 20922 - DNA, 23 bp, Homo sapiens
gttacctgacaacagtgctgggg

SEQ ID NO: 20923 - DNA, 23 bp, Homo sapiens
ccaaggagctgcaggtagattgg

SEQ ID NO: 20924 - DNA, 23 bp, Homo sapiens
cttgctatgatcaggaaagatgg

SEQ ID NO: 20925 - DNA, 23 bp, Homo sapiens
ccaggccctgtctctggcagtgg

SEQ ID NO: 20926 - DNA, 23 bp, Homo sapiens
tcaagacagcattgaccacgcgg

SEQ ID NO: 20927 - DNA, 23 bp, Homo sapiens
tccatcaaggagcaaagaagggg

SEQ ID NO: 20928 - DNA, 23 bp, Homo sapiens
taggaagactcagcagtcagtgg

SEQ ID NO: 20929 - DNA, 23 bp, Homo sapiens
tgcttagctaatcttcatcttgg

SEQ ID NO: 20930 - DNA, 23 bp, Homo sapiens
gaagcagaagacggaggatgagg

SEQ ID NO: 20931 - DNA, 23 bp, Homo sapiens
gggaggggcgtcatttcaccagg

SEQ ID NO: 20932 - DNA, 23 bp, Homo sapiens
agctcttgatcattctgccctgg

SEQ ID NO: 20933 - DNA, 23 bp, Homo sapiens
ttggtgtctctagggtcttaagg

SEQ ID NO: 20934 - DNA, 23 bp, Homo sapiens
ttattggttcagtctatgcctgg

SEQ ID NO: 20935 - DNA, 23 bp, Homo sapiens
gaaaccaggtaacattagtgtgg

SEQ ID NO: 20936 - DNA, 23 bp, Homo sapiens
tcggaactcagtggaatgatggg

SEQ ID NO: 20937 - DNA, 23 bp, Homo sapiens
gttcccaagagaaaacatactgg

SEQ ID NO: 20938 - DNA, 23 bp, Homo sapiens
actgtttactgctggaagaaagg

SEQ ID NO: 20939 - DNA, 23 bp, Homo sapiens
tcatcaccttcatgttgagcagg

SEQ ID NO: 20940 - DNA, 23 bp, Homo sapiens
tcattcattatggctaaccatgg

SEQ ID NO: 20941 - DNA, 23 bp, Homo sapiens
tcttaattttcattcctgggtgg

SEQ ID NO: 20942 - DNA, 23 bp, Homo sapiens
caacatgctgctgagtgaagagg

SEQ ID NO: 20943 - DNA, 23 bp, Homo sapiens
gagcactggcagcctcagtgcgg

SEQ ID NO: 20944 - DNA, 23 bp, Homo sapiens
cctgtccttcagttggctagagg

SEQ ID NO: 20945 - DNA, 23 bp, Homo sapiens
caccagaaacaactgcttaatgg

SEQ ID NO: 20946 - DNA, 23 bp, Homo sapiens
aagcaagtggctgcagaagatgg

SEQ ID NO: 20947 - DNA, 23 bp, Homo sapiens
ctgcagagccccatctaaccggg

SEQ ID NO: 20948 - DNA, 23 bp, Homo sapiens
tgggaccttcccctcatcctagg

SEQ ID NO: 20949 - DNA, 23 bp, Homo sapiens
aggctgcttatcgagtaaagagg

SEQ ID NO: 20950 - DNA, 23 bp, Homo sapiens
gctcatgaaatcttcttcctcgg

SEQ ID NO: 20951 - DNA, 23 bp, Homo sapiens
acctcttaaaaggcagaggacgg

SEQ ID NO: 20952 - DNA, 23 bp, Homo sapiens
aagggttaagagtcagactctgg

SEQ ID NO: 20953 - DNA, 23 bp, Homo sapiens
caccaagaccccaggctaggggg

SEQ ID NO: 20954 - DNA, 23 bp, Homo sapiens
tggagtactcagttaagttgtgg

SEQ ID NO: 20955 - DNA, 23 bp, Homo sapiens
gatccatctctgtcagagcaagg

SEQ ID NO: 20956 - DNA, 23 bp, Homo sapiens
gctgtcactggggctctcagtgg

SEQ ID NO: 20957 - DNA, 23 bp, Homo sapiens
atccctgccatgatgtagccagg

SEQ ID NO: 20958 - DNA, 23 bp, Homo sapiens
gggcgtggaggtcagcgctgcgg

SEQ ID NO: 20959 - DNA, 23 bp, Homo sapiens
cgagaacagtggaaaaaaagtgg

SEQ ID NO: 20960 - DNA, 23 bp, Homo sapiens
cagctgagggtgtcatgtgatgg

SEQ ID NO: 20961 - DNA, 23 bp, Homo sapiens
ggcttctcgtatggctagtgagg

SEQ ID NO: 20962 - DNA, 23 bp, Homo sapiens
gtgattacaggtacaagccatgg

SEQ ID NO: 20963 - DNA, 23 bp, Homo sapiens
tgtctcatcatggagagccctgg

SEQ ID NO: 20964 - DNA, 23 bp, Homo sapiens
cggctttgatactggagctctgg

SEQ ID NO: 20965 - DNA, 23 bp, Homo sapiens
tctatcatctgggtctgcaatgg

SEQ ID NO: 20966 - DNA, 23 bp, Homo sapiens
tgaggagctaaggctcaagatgg

SEQ ID NO: 20967 - DNA, 23 bp, Homo sapiens
taagggatttacttggctttcgg

SEQ ID NO: 20968 - DNA, 23 bp, Homo sapiens
tcattcacatctcagcatgctgg

SEQ ID NO: 20969 - DNA, 23 bp, Homo sapiens
ttgtggtcacgtaatcttcgtgg

SEQ ID NO: 20970 - DNA, 23 bp, Homo sapiens
catagacagggacttcactgagg

SEQ ID NO: 20971 - DNA, 23 bp, Homo sapiens
atgattagggcttgacttagagg

SEQ ID NO: 20972 - DNA, 23 bp, Homo sapiens
agatcaggctatgttagacatgg

SEQ ID NO: 20973 - DNA, 23 bp, Homo sapiens
atccatggaaccaaatcaagagg

SEQ ID NO: 20974 - DNA, 23 bp, Homo sapiens
gaccacctgagggtgaacaaggg

SEQ ID NO: 20975 - DNA, 23 bp, Homo sapiens
acactagatgttctttacagtgg

SEQ ID NO: 20976 - DNA, 23 bp, Homo sapiens
agactagcattcagtttctgtgg

SEQ ID NO: 20977 - DNA, 23 bp, Homo sapiens
gaaggcagccgctgagttcgggg

SEQ ID NO: 20978 - DNA, 23 bp, Homo sapiens
atactcagaagaaggcgggtagg

SEQ ID NO: 20979 - DNA, 23 bp, Homo sapiens
tgtgcttgctttcaaagctttgg

SEQ ID NO: 20980 - DNA, 23 bp, Homo sapiens
cgccaccccctgacctgcctggg

SEQ ID NO: 20981 - DNA, 23 bp, Homo sapiens
ccaagcagctcaggtgtccgagg

SEQ ID NO: 20982 - DNA, 23 bp, Homo sapiens
tagttgcatatcatcttctgggg

SEQ ID NO: 20983 - DNA, 23 bp, Homo sapiens
agttgattctgattctttggtgg

SEQ ID NO: 20984 - DNA, 23 bp, Homo sapiens
gaggcatcgatttagacaactgg

SEQ ID NO: 20985 - DNA, 23 bp, Homo sapiens
gcataggaacaatgcacaagtgg

SEQ ID NO: 20986 - DNA, 23 bp, Homo sapiens
acagctccagagaaaggaggagg

SEQ ID NO: 20987 - DNA, 23 bp, Homo sapiens
gccgcttccggggagaagtgagg

SEQ ID NO: 20988 - DNA, 23 bp, Homo sapiens
gctgcatctgggccatcagttgg

SEQ ID NO: 20989 - DNA, 23 bp, Homo sapiens
tgggttccgcttctacaccgagg

SEQ ID NO: 20990 - DNA, 23 bp, Homo sapiens
ctgggctgcagtccctagagcgg

SEQ ID NO: 20991 - DNA, 23 bp, Homo sapiens
tagtgagggggatggagaggagg

SEQ ID NO: 20992 - DNA, 23 bp, Homo sapiens
tctggaggacggggagagctggg

SEQ ID NO: 20993 - DNA, 23 bp, Homo sapiens
tggcggccacagtcacagccagg

SEQ ID NO: 20994 - DNA, 23 bp, Homo sapiens
aaaacctgagtctaatgaacagg

SEQ ID NO: 20995 - DNA, 23 bp, Homo sapiens
tggggctggagaggggtgcgggg

SEQ ID NO: 20996 - DNA, 23 bp, Homo sapiens
gagttattgcttcccctcccagg

SEQ ID NO: 20997 - DNA, 23 bp, Homo sapiens
ttcatttactgaattggggcagg

SEQ ID NO: 20998 - DNA, 23 bp, Homo sapiens
actcatcatgaacacagctaagg

SEQ ID NO: 20999 - DNA, 23 bp, Homo sapiens
gacttcaccgagtttgtgtgagg

SEQ ID NO: 21000 - DNA, 23 bp, Homo sapiens
cgggggcataggcagctatgcgg

SEQ ID NO: 21001 - DNA, 23 bp, Homo sapiens
tgtgactgagaaatactctgtgg

SEQ ID NO: 21002 - DNA, 23 bp, Homo sapiens
ctttatgctgaggagacattcgg

SEQ ID NO: 21003 - DNA, 23 bp, Homo sapiens
tggtggttctgcggtgtaagtgg

SEQ ID NO: 21004 - DNA, 23 bp, Homo sapiens
taagggaagggaggctcagacgg

SEQ ID NO: 21005 - DNA, 23 bp, Homo sapiens
aaaacaagcatcaggaaacatgg

SEQ ID NO: 21006 - DNA, 23 bp, Homo sapiens
agagaaatattctgagggtctgg

SEQ ID NO: 21007 - DNA, 23 bp, Homo sapiens
atttatgctgccagaccctcagg

SEQ ID NO: 21008 - DNA, 23 bp, Homo sapiens
caggataagggagatcttgaagg

SEQ ID NO: 21009 - DNA, 23 bp, Homo sapiens
gagaatcgcttaaacccagcagg

SEQ ID NO: 21010 - DNA, 23 bp, Homo sapiens
gatgggtttcttcacgagagagg

SEQ ID NO: 21011 - DNA, 23 bp, Homo sapiens
aggtctctggagttcactgcagg

SEQ ID NO: 21012 - DNA, 23 bp, Homo sapiens
tcaggaggtctcaataaacttgg

SEQ ID NO: 21013 - DNA, 23 bp, Homo sapiens
tcacgttgccccaggatgtgggg

SEQ ID NO: 21014 - DNA, 23 bp, Homo sapiens
aggtgcttagagcagtcaagagg

SEQ ID NO: 21015 - DNA, 23 bp, Homo sapiens
agaggcagcagaaactgaatagg

SEQ ID NO: 21016 - DNA, 23 bp, Homo sapiens
atgcagagggttgatcctttagg

SEQ ID NO: 21017 - DNA, 23 bp, Homo sapiens
ggtatcagagaagtcagtagagg

SEQ ID NO: 21018 - DNA, 23 bp, Homo sapiens
ctaatgatcgatctaggcctcgg

SEQ ID NO: 21019 - DNA, 23 bp, Homo sapiens
ttatctcagggactgcactccgg

SEQ ID NO: 21020 - DNA, 23 bp, Homo sapiens
tcaaaaaggccacggtcatcggg

SEQ ID NO: 21021 - DNA, 23 bp, Homo sapiens
cctcagaagtcttatctggtagg

SEQ ID NO: 21022 - DNA, 23 bp, Homo sapiens
catctaaccccaaagaagcaagg

SEQ ID NO: 21023 - DNA, 23 bp, Homo sapiens
tgccttagcaggcatcatgatgg

SEQ ID NO: 21024 - DNA, 23 bp, Homo sapiens
cctgatctatgtgactgagttgg

SEQ ID NO: 21025 - DNA, 23 bp, Homo sapiens
ttcacagtttgtaacagacgtgg

SEQ ID NO: 21026 - DNA, 23 bp, Homo sapiens
ctaactcagagacatacagaagg

SEQ ID NO: 21027 - DNA, 23 bp, Homo sapiens
ctcagcccctgaacaataaatgg

SEQ ID NO: 21028 - DNA, 23 bp, Homo sapiens
ccacaccatttgtcacaagatgg

SEQ ID NO: 21029 - DNA, 23 bp, Homo sapiens
tgtcacaattacaaggattgtgg

SEQ ID NO: 21030 - DNA, 23 bp, Homo sapiens
agcttgtgttgaaaaataggagg

SEQ ID NO: 21031 - DNA, 23 bp, Homo sapiens
ctccaccttcatcaatgagctgg

SEQ ID NO: 21032 - DNA, 23 bp, Homo sapiens
ggcccttccagggacctcagggg

SEQ ID NO: 21033 - DNA, 23 bp, Homo sapiens
gtagcatcactttcggacagagg

SEQ ID NO: 21034 - DNA, 23 bp, Homo sapiens
acatctgccaacatatgttttgg

SEQ ID NO: 21035 - DNA, 23 bp, Homo sapiens
agagccagagcctgcaagctagg

SEQ ID NO: 21036 - DNA, 23 bp, Homo sapiens
tagattgcagtacagatacatgg

SEQ ID NO: 21037 - DNA, 23 bp, Homo sapiens
tcggggcgtgcgctcagccccgg

SEQ ID NO: 21038 - DNA, 23 bp, Homo sapiens
tccagcggcatttttactaatgg

SEQ ID NO: 21039 - DNA, 23 bp, Homo sapiens
taatacacactttgagatggagg

SEQ ID NO: 21040 - DNA, 23 bp, Homo sapiens
tctcatcaaaggaatgcactagg

SEQ ID NO: 21041 - DNA, 23 bp, Homo sapiens
aaggccggccatcacttctgagg

SEQ ID NO: 21042 - DNA, 23 bp, Homo sapiens
atggcaggctgggccctaattgg

SEQ ID NO: 21043 - DNA, 23 bp, Homo sapiens
gcaggctggtcttgaactgctgg

SEQ ID NO: 21044 - DNA, 23 bp, Homo sapiens
ttgctgctgtttatcaagctggg

SEQ ID NO: 21045 - DNA, 23 bp, Homo sapiens
gctcagggtataaaccacccagg

SEQ ID NO: 21046 - DNA, 23 bp, Homo sapiens
gtggtggcgggagtcttcatggg

SEQ ID NO: 21047 - DNA, 23 bp, Homo sapiens
cttcaggccataccctctactgg

SEQ ID NO: 21048 - DNA, 23 bp, Homo sapiens
ccaaaggtcacatttctgcatgg

SEQ ID NO: 21049 - DNA, 23 bp, Homo sapiens
agtttcgtatcgcacagcagagg

SEQ ID NO: 21050 - DNA, 23 bp, Homo sapiens
ttgagttgtcaactatgcatagg

SEQ ID NO: 21051 - DNA, 23 bp, Homo sapiens
ggatccaaagtctcatagaaagg

SEQ ID NO: 21052 - DNA, 23 bp, Homo sapiens
cagtctgagagaccccgctcagg

SEQ ID NO: 21053 - DNA, 23 bp, Homo sapiens
aggatggattctcagtaccatgg

SEQ ID NO: 21054 - DNA, 23 bp, Homo sapiens
ggcagacacctactgcgcgtagg

SEQ ID NO: 21055 - DNA, 23 bp, Homo sapiens
tcgaagctgtcagggcgagctgg

SEQ ID NO: 21056 - DNA, 23 bp, Homo sapiens
tgggttacactatctcatactgg

SEQ ID NO: 21057 - DNA, 23 bp, Homo sapiens
ttggaagcaagcaactccaaagg

SEQ ID NO: 21058 - DNA, 23 bp, Homo sapiens
aatcagtatgagatggtgtaagg

SEQ ID NO: 21059 - DNA, 23 bp, Homo sapiens
agattcatttgttcccgatctgg

SEQ ID NO: 21060 - DNA, 23 bp, Homo sapiens
aagaagtacgacgcatgagcggg

SEQ ID NO: 21061 - DNA, 23 bp, Homo sapiens
ctgcggctgaggacacgctgagg

SEQ ID NO: 21062 - DNA, 23 bp, Homo sapiens
ggtgggccgggcactcactctgg

SEQ ID NO: 21063 - DNA, 23 bp, Homo sapiens
cccacggagaagagtgactgagg

SEQ ID NO: 21064 - DNA, 23 bp, Homo sapiens
gagaagagtccagtgctagatgg

SEQ ID NO: 21065 - DNA, 23 bp, Homo sapiens
attgcaggggattgcgccacagg

SEQ ID NO: 21066 - DNA, 23 bp, Homo sapiens
gaagagggaacagagacgtcagg

SEQ ID NO: 21067 - DNA, 23 bp, Homo sapiens
agggcaaatgttaaccagactgg

SEQ ID NO: 21068 - DNA, 23 bp, Homo sapiens
aaaaggggaaaacccttatccgg

SEQ ID NO: 21069 - DNA, 23 bp, Homo sapiens
aggacagagattagccagactgg

SEQ ID NO: 21070 - DNA, 23 bp, Homo sapiens
gagacttgtgcaggatcagttgg

SEQ ID NO: 21071 - DNA, 23 bp, Homo sapiens
aaggcaaaggttaaccacactgg

SEQ ID NO: 21072 - DNA, 23 bp, Homo sapiens
ctcaagggggcatggagtaatgg

SEQ ID NO: 21073 - DNA, 23 bp, Homo sapiens
cccatttgagttcaggggtgagg

SEQ ID NO: 21074 - DNA, 23 bp, Homo sapiens
gtccggagaaaaaaatgagtggg

SEQ ID NO: 21075 - DNA, 23 bp, Homo sapiens
agaaacggcagagagactgaggg

SEQ ID NO: 21076 - DNA, 23 bp, Homo sapiens
ccaggtgctgaggtctgagaggg

SEQ ID NO: 21077 - DNA, 23 bp, Homo sapiens
ctgggccgcaagaagctcactgg

SEQ ID NO: 21078 - DNA, 23 bp, Homo sapiens
acatctccggagctgaggtgggg

SEQ ID NO: 21079 - DNA, 23 bp, Homo sapiens
tatcaagtgcttgctagccatgg

SEQ ID NO: 21080 - DNA, 23 bp, Homo sapiens
ttttcaggtcgtaatttgcaagg

SEQ ID NO: 21081 - DNA, 23 bp, Homo sapiens
ggaaccacccggcttctagccgg

SEQ ID NO: 21082 - DNA, 23 bp, Homo sapiens
gtcccagggaaagtctgagaagg

SEQ ID NO: 21083 - DNA, 23 bp, Homo sapiens
ctgtcttccagcttcacttccgg

SEQ ID NO: 21084 - DNA, 23 bp, Homo sapiens
ctgctagctgggaggtgatgggg

SEQ ID NO: 21085 - DNA, 23 bp, Homo sapiens
ttggagaaagagagttaggcagg

SEQ ID NO: 21086 - DNA, 23 bp, Homo sapiens
ggtgctgctcacataagcactgg

SEQ ID NO: 21087 - DNA, 23 bp, Homo sapiens
aaaacactagctgtcagatttgg

SEQ ID NO: 21088 - DNA, 23 bp, Homo sapiens
gagcagcgggcgtcattatctgg

SEQ ID NO: 21089 - DNA, 23 bp, Homo sapiens
agccagtaaactcagcagatagg

SEQ ID NO: 21090 - DNA, 23 bp, Homo sapiens
gaaattgatggagtacgagccgg

SEQ ID NO: 21091 - DNA, 23 bp, Homo sapiens
tcgtagagttgagaatttctagg

SEQ ID NO: 21092 - DNA, 23 bp, Homo sapiens
tagagtttcttaagacaacgtgg

SEQ ID NO: 21093 - DNA, 23 bp, Homo sapiens
cataaacctaagcctacccgtgg

SEQ ID NO: 21094 - DNA, 23 bp, Homo sapiens
ctacttagtgcatcttcttctgg

SEQ ID NO: 21095 - DNA, 23 bp, Homo sapiens
tgagacttttaaagatgcagagg

SEQ ID NO: 21096 - DNA, 23 bp, Homo sapiens
ctactatgaagctgtctgaaggg

SEQ ID NO: 21097 - DNA, 23 bp, Homo sapiens
acttaatgctgaagaagggacgg

SEQ ID NO: 21098 - DNA, 23 bp, Homo sapiens
ttatgtctatggcactttcctgg

SEQ ID NO: 21099 - DNA, 23 bp, Homo sapiens
agcttgacagaatttgtcaaagg

SEQ ID NO: 21100 - DNA, 23 bp, Homo sapiens
aggtccctgaggccctagctggg

SEQ ID NO: 21101 - DNA, 23 bp, Homo sapiens
ttcaaggtcttaaagacgcacgg

SEQ ID NO: 21102 - DNA, 23 bp, Homo sapiens
cgccgggctgtctcattctaggg

SEQ ID NO: 21103 - DNA, 23 bp, Homo sapiens
tgggtgtagtggctcacacctgg

SEQ ID NO: 21104 - DNA, 23 bp, Homo sapiens
cccggcacaacagcagactgagg

SEQ ID NO: 21105 - DNA, 23 bp, Homo sapiens
tgtccaaaatggagaaaaacagg

SEQ ID NO: 21106 - DNA, 23 bp, Homo sapiens
cagaggagacccatggagtcggg

SEQ ID NO: 21107 - DNA, 23 bp, Homo sapiens
aacaggaaatgagatggaaaagg

SEQ ID NO: 21108 - DNA, 23 bp, Homo sapiens
actgaggaaaaccaactacgtgg

SEQ ID NO: 21109 - DNA, 23 bp, Homo sapiens
aggactgaactcagtcaagacgg

SEQ ID NO: 21110 - DNA, 23 bp, Homo sapiens
ctccatttactgagaagcacagg

SEQ ID NO: 21111 - DNA, 23 bp, Homo sapiens
gacgctggcgctattttagatgg

SEQ ID NO: 21112 - DNA, 23 bp, Homo sapiens
gatttcgaaactggttgcttagg

SEQ ID NO: 21113 - DNA, 23 bp, Homo sapiens
atgctttagcatttggaagaagg

SEQ ID NO: 21114 - DNA, 23 bp, Homo sapiens
aacgtttggaagaactcagtagg

SEQ ID NO: 21115 - DNA, 23 bp, Homo sapiens
agctgccttcctgctcttctagg

SEQ ID NO: 21116 - DNA, 23 bp, Homo sapiens
catgcattctttcttcttcgagg

SEQ ID NO: 21117 - DNA, 23 bp, Homo sapiens
atacagtcacatatgagtctagg

SEQ ID NO: 21118 - DNA, 23 bp, Homo sapiens
ctgtctcaggccagatgaggggg

SEQ ID NO: 21119 - DNA, 23 bp, Homo sapiens
aaagtagcatcttgaaatccagg

SEQ ID NO: 21120 - DNA, 23 bp, Homo sapiens
tcctatgcatactgcttcatcgg

SEQ ID NO: 21121 - DNA, 23 bp, Homo sapiens
gggaggcatcctcaggctgctgg

SEQ ID NO: 21122 - DNA, 23 bp, Homo sapiens
cccgggtccgcggcgctcagcgg

SEQ ID NO: 21123 - DNA, 23 bp, Homo sapiens
tcatggagatacaagagcattgg

SEQ ID NO: 21124 - DNA, 23 bp, Homo sapiens
ccaggctggctcactgcatgagg

SEQ ID NO: 21125 - DNA, 23 bp, Homo sapiens
aactgctgcacaaagctacaagg

SEQ ID NO: 21126 - DNA, 23 bp, Homo sapiens
acatcgtgctcccactgtgtagg

SEQ ID NO: 21127 - DNA, 23 bp, Homo sapiens
ttcaagttctgatcaatctgagg

SEQ ID NO: 21128 - DNA, 23 bp, Homo sapiens
gtgttccgggtctgtcactgagg

SEQ ID NO: 21129 - DNA, 23 bp, Homo sapiens
ttcagacagtgtaatagttgggg

SEQ ID NO: 21130 - DNA, 23 bp, Homo sapiens
cctggcttagtcatcgtatctgg

SEQ ID NO: 21131 - DNA, 23 bp, Homo sapiens
gtcaaaggtcattcacactgtgg

SEQ ID NO: 21132 - DNA, 23 bp, Homo sapiens
agtcttcaagatcaagtgcttgg

SEQ ID NO: 21133 - DNA, 23 bp, Homo sapiens
gcagcgtcgtcagagctctctgg

SEQ ID NO: 21134 - DNA, 23 bp, Homo sapiens
atcccccgcgtgctctgagcagg

SEQ ID NO: 21135 - DNA, 23 bp, Homo sapiens
ttaaatgttgtgtgtccacatgg

SEQ ID NO: 21136 - DNA, 23 bp, Homo sapiens
gaaaaagaagccatgtaaccagg

SEQ ID NO: 21137 - DNA, 23 bp, Homo sapiens
actcgggatgtaattggctgagg

SEQ ID NO: 21138 - DNA, 23 bp, Homo sapiens
cagctctacctgggcatgtttgg

SEQ ID NO: 21139 - DNA, 23 bp, Homo sapiens
caaggccggtggatcatctgagg

SEQ ID NO: 21140 - DNA, 23 bp, Homo sapiens
caggaggttagatgccaaaaagg

SEQ ID NO: 21141 - DNA, 23 bp, Homo sapiens
caacgtgctccagctgctcaagg

SEQ ID NO: 21142 - DNA, 23 bp, Homo sapiens
tctgaaggcgcaccctacaatgg

SEQ ID NO: 21143 - DNA, 23 bp, Homo sapiens
gcagctttcaaaatggagttagg

SEQ ID NO: 21144 - DNA, 23 bp, Homo sapiens
cctctgtcacagcttgatgaagg

SEQ ID NO: 21145 - DNA, 23 bp, Homo sapiens
tccaggtgggactcacttccagg

SEQ ID NO: 21146 - DNA, 23 bp, Homo sapiens
ctgagaacgcgaggccctagggg

SEQ ID NO: 21147 - DNA, 23 bp, Homo sapiens
gagggatctcactcccagactgg

SEQ ID NO: 21148 - DNA, 23 bp, Homo sapiens
ccagacataccctgtcctgaggg

SEQ ID NO: 21149 - DNA, 23 bp, Homo sapiens
agggctctctggcttcgtgtagg

SEQ ID NO: 21150 - DNA, 23 bp, Homo sapiens
ggacagcgagtgcctagacaagg

SEQ ID NO: 21151 - DNA, 23 bp, Homo sapiens
tcattagtttctggagctcttgg

SEQ ID NO: 21152 - DNA, 23 bp, Homo sapiens
gggtccacagcaagagcctgagg

SEQ ID NO: 21153 - DNA, 23 bp, Homo sapiens
tttggagagaggccagttatggg

SEQ ID NO: 21154 - DNA, 23 bp, Homo sapiens
agagctggtgatgggcacaaagg

SEQ ID NO: 21155 - DNA, 23 bp, Homo sapiens
ctggccaaaaaggatgtgagagg

SEQ ID NO: 21156 - DNA, 23 bp, Homo sapiens
cttcccttctgtttcacagatgg

SEQ ID NO: 21157 - DNA, 23 bp, Homo sapiens
cgtccgccgcccggaggaaaagg

SEQ ID NO: 21158 - DNA, 23 bp, Homo sapiens
cctggcagctggggatcaactgg

SEQ ID NO: 21159 - DNA, 23 bp, Homo sapiens
agctacaaacaaatcaggaatgg

SEQ ID NO: 21160 - DNA, 23 bp, Homo sapiens
agggcacaggccctcttaaatgg

SEQ ID NO: 21161 - DNA, 23 bp, Homo sapiens
tggaggacatttgtcaggaatgg

SEQ ID NO: 21162 - DNA, 23 bp, Homo sapiens
ctgggggacgggctagtagcagg

SEQ ID NO: 21163 - DNA, 23 bp, Homo sapiens
tcaccaatcccaaggaatgaggg

SEQ ID NO: 21164 - DNA, 23 bp, Homo sapiens
gcccaggcaggctgggttagtgg

SEQ ID NO: 21165 - DNA, 23 bp, Homo sapiens
aatccaagcgctttgtgcagtgg

SEQ ID NO: 21166 - DNA, 23 bp, Homo sapiens
cccccgaaagtctgttaggctgg

SEQ ID NO: 21167 - DNA, 23 bp, Homo sapiens
ggctgccgggcgcggtctagtgg

SEQ ID NO: 21168 - DNA, 23 bp, Homo sapiens
gcaagctggcgtgcgagtagagg

SEQ ID NO: 21169 - DNA, 23 bp, Homo sapiens
agagggtgaggaagaaggagagg

SEQ ID NO: 21170 - DNA, 23 bp, Homo sapiens
agtgctgacggagaggatgaggg

SEQ ID NO: 21171 - DNA, 23 bp, Homo sapiens
agaaggtgaagaatactgagggg

SEQ ID NO: 21172 - DNA, 23 bp, Homo sapiens
agaaggcgaagaatactgagggg

SEQ ID NO: 21173 - DNA, 23 bp, Homo sapiens
tcctatgaggacgaggatgaggg

SEQ ID NO: 21174 - DNA, 23 bp, Homo sapiens
tgaagaagaaaatgaaggggagg

SEQ ID NO: 21175 - DNA, 23 bp, Homo sapiens
gaagtggcgcaaagtttctgagg

SEQ ID NO: 21176 - DNA, 23 bp, Homo sapiens
gaggccgaagaggaggcctaagg

SEQ ID NO: 21177 - DNA, 23 bp, Homo sapiens
gaaatggagccagaagataaggg

SEQ ID NO: 21178 - DNA, 23 bp, Homo sapiens
ggaggaggagggcgaggacgagg

SEQ ID NO: 21179 - DNA, 23 bp, Homo sapiens
cagctgcgagcagcttcacttgg

SEQ ID NO: 21180 - DNA, 23 bp, Homo sapiens
ggcggaggaggaggtggcctagg

SEQ ID NO: 21181 - DNA, 23 bp, Homo sapiens
ggaggaggctgaggaggaggtgg

SEQ ID NO: 21182 - DNA, 23 bp, Homo sapiens
agaggagatcgatggatagtcgg

SEQ ID NO: 21183 - DNA, 23 bp, Homo sapiens
caggggaactgaggagaaacagg

SEQ ID NO: 21184 - DNA, 23 bp, Homo sapiens
ggagtatgccgaggaggaggtgg

SEQ ID NO: 21185 - DNA, 23 bp, Homo sapiens
agatcagagattacagtaactgg

SEQ ID NO: 21186 - DNA, 23 bp, Homo sapiens
tcacatagctatgcttagtctgg

SEQ ID NO: 21187 - DNA, 23 bp, Homo sapiens
cctgggggactcactgctcctgg

SEQ ID NO: 21188 - DNA, 23 bp, Homo sapiens
gggagggaaatcactgctcctgg

SEQ ID NO: 21189 - DNA, 23 bp, Homo sapiens
cacagccagggctcactgtgcgg

SEQ ID NO: 21190 - DNA, 23 bp, Homo sapiens
aggaccgcgagcttcacgtgtgg

SEQ ID NO: 21191 - DNA, 23 bp, Homo sapiens
cgggacttcaaacgcagtatagg

SEQ ID NO: 21192 - DNA, 23 bp, Homo sapiens
tgtttcagaactcgtttgtaggg

SEQ ID NO: 21193 - DNA, 23 bp, Homo sapiens
acccaggctggtggaactctggg

SEQ ID NO: 21194 - DNA, 23 bp, Homo sapiens
gatatactcacaatggggaaagg

SEQ ID NO: 21195 - DNA, 23 bp, Homo sapiens
ggtcggtaatcccagcattttgg

SEQ ID NO: 21196 - DNA, 23 bp, Homo sapiens
gttgtcactcatggctggcatgg

SEQ ID NO: 21197 - DNA, 23 bp, Homo sapiens
aactactaccaggacgcctgagg

SEQ ID NO: 21198 - DNA, 23 bp, Homo sapiens
aggaggagaagaatatcaaatgg

SEQ ID NO: 21199 - DNA, 23 bp, Homo sapiens
cagctcaggtttccaccactcgg

SEQ ID NO: 21200 - DNA, 23 bp, Homo sapiens
gggctgctggggtcactcgcagg

SEQ ID NO: 21201 - DNA, 23 bp, Homo sapiens
agccagcttctaattgaaactgg

SEQ ID NO: 21202 - DNA, 23 bp, Homo sapiens
cacatcagataagcatgtgaagg

SEQ ID NO: 21203 - DNA, 23 bp, Homo sapiens
ttctagctttgacagtaagctgg

SEQ ID NO: 21204 - DNA, 23 bp, Homo sapiens
atgcagtttggacggattgatgg

SEQ ID NO: 21205 - DNA, 23 bp, Homo sapiens
cacaccagtctcttcatttgagg

SEQ ID NO: 21206 - DNA, 23 bp, Homo sapiens
ctgcggcctcggctacagccagg

SEQ ID NO: 21207 - DNA, 23 bp, Homo sapiens
cccagggtcacacctcatagagg

SEQ ID NO: 21208 - DNA, 23 bp, Homo sapiens
atatttcgttccaagtaccacgg

SEQ ID NO: 21209 - DNA, 23 bp, Homo sapiens
ggctccgtctggtgctgcttagg

SEQ ID NO: 21210 - DNA, 23 bp, Homo sapiens
ttgagatgtcgaattgcttgagg

SEQ ID NO: 21211 - DNA, 23 bp, Homo sapiens
gctggagattcaccagcattagg

SEQ ID NO: 21212 - DNA, 23 bp, Homo sapiens
agcatggctacttcatattttgg

SEQ ID NO: 21213 - DNA, 23 bp, Homo sapiens
tcttctccttcagagtaaagtgg

SEQ ID NO: 21214 - DNA, 23 bp, Homo sapiens
ccaaaatttcatctggcatccgg

SEQ ID NO: 21215 - DNA, 23 bp, Homo sapiens
ctccttcacagtaaagtggctgg

SEQ ID NO: 21216 - DNA, 23 bp, Homo sapiens
gtagtagcttcagtttccgctgg

SEQ ID NO: 21217 - DNA, 23 bp, Homo sapiens
aaatggggatgacagctaggagg

SEQ ID NO: 21218 - DNA, 23 bp, Homo sapiens
tggggggctccgcctgctagtgg

SEQ ID NO: 21219 - DNA, 23 bp, Homo sapiens
ggtgggtggcgcggcgctagtgg

SEQ ID NO: 21220 - DNA, 23 bp, Homo sapiens
tttggtgagcatttcaaaggtgg

SEQ ID NO: 21221 - DNA, 23 bp, Homo sapiens
caaagcttgagctccgctaaagg

SEQ ID NO: 21222 - DNA, 23 bp, Homo sapiens
cctccaagcgttcaaagtgaagg

SEQ ID NO: 21223 - DNA, 23 bp, Homo sapiens
ggtccagaatgtattgactatgg

SEQ ID NO: 21224 - DNA, 23 bp, Homo sapiens
gattgcggaaacctggtgaccgg

SEQ ID NO: 21225 - DNA, 23 bp, Homo sapiens
acaccaggctctctaggccctgg

SEQ ID NO: 21226 - DNA, 23 bp, Homo sapiens
gtggctgacaccaatctggaagg

SEQ ID NO: 21227 - DNA, 23 bp, Homo sapiens
ctctgctccggccatcgagtcgg

SEQ ID NO: 21228 - DNA, 23 bp, Homo sapiens
ggcttcaagcttttccttattgg

SEQ ID NO: 21229 - DNA, 23 bp, Homo sapiens
gccttcctgaagaagctgattgg

SEQ ID NO: 21230 - DNA, 23 bp, Homo sapiens
ctgaaaggaataaggagaacagg

SEQ ID NO: 21231 - DNA, 23 bp, Homo sapiens
gaagctcaggaaaggctgacggg

SEQ ID NO: 21232 - DNA, 23 bp, Homo sapiens
aggacaagagcaggaacatgtgg

SEQ ID NO: 21233 - DNA, 23 bp, Homo sapiens
agatgtgcaggagaatgataagg

SEQ ID NO: 21234 - DNA, 23 bp, Homo sapiens
cagagaacaacatttccaccagg

SEQ ID NO: 21235 - DNA, 23 bp, Homo sapiens
tgaactttgcggcgcccttaagg

SEQ ID NO: 21236 - DNA, 23 bp, Homo sapiens
ccaagcgaaagacgaactttagg

SEQ ID NO: 21237 - DNA, 23 bp, Homo sapiens
aggactttgcttaagcagctagg

SEQ ID NO: 21238 - DNA, 23 bp, Homo sapiens
tgcagatgatggaaatgagtagg

SEQ ID NO: 21239 - DNA, 23 bp, Homo sapiens
ctggaaaagaaaactatccgagg

SEQ ID NO: 21240 - DNA, 23 bp, Homo sapiens
ctcactgcacattgttgttgagg

SEQ ID NO: 21241 - DNA, 23 bp, Homo sapiens
cagtgtcttttgtaccttagtgg

SEQ ID NO: 21242 - DNA, 23 bp, Homo sapiens
tccaccaagtaccgctactgagg

SEQ ID NO: 21243 - DNA, 23 bp, Homo sapiens
ctctccttttgtcttattcctgg

SEQ ID NO: 21244 - DNA, 23 bp, Homo sapiens
tcttgggatcaataggactttgg

SEQ ID NO: 21245 - DNA, 23 bp, Homo sapiens
atcctccaggctggctgctgagg

SEQ ID NO: 21246 - DNA, 23 bp, Homo sapiens
aaccagagaagagactgagacgg

SEQ ID NO: 21247 - DNA, 23 bp, Homo sapiens
ccacggtgacaggctgctgaggg

SEQ ID NO: 21248 - DNA, 23 bp, Homo sapiens
atcactcagaaaggctgctgagg

SEQ ID NO: 21249 - DNA, 23 bp, Homo sapiens
agaaaggatgatgtttgcccagg

SEQ ID NO: 21250 - DNA, 23 bp, Homo sapiens
tcagtgttcagcgtgtgctgagg

SEQ ID NO: 21251 - DNA, 23 bp, Homo sapiens
gcaaaggagctttattgctgcgg

SEQ ID NO: 21252 - DNA, 23 bp, Homo sapiens
tccgcatccaactattaaaatgg

SEQ ID NO: 21253 - DNA, 23 bp, Homo sapiens
cctccgctgcggcgtcaggaagg

SEQ ID NO: 21254 - DNA, 23 bp, Homo sapiens
aatggctctgatacaagctgtgg

SEQ ID NO: 21255 - DNA, 23 bp, Homo sapiens
gtgggctaacagctactgtgtgg

SEQ ID NO: 21256 - DNA, 23 bp, Homo sapiens
attcgggctcatttgtaatacgg

SEQ ID NO: 21257 - DNA, 23 bp, Homo sapiens
ccagaatcctaatcagtctgtgg

SEQ ID NO: 21258 - DNA, 23 bp, Homo sapiens
gccccgcggagcaagctctgagg

SEQ ID NO: 21259 - DNA, 23 bp, Homo sapiens
caacacccgggacaataatacgg

SEQ ID NO: 21260 - DNA, 23 bp, Homo sapiens
tctctgatgtcttgtgtccttgg

SEQ ID NO: 21261 - DNA, 23 bp, Homo sapiens
accaaagcttagtaatcttcagg

SEQ ID NO: 21262 - DNA, 23 bp, Homo sapiens
ttactcagagttcttgctgtagg

SEQ ID NO: 21263 - DNA, 23 bp, Homo sapiens
cgagagatcgtgaaagatctggg

SEQ ID NO: 21264 - DNA, 23 bp, Homo sapiens
acagattacattatggagcccgg

SEQ ID NO: 21265 - DNA, 23 bp, Homo sapiens
cactggcatggccgcttctgagg

SEQ ID NO: 21266 - DNA, 23 bp, Homo sapiens
accgccgggacttctggtagagg

SEQ ID NO: 21267 - DNA, 23 bp, Homo sapiens
gactttttatgagacctgtgtgg

SEQ ID NO: 21268 - DNA, 23 bp, Homo sapiens
agatcatacaaatgcggcagggg

SEQ ID NO: 21269 - DNA, 23 bp, Homo sapiens
gttcatgagctggtgaaaaatgg

SEQ ID NO: 21270 - DNA, 23 bp, Homo sapiens
ggccagggagccgcagctgcagg

SEQ ID NO: 21271 - DNA, 23 bp, Homo sapiens
agaggagcagacggggtcagcgg

SEQ ID NO: 21272 - DNA, 23 bp, Homo sapiens
gaggtcacgtatagaacagaagg

SEQ ID NO: 21273 - DNA, 23 bp, Homo sapiens
agtttgaatagtacagtctgtgg

SEQ ID NO: 21274 - DNA, 23 bp, Homo sapiens
tattcttcattttggccatgagg

SEQ ID NO: 21275 - DNA, 23 bp, Homo sapiens
aagaagaaggtcaaataaggtgg

SEQ ID NO: 21276 - DNA, 23 bp, Homo sapiens
acagaaaaactagccaggcgtgg

SEQ ID NO: 21277 - DNA, 23 bp, Homo sapiens
tgactgaagtagtatcttactgg

SEQ ID NO: 21278 - DNA, 23 bp, Homo sapiens
ctgcactatgagctgtgacaagg

SEQ ID NO: 21279 - DNA, 23 bp, Homo sapiens
gacactaaatcgcacgtaggtgg

SEQ ID NO: 21280 - DNA, 23 bp, Homo sapiens
gggactatcagtgctgcagcagg

SEQ ID NO: 21281 - DNA, 23 bp, Homo sapiens
ccatggaggcagagagataaggg

SEQ ID NO: 21282 - DNA, 23 bp, Homo sapiens
gcggcgtccagtctcatctctgg

SEQ ID NO: 21283 - DNA, 23 bp, Homo sapiens
aggcagggcctggtctcagctgg

SEQ ID NO: 21284 - DNA, 23 bp, Homo sapiens
tggagtgcctccgtggtcactgg

SEQ ID NO: 21285 - DNA, 23 bp, Homo sapiens
tgggtttagtttgtccagtatgg

SEQ ID NO: 21286 - DNA, 23 bp, Homo sapiens
aagagggtcagggcctcagttgg

SEQ ID NO: 21287 - DNA, 23 bp, Homo sapiens
aatttcgtcgatgaccagcttgg

SEQ ID NO: 21288 - DNA, 23 bp, Homo sapiens
tggacggctgagagctaatttgg

SEQ ID NO: 21289 - DNA, 23 bp, Homo sapiens
aactggaggaactggatctcagg

SEQ ID NO: 21290 - DNA, 23 bp, Homo sapiens
agaggaaggaaaatgggagttgg

SEQ ID NO: 21291 - DNA, 23 bp, Homo sapiens
tgtggtttattcttgaagcaagg

SEQ ID NO: 21292 - DNA, 23 bp, Homo sapiens
ctggtcctgcgcctgaggggtgg

SEQ ID NO: 21293 - DNA, 23 bp, Homo sapiens
ttggtcctgcgcttgaggggggg

SEQ ID NO: 21294 - DNA, 23 bp, Homo sapiens
tggcatgttattgtattggaggg

SEQ ID NO: 21295 - DNA, 23 bp, Homo sapiens
ctgcaatagtagaacaaagctgg

SEQ ID NO: 21296 - DNA, 23 bp, Homo sapiens
cggccattgttgaacaaagctgg

SEQ ID NO: 21297 - DNA, 23 bp, Homo sapiens
gcagcctgggtcagggctcctgg

SEQ ID NO: 21298 - DNA, 23 bp, Homo sapiens
tcggcagcatgtgtgttcaaggg

SEQ ID NO: 21299 - DNA, 23 bp, Homo sapiens
acaacagacatgcaagagaatgg

SEQ ID NO: 21300 - DNA, 23 bp, Homo sapiens
acaacagaatagctcgggaatgg

SEQ ID NO: 21301 - DNA, 23 bp, Homo sapiens
gactttaaggtagcatcacatgg

SEQ ID NO: 21302 - DNA, 23 bp, Homo sapiens
agagaaatacgctatgttgtagg

SEQ ID NO: 21303 - DNA, 23 bp, Homo sapiens
acaacagactagcaagagagtgg

SEQ ID NO: 21304 - DNA, 23 bp, Homo sapiens
gtatctcttggtccactgtctgg

SEQ ID NO: 21305 - DNA, 23 bp, Homo sapiens
gcaggcagcaggcccctatgtgg

SEQ ID NO: 21306 - DNA, 23 bp, Homo sapiens
aatcgtccccttttatcatctgg

SEQ ID NO: 21307 - DNA, 23 bp, Homo sapiens
gtcactcaaaagcagtctcttgg

SEQ ID NO: 21308 - DNA, 23 bp, Homo sapiens
cagatcgtccagaagtctctggg

SEQ ID NO: 21309 - DNA, 23 bp, Homo sapiens
tctactacaactccatatcctgg

SEQ ID NO: 21310 - DNA, 23 bp, Homo sapiens
ccacaaggtcgctgcttatgagg

SEQ ID NO: 21311 - DNA, 23 bp, Homo sapiens
cgtttgccagatatattcgtcgg

SEQ ID NO: 21312 - DNA, 23 bp, Homo sapiens
aggagcatcgcgcaggagtgagg

SEQ ID NO: 21313 - DNA, 23 bp, Homo sapiens
gaattgcttctgagtaactgagg

SEQ ID NO: 21314 - DNA, 23 bp, Homo sapiens
cgtggcagattttagtccacagg

SEQ ID NO: 21315 - DNA, 23 bp, Homo sapiens
gggtcagaacatgagttaggagg

SEQ ID NO: 21316 - DNA, 23 bp, Homo sapiens
tttgagcgctgcctgaaataggg

SEQ ID NO: 21317 - DNA, 23 bp, Homo sapiens
aaacagctagagcatggactagg

SEQ ID NO: 21318 - DNA, 23 bp, Homo sapiens
aggcatgccggagtgcacagagg

SEQ ID NO: 21319 - DNA, 23 bp, Homo sapiens
tacacacccccaaaagaagacgg

SEQ ID NO: 21320 - DNA, 23 bp, Homo sapiens
tacacccctccaaaggaagatgg

SEQ ID NO: 21321 - DNA, 23 bp, Homo sapiens
ctaaggagaacagttcggtgagg

SEQ ID NO: 21322 - DNA, 23 bp, Homo sapiens
acgtggcagacatcagccgtcgg

SEQ ID NO: 21323 - DNA, 23 bp, Homo sapiens
tgatgatgattctgggaatgagg

SEQ ID NO: 21324 - DNA, 23 bp, Homo sapiens
ggcgctgcggcggctgtagtggg

SEQ ID NO: 21325 - DNA, 23 bp, Homo sapiens
ggacaagtcccctaaacatcagg

SEQ ID NO: 21326 - DNA, 23 bp, Homo sapiens
atctacagcatcagaaagaatgg

SEQ ID NO: 21327 - DNA, 23 bp, Homo sapiens
attgctgtaacactgtccttcgg

SEQ ID NO: 21328 - DNA, 23 bp, Homo sapiens
ttggctggcattatgaagactgg

SEQ ID NO: 21329 - DNA, 23 bp, Homo sapiens
ttgttgtatgtttgtccttctgg

SEQ ID NO: 21330 - DNA, 23 bp, Homo sapiens
tagcatgctttccagctgcaagg

SEQ ID NO: 21331 - DNA, 23 bp, Homo sapiens
ggagcagggtctaaaccctcagg

SEQ ID NO: 21332 - DNA, 23 bp, Homo sapiens
atcacgtatgccaaaggatttgg

SEQ ID NO: 21333 - DNA, 23 bp, Homo sapiens
actggcagttgtctcgctagagg

SEQ ID NO: 21334 - DNA, 23 bp, Homo sapiens
tacgccatcagcatgaacacggg

SEQ ID NO: 21335 - DNA, 23 bp, Homo sapiens
tcagctcagctcaaagccagcgg

SEQ ID NO: 21336 - DNA, 23 bp, Homo sapiens
tcgccgtgtgaattcctttcagg

SEQ ID NO: 21337 - DNA, 23 bp, Homo sapiens
tgcagagaggaaacaacaaaagg

SEQ ID NO: 21338 - DNA, 23 bp, Homo sapiens
tgaaagagcagattcaggcgtgg

SEQ ID NO: 21339 - DNA, 23 bp, Homo sapiens
aagacactgtgctggggaaatgg

SEQ ID NO: 21340 - DNA, 23 bp, Homo sapiens
atgtgggcactctgcttcagtgg

SEQ ID NO: 21341 - DNA, 23 bp, Homo sapiens
cagtctgcccaaaatttaagggg

SEQ ID NO: 21342 - DNA, 23 bp, Homo sapiens
tctgcttcagtggctagatgagg

SEQ ID NO: 21343 - DNA, 23 bp, Homo sapiens
actaggcagacagtgtttacagg

SEQ ID NO: 21344 - DNA, 23 bp, Homo sapiens
catgctccgagaattctatttgg

SEQ ID NO: 21345 - DNA, 23 bp, Homo sapiens
gcagcagctgatcagtaaacggg

SEQ ID NO: 21346 - DNA, 23 bp, Homo sapiens
aatccacgatgggatgaacctgg

SEQ ID NO: 21347 - DNA, 23 bp, Homo sapiens
aggggaagcagggagttcatggg

SEQ ID NO: 21348 - DNA, 23 bp, Homo sapiens
agatatctctcaaagaagcaagg

SEQ ID NO: 21349 - DNA, 23 bp, Homo sapiens
tgaagcggtcacaatttccgtgg

SEQ ID NO: 21350 - DNA, 23 bp, Homo sapiens
ggcagtcactgagatttccgtgg

SEQ ID NO: 21351 - DNA, 23 bp, Homo sapiens
ggaggtcagtcactcagaagtgg

SEQ ID NO: 21352 - DNA, 23 bp, Homo sapiens
gggagcgttgcttctcacccagg

SEQ ID NO: 21353 - DNA, 23 bp, Homo sapiens
aacaagaatgtgaataccggtgg

SEQ ID NO: 21354 - DNA, 23 bp, Homo sapiens
atacagaaatgctgctatgatgg

SEQ ID NO: 21355 - DNA, 23 bp, Homo sapiens
agaaatgtgattacgatggctgg

SEQ ID NO: 21356 - DNA, 23 bp, Homo sapiens
ggagaagctgagacagtcgtagg

SEQ ID NO: 21357 - DNA, 23 bp, Homo sapiens
ggccgagggattaggagagctgg

SEQ ID NO: 21358 - DNA, 23 bp, Homo sapiens
ttctgatctgcttagtgcttagg

SEQ ID NO: 21359 - DNA, 23 bp, Homo sapiens
atcggaagctccatttggtctgg

SEQ ID NO: 21360 - DNA, 23 bp, Homo sapiens
tgccttggctaggattacagagg

SEQ ID NO: 21361 - DNA, 23 bp, Homo sapiens
agacactggttggcattgactgg

SEQ ID NO: 21362 - DNA, 23 bp, Homo sapiens
gatggggtccacattacaatggg

SEQ ID NO: 21363 - DNA, 23 bp, Homo sapiens
agctgctgtgtggtggtcagggg

SEQ ID NO: 21364 - DNA, 23 bp, Homo sapiens
atctgtttagaggaatagagtgg

SEQ ID NO: 21365 - DNA, 23 bp, Homo sapiens
cagtattactgcagctagagtgg

SEQ ID NO: 21366 - DNA, 23 bp, Homo sapiens
cccaccaccccaggactgatggg

SEQ ID NO: 21367 - DNA, 23 bp, Homo sapiens
ggctcagttcagttctccactgg

SEQ ID NO: 21368 - DNA, 23 bp, Homo sapiens
gggtggggctgagcctcagttgg

SEQ ID NO: 21369 - DNA, 23 bp, Homo sapiens
aactcttcagactgcagcagtgg

SEQ ID NO: 21370 - DNA, 23 bp, Homo sapiens
aggagggatgcaaagagaagggg

SEQ ID NO: 21371 - DNA, 23 bp, Homo sapiens
atgggacaaaggccctcagctgg

SEQ ID NO: 21372 - DNA, 23 bp, Homo sapiens
cactggaagatggggaagggtgg

SEQ ID NO: 21373 - DNA, 23 bp, Homo sapiens
tgagggggcgggtgctttattgg

SEQ ID NO: 21374 - DNA, 23 bp, Homo sapiens
gctagatgagacactcacactgg

SEQ ID NO: 21375 - DNA, 23 bp, Homo sapiens
tatctgcttctagcagtgtcagg

SEQ ID NO: 21376 - DNA, 23 bp, Homo sapiens
ttctggagtctgttaagagaggg

SEQ ID NO: 21377 - DNA, 23 bp, Homo sapiens
gtcacactacatctgttgagtgg

SEQ ID NO: 21378 - DNA, 23 bp, Homo sapiens
atttcacaagagcttctcgatgg

SEQ ID NO: 21379 - DNA, 23 bp, Homo sapiens
tcaagagactgtctttgtacagg

SEQ ID NO: 21380 - DNA, 23 bp, Homo sapiens
gctctcccttctttcctagttgg

SEQ ID NO: 21381 - DNA, 23 bp, Homo sapiens
ctctgccgtggctctctgcaagg

SEQ ID NO: 21382 - DNA, 23 bp, Homo sapiens
tttcatcactagtttcaccatgg

SEQ ID NO: 21383 - DNA, 23 bp, Homo sapiens
acagaacgcaaagaaagctcagg

SEQ ID NO: 21384 - DNA, 23 bp, Homo sapiens
cactttgagaagacactactagg

SEQ ID NO: 21385 - DNA, 23 bp, Homo sapiens
ctactagtggtattaactgctgg

SEQ ID NO: 21386 - DNA, 23 bp, Homo sapiens
gaggctcggcagcccctcagtgg

SEQ ID NO: 21387 - DNA, 23 bp, Homo sapiens
cacatccaggacattctgaatgg

SEQ ID NO: 21388 - DNA, 23 bp, Homo sapiens
ccgatggagacgggtcaatgcgg

SEQ ID NO: 21389 - DNA, 23 bp, Homo sapiens
actgggcagctaacccgtgtagg

SEQ ID NO: 21390 - DNA, 23 bp, Homo sapiens
tctttgcagaccatcttctgagg

SEQ ID NO: 21391 - DNA, 23 bp, Homo sapiens
tcgactcggtgggcaagtgatgg

SEQ ID NO: 21392 - DNA, 23 bp, Homo sapiens
gacaaggctgccatggtcacagg

SEQ ID NO: 21393 - DNA, 23 bp, Homo sapiens
aaattgggaggaagaagtagagg

SEQ ID NO: 21394 - DNA, 23 bp, Homo sapiens
gtcaaagtcaaggcagactatgg

SEQ ID NO: 21395 - DNA, 23 bp, Homo sapiens
agcagcaggagaggctcagaagg

SEQ ID NO: 21396 - DNA, 23 bp, Homo sapiens
gatgaaagtccagatgttacggg

SEQ ID NO: 21397 - DNA, 23 bp, Homo sapiens
gccccacagccttctacaagggg

SEQ ID NO: 21398 - DNA, 23 bp, Homo sapiens
ttacccaggctggagtgtagtgg

SEQ ID NO: 21399 - DNA, 23 bp, Homo sapiens
ctcaagtgcagctgtccaacagg

SEQ ID NO: 21400 - DNA, 23 bp, Homo sapiens
ggcgagcaaggagaagacaaagg

SEQ ID NO: 21401 - DNA, 23 bp, Homo sapiens
ttaactgttgttggagactgtgg

SEQ ID NO: 21402 - DNA, 23 bp, Homo sapiens
tcagtggcttgattcttcattgg

SEQ ID NO: 21403 - DNA, 23 bp, Homo sapiens
agcccctccccaatcaagcctgg

SEQ ID NO: 21404 - DNA, 23 bp, Homo sapiens
ggacagtcattgcgtaaaaaggg

SEQ ID NO: 21405 - DNA, 23 bp, Homo sapiens
atctaggaaatcatctgtgacgg

SEQ ID NO: 21406 - DNA, 23 bp, Homo sapiens
agatactgatttcttccggaagg

SEQ ID NO: 21407 - DNA, 23 bp, Homo sapiens
attattcctagagatcgtgttgg

SEQ ID NO: 21408 - DNA, 23 bp, Homo sapiens
cagcagcgcaccttggactgagg

SEQ ID NO: 21409 - DNA, 23 bp, Homo sapiens
taaatcatatttggtcgctgagg

SEQ ID NO: 21410 - DNA, 23 bp, Homo sapiens
acgctgtgggggtacagcagagg

SEQ ID NO: 21411 - DNA, 23 bp, Homo sapiens
aatggcaatctctacactttagg

SEQ ID NO: 21412 - DNA, 23 bp, Homo sapiens
acaaaagaaccaagccgagaagg

SEQ ID NO: 21413 - DNA, 23 bp, Homo sapiens
cagaattgtcccagaatgggtgg

SEQ ID NO: 21414 - DNA, 23 bp, Homo sapiens
gtctggaaaccttcgcatcttgg

SEQ ID NO: 21415 - DNA, 23 bp, Homo sapiens
atttcccacccacttctcaatgg

SEQ ID NO: 21416 - DNA, 23 bp, Homo sapiens
tgtgacaacggctatatttttgg

SEQ ID NO: 21417 - DNA, 23 bp, Homo sapiens
gaatatagcagttgccacacagg

SEQ ID NO: 21418 - DNA, 23 bp, Homo sapiens
ttctggaagtttgctagaaaagg

SEQ ID NO: 21419 - DNA, 23 bp, Homo sapiens
tttgctagaaaagggaagaaggg

SEQ ID NO: 21420 - DNA, 23 bp, Homo sapiens
ttccgaaagcttgccaaaaaagg

SEQ ID NO: 21421 - DNA, 23 bp, Homo sapiens
ttccgaaagcttgccaaaacagg

SEQ ID NO: 21422 - DNA, 23 bp, Homo sapiens
cttttgtgggatcttggcaaggg

SEQ ID NO: 21423 - DNA, 23 bp, Homo sapiens
tcaatactcggctgtacaagtgg

SEQ ID NO: 21424 - DNA, 23 bp, Homo sapiens
ttgttagaacaggaaagaagggg

SEQ ID NO: 21425 - DNA, 23 bp, Homo sapiens
tcaatactcggctctacaagtgg

SEQ ID NO: 21426 - DNA, 23 bp, Homo sapiens
tgggttcctgctggtctgtgtgg

SEQ ID NO: 21427 - DNA, 23 bp, Homo sapiens
aggaaggtgaagaagacatgagg

SEQ ID NO: 21428 - DNA, 23 bp, Homo sapiens
tgtatcctgaaccactgagatgg

SEQ ID NO: 21429 - DNA, 23 bp, Homo sapiens
agaaaggtgaaggagacataagg

SEQ ID NO: 21430 - DNA, 23 bp, Homo sapiens
ttcttttgtacttgccattgagg

SEQ ID NO: 21431 - DNA, 23 bp, Homo sapiens
ccgctgagtgcctacaagagggg

SEQ ID NO: 21432 - DNA, 23 bp, Homo sapiens
gctaagactgctgaatgtgctgg

SEQ ID NO: 21433 - DNA, 23 bp, Homo sapiens
gagaagtgcttggagatcaccgg

SEQ ID NO: 21434 - DNA, 23 bp, Homo sapiens
ctggtttcagagctcaaagaagg

SEQ ID NO: 21435 - DNA, 23 bp, Homo sapiens
gaagatgacagttgaatagcagg

SEQ ID NO: 21436 - DNA, 23 bp, Homo sapiens
ttgagttttctcatctgcttagg

SEQ ID NO: 21437 - DNA, 23 bp, Homo sapiens
ttcttccctggctacagcaaagg

SEQ ID NO: 21438 - DNA, 23 bp, Homo sapiens
ccaaagctggcagaggaagaagg

SEQ ID NO: 21439 - DNA, 23 bp, Homo sapiens
gcaaacttgttcagccactatgg

SEQ ID NO: 21440 - DNA, 23 bp, Homo sapiens
ttcattctagctggcagatgagg

SEQ ID NO: 21441 - DNA, 23 bp, Homo sapiens
ttcatcctccctggcatctgagg

SEQ ID NO: 21442 - DNA, 23 bp, Homo sapiens
aatgactcttctcagatgccagg

SEQ ID NO: 21443 - DNA, 23 bp, Homo sapiens
agactctcggcgctgctgactgg

SEQ ID NO: 21444 - DNA, 23 bp, Homo sapiens
ggatgagcctgctgctcacacgg

SEQ ID NO: 21445 - DNA, 23 bp, Homo sapiens
cattcttctagggtcactgaagg

SEQ ID NO: 21446 - DNA, 23 bp, Homo sapiens
aggagcagaagcttctgttaagg

SEQ ID NO: 21447 - DNA, 23 bp, Homo sapiens
cctccaagccgttgggcactagg

SEQ ID NO: 21448 - DNA, 23 bp, Homo sapiens
gcgaaaacttatcacggttttgg

SEQ ID NO: 21449 - DNA, 23 bp, Homo sapiens
ctgtcagtcactgaaaagtcagg

SEQ ID NO: 21450 - DNA, 23 bp, Homo sapiens
ccaggtgttctacgaataggagg

SEQ ID NO: 21451 - DNA, 23 bp, Homo sapiens
gaagcgtatttgagtagacttgg

SEQ ID NO: 21452 - DNA, 23 bp, Homo sapiens
gggtcagggtgtcccgctgtagg

SEQ ID NO: 21453 - DNA, 23 bp, Homo sapiens
tggctcccacctgcctcaggcgg

SEQ ID NO: 21454 - DNA, 23 bp, Homo sapiens
ttctgggagtggggaagtggggg

SEQ ID NO: 21455 - DNA, 23 bp, Homo sapiens
tctactcttgcagcacttactgg

SEQ ID NO: 21456 - DNA, 23 bp, Homo sapiens
gccgcgcctgcgccttagcgcgg

SEQ ID NO: 21457 - DNA, 23 bp, Homo sapiens
agtctcgttccacggaggagggg

SEQ ID NO: 21458 - DNA, 23 bp, Homo sapiens
tcagaggaccagtgatgatgtgg

SEQ ID NO: 21459 - DNA, 23 bp, Homo sapiens
aacctctacggctacggtgccgg

SEQ ID NO: 21460 - DNA, 23 bp, Homo sapiens
aaccaagatggagagtgaggggg

SEQ ID NO: 21461 - DNA, 23 bp, Homo sapiens
agggtcgctgtctaagacactgg

SEQ ID NO: 21462 - DNA, 23 bp, Homo sapiens
ggctttccctggcactgggatgg

SEQ ID NO: 21463 - DNA, 23 bp, Homo sapiens
gtgtcggaggctgagtgctgagg

SEQ ID NO: 21464 - DNA, 23 bp, Homo sapiens
ggaggctcagcagtccccgtcgg

SEQ ID NO: 21465 - DNA, 23 bp, Homo sapiens
tggtgtccttagcagcagaaggg

SEQ ID NO: 21466 - DNA, 23 bp, Homo sapiens
agagcttctcgtccagctccagg

SEQ ID NO: 21467 - DNA, 23 bp, Homo sapiens
ttcaactacagcaggcaaaatgg

SEQ ID NO: 21468 - DNA, 23 bp, Homo sapiens
gccgaggagtccactcatagagg

SEQ ID NO: 21469 - DNA, 23 bp, Homo sapiens
tcccactgagctggggaaaacgg

SEQ ID NO: 21470 - DNA, 23 bp, Homo sapiens
gtatttcttcatcctctgcctgg

SEQ ID NO: 21471 - DNA, 23 bp, Homo sapiens
cgggccggaggagcagtgagggg

SEQ ID NO: 21472 - DNA, 23 bp, Homo sapiens
gaggagctggacatggactgagg

SEQ ID NO: 21473 - DNA, 23 bp, Homo sapiens
caagaagcccattgactggaagg

SEQ ID NO: 21474 - DNA, 23 bp, Homo sapiens
caggcctgcagggtcacgactgg

SEQ ID NO: 21475 - DNA, 23 bp, Homo sapiens
cccgctgaggtcaccactgcagg

SEQ ID NO: 21476 - DNA, 23 bp, Homo sapiens
ggggacagctggggctcaggcgg

SEQ ID NO: 21477 - DNA, 23 bp, Homo sapiens
caccatcgtgaaagagtagccgg

SEQ ID NO: 21478 - DNA, 23 bp, Homo sapiens
ggggctgtcccagtattaaaagg

SEQ ID NO: 21479 - DNA, 23 bp, Homo sapiens
taatctttaagactggtgggagg

SEQ ID NO: 21480 - DNA, 23 bp, Homo sapiens
tggtcctgagaagagggaagagg

SEQ ID NO: 21481 - DNA, 23 bp, Homo sapiens
cttattccttaccaggaaactgg

SEQ ID NO: 21482 - DNA, 23 bp, Homo sapiens
aaagaaacgtttgcgggaagagg

SEQ ID NO: 21483 - DNA, 23 bp, Homo sapiens
gcgaagacaagagagctcattgg

SEQ ID NO: 21484 - DNA, 23 bp, Homo sapiens
tatagttccagctactgaggagg

SEQ ID NO: 21485 - DNA, 23 bp, Homo sapiens
ttatattctggatctcaggtcgg

SEQ ID NO: 21486 - DNA, 23 bp, Homo sapiens
ccatagaaaagaaggaggagagg

SEQ ID NO: 21487 - DNA, 23 bp, Homo sapiens
atttctacaccatgctctgaggg

SEQ ID NO: 21488 - DNA, 23 bp, Homo sapiens
ttgggtttgccatcctgatgtgg

SEQ ID NO: 21489 - DNA, 23 bp, Homo sapiens
tcctgggtaccatgttctactgg

SEQ ID NO: 21490 - DNA, 23 bp, Homo sapiens
ctgggctcccgcaagtaaggagg

SEQ ID NO: 21491 - DNA, 23 bp, Homo sapiens
ggtggtgctgggctcagtcttgg

SEQ ID NO: 21492 - DNA, 23 bp, Homo sapiens
cccagcctcagcccctagcctgg

SEQ ID NO: 21493 - DNA, 23 bp, Homo sapiens
ggctgggggagatggggcgccgg

SEQ ID NO: 21494 - DNA, 23 bp, Homo sapiens
tgccgagggggcttcctgagggg

SEQ ID NO: 21495 - DNA, 23 bp, Homo sapiens
catcaagaagaaactgagcaagg

SEQ ID NO: 21496 - DNA, 23 bp, Homo sapiens
aacttcatcagacggcggcttgg

SEQ ID NO: 21497 - DNA, 23 bp, Homo sapiens
cctgttgcacctacacattttgg

SEQ ID NO: 21498 - DNA, 23 bp, Homo sapiens
ttcagcatgaggcagtaactagg

SEQ ID NO: 21499 - DNA, 23 bp, Homo sapiens
caacgacgagggactttgatggg

SEQ ID NO: 21500 - DNA, 23 bp, Homo sapiens
gggtcctgaggaggatcataagg

SEQ ID NO: 21501 - DNA, 23 bp, Homo sapiens
gtctcacggtgacctcccgccgg

SEQ ID NO: 21502 - DNA, 23 bp, Homo sapiens
tatgtttagtcagcatgctcagg

SEQ ID NO: 21503 - DNA, 23 bp, Homo sapiens
ccaccagcatgatcaacatccgg

SEQ ID NO: 21504 - DNA, 23 bp, Homo sapiens
gggacagtatcagagagggatgg

SEQ ID NO: 21505 - DNA, 23 bp, Homo sapiens
cctctttcagatacggttcaagg

SEQ ID NO: 21506 - DNA, 23 bp, Homo sapiens
ccttgaaccgtatctgaaagagg

SEQ ID NO: 21507 - DNA, 23 bp, Homo sapiens
ttctggctgcgcttctaggcggg

SEQ ID NO: 21508 - DNA, 23 bp, Homo sapiens
atggcagcaagtggaaatttggg

SEQ ID NO: 21509 - DNA, 23 bp, Homo sapiens
agtgacgatatggtgattgttgg

SEQ ID NO: 21510 - DNA, 23 bp, Homo sapiens
cacagagctctagccgctcccgg

SEQ ID NO: 21511 - DNA, 23 bp, Homo sapiens
agagtttgtgggccacgcaatgg

SEQ ID NO: 21512 - DNA, 23 bp, Homo sapiens
ggcgtaagccatggtgctctggg

SEQ ID NO: 21513 - DNA, 23 bp, Homo sapiens
acagcttggcggggtctgcgcgg

SEQ ID NO: 21514 - DNA, 23 bp, Homo sapiens
cggcaggagtcaagcatctgagg

SEQ ID NO: 21515 - DNA, 23 bp, Homo sapiens
gagaaaagatatacggcctaagg

SEQ ID NO: 21516 - DNA, 23 bp, Homo sapiens
agctcattgagctggtgagacgg

SEQ ID NO: 21517 - DNA, 23 bp, Homo sapiens
aaaaaaggggattgttctagagg

SEQ ID NO: 21518 - DNA, 23 bp, Homo sapiens
cagattgcaacagaaagactagg

SEQ ID NO: 21519 - DNA, 23 bp, Homo sapiens
ttacagtatgacattcagagggg

SEQ ID NO: 21520 - DNA, 23 bp, Homo sapiens
caacctgcaaatcttcaggatgg

SEQ ID NO: 21521 - DNA, 23 bp, Homo sapiens
ccactctgcacggcggctgaggg

SEQ ID NO: 21522 - DNA, 23 bp, Homo sapiens
tcagccactatattcagttgtgg

SEQ ID NO: 21523 - DNA, 23 bp, Homo sapiens
agcaggccctgcagctctgaggg

SEQ ID NO: 21524 - DNA, 23 bp, Homo sapiens
tttatgcacagcatccacaaagg

SEQ ID NO: 21525 - DNA, 23 bp, Homo sapiens
aagcttttctgcatttccacagg

SEQ ID NO: 21526 - DNA, 23 bp, Homo sapiens
ggctgactcagcagcagccatgg

SEQ ID NO: 21527 - DNA, 23 bp, Homo sapiens
gcctctggtgctcacttcaaagg

SEQ ID NO: 21528 - DNA, 23 bp, Homo sapiens
ctctttggtttaagccactttgg

SEQ ID NO: 21529 - DNA, 23 bp, Homo sapiens
tattatctggtctgtgatcctgg

SEQ ID NO: 21530 - DNA, 23 bp, Homo sapiens
gggggtctttatttgagtttagg

SEQ ID NO: 21531 - DNA, 23 bp, Homo sapiens
gttgcggcaccacggattagagg

SEQ ID NO: 21532 - DNA, 23 bp, Homo sapiens
gtggtggcgggcgtcactgccgg

SEQ ID NO: 21533 - DNA, 23 bp, Homo sapiens
tgcaatcatgacctagaatatgg

SEQ ID NO: 21534 - DNA, 23 bp, Homo sapiens
cccttttggacttcagaagaagg

SEQ ID NO: 21535 - DNA, 23 bp, Homo sapiens
cggagctcactgtttcctaacgg

SEQ ID NO: 21536 - DNA, 23 bp, Homo sapiens
ggagcgcccgccggccctggagg

SEQ ID NO: 21537 - DNA, 23 bp, Homo sapiens
ccagtcaatacagacttcactgg

SEQ ID NO: 21538 - DNA, 23 bp, Homo sapiens
tctgggtttccatcctttacagg

SEQ ID NO: 21539 - DNA, 23 bp, Homo sapiens
gcttggggacacctttctgtagg

SEQ ID NO: 21540 - DNA, 23 bp, Homo sapiens
agctgtgaaagcaacataaatgg

SEQ ID NO: 21541 - DNA, 23 bp, Homo sapiens
atatgatctagatccttgccagg

SEQ ID NO: 21542 - DNA, 23 bp, Homo sapiens
agcaagtaaggagtagaagtagg

SEQ ID NO: 21543 - DNA, 23 bp, Homo sapiens
gcgcacacagggtttacagcagg

SEQ ID NO: 21544 - DNA, 23 bp, Homo sapiens
cccacccagctctgagttcatgg

SEQ ID NO: 21545 - DNA, 23 bp, Homo sapiens
tatcagtctcgggactgagaggg

SEQ ID NO: 21546 - DNA, 23 bp, Homo sapiens
aggtttagcttggtatcctgcgg

SEQ ID NO: 21547 - DNA, 23 bp, Homo sapiens
gcctcgcagagttgaaataatgg

SEQ ID NO: 21548 - DNA, 23 bp, Homo sapiens
actttctaatgggatgccagtgg

SEQ ID NO: 21549 - DNA, 23 bp, Homo sapiens
cactagcaactctgctctagtgg

SEQ ID NO: 21550 - DNA, 23 bp, Homo sapiens
gataactctggacttctcaaagg

SEQ ID NO: 21551 - DNA, 23 bp, Homo sapiens
tcaagagccaatagcacgaaagg

SEQ ID NO: 21552 - DNA, 23 bp, Homo sapiens
aaatggaatcaaaagggcagtgg

SEQ ID NO: 21553 - DNA, 23 bp, Homo sapiens
ggaggaccaggagagccaaaggg

SEQ ID NO: 21554 - DNA, 23 bp, Homo sapiens
ttcgacgaccccgacacatcagg

SEQ ID NO: 21555 - DNA, 23 bp, Homo sapiens
aggaaagcaccttagaccgctgg

SEQ ID NO: 21556 - DNA, 23 bp, Homo sapiens
ttgtgtgccagtggtctcagtgg

SEQ ID NO: 21557 - DNA, 23 bp, Homo sapiens
gacagaagtgatgctagcggcgg

SEQ ID NO: 21558 - DNA, 23 bp, Homo sapiens
ggcagagaaccaagagcccttgg

SEQ ID NO: 21559 - DNA, 23 bp, Homo sapiens
ggaggaccaggagatccaaaggg

SEQ ID NO: 21560 - DNA, 23 bp, Homo sapiens
accgacaggcgagcaacgcaagg

SEQ ID NO: 21561 - DNA, 23 bp, Homo sapiens
gctgtgtttgttattccctttgg

SEQ ID NO: 21562 - DNA, 23 bp, Homo sapiens
acatgaagatggagtgctaatgg

SEQ ID NO: 21563 - DNA, 23 bp, Homo sapiens
catggaggaggtggattagcagg

SEQ ID NO: 21564 - DNA, 23 bp, Homo sapiens
ctctggtatcccagagtcgctgg

SEQ ID NO: 21565 - DNA, 23 bp, Homo sapiens
gtggctcctggcgctacattcgg

SEQ ID NO: 21566 - DNA, 23 bp, Homo sapiens
gactagcccagcagatcacacgg

SEQ ID NO: 21567 - DNA, 23 bp, Homo sapiens
ccagagcttagaggtgtcacagg

SEQ ID NO: 21568 - DNA, 23 bp, Homo sapiens
gataaggctactcgtattccagg

SEQ ID NO: 21569 - DNA, 23 bp, Homo sapiens
ttgatgatgttgatccctagagg

SEQ ID NO: 21570 - DNA, 23 bp, Homo sapiens
gcagtttatcttccatcagcagg

SEQ ID NO: 21571 - DNA, 23 bp, Homo sapiens
ggtagaggagacccttcagaagg

SEQ ID NO: 21572 - DNA, 23 bp, Homo sapiens
ggtctgtgtgtcacttcagtagg

SEQ ID NO: 21573 - DNA, 23 bp, Homo sapiens
attttcattctacctgacgaagg

SEQ ID NO: 21574 - DNA, 23 bp, Homo sapiens
gctgtcatggagtcaattcaggg

SEQ ID NO: 21575 - DNA, 23 bp, Homo sapiens
gccgagtgagtctgtcaagcagg

SEQ ID NO: 21576 - DNA, 23 bp, Homo sapiens
acaccaggccaaagctggatcgg

SEQ ID NO: 21577 - DNA, 23 bp, Homo sapiens
attcttcagacttgcactcctgg

SEQ ID NO: 21578 - DNA, 23 bp, Homo sapiens
tgattgcagaaatatcactgagg

SEQ ID NO: 21579 - DNA, 23 bp, Homo sapiens
tcatacttgccaaattgaggcgg

SEQ ID NO: 21580 - DNA, 23 bp, Homo sapiens
tcttctgcttgaagtatatctgg

SEQ ID NO: 21581 - DNA, 23 bp, Homo sapiens
cctaatgtcaagaagcagcttgg

SEQ ID NO: 21582 - DNA, 23 bp, Homo sapiens
cacattagaagaccagtctgtgg

SEQ ID NO: 21583 - DNA, 23 bp, Homo sapiens
ttccacaggggcacagtcagcgg

SEQ ID NO: 21584 - DNA, 23 bp, Homo sapiens
agtggggaagactacccgtcagg

SEQ ID NO: 21585 - DNA, 23 bp, Homo sapiens
acctctacagaaagaacttatgg

SEQ ID NO: 21586 - DNA, 23 bp, Homo sapiens
ggaggaggatttaatacagttgg

SEQ ID NO: 21587 - DNA, 23 bp, Homo sapiens
ccaaccagcagggggcttgaagg

SEQ ID NO: 21588 - DNA, 23 bp, Homo sapiens
ggggaaggatgtcagtcacctgg

SEQ ID NO: 21589 - DNA, 23 bp, Homo sapiens
tcccgagtggctgggatgacagg

SEQ ID NO: 21590 - DNA, 23 bp, Homo sapiens
atcgtggagtcagcattagttgg

SEQ ID NO: 21591 - DNA, 23 bp, Homo sapiens
gttatctgaagctccccacgtgg

SEQ ID NO: 21592 - DNA, 23 bp, Homo sapiens
cgtctctttgagtatggccaggg

SEQ ID NO: 21593 - DNA, 23 bp, Homo sapiens
taccggagtccagcttttgatgg

SEQ ID NO: 21594 - DNA, 23 bp, Homo sapiens
cattgtctttggatcagctaagg

SEQ ID NO: 21595 - DNA, 23 bp, Homo sapiens
attctgctctgctacttgtaagg

SEQ ID NO: 21596 - DNA, 23 bp, Homo sapiens
gaatgcttcttggcagctctagg

SEQ ID NO: 21597 - DNA, 23 bp, Homo sapiens
gcactaagtgctcttgattctgg

SEQ ID NO: 21598 - DNA, 23 bp, Homo sapiens
taatcagctttgtcagaagtggg

SEQ ID NO: 21599 - DNA, 23 bp, Homo sapiens
tactgatgctctatgactactgg

SEQ ID NO: 21600 - DNA, 23 bp, Homo sapiens
ttgtgaaaagtcacggcttctgg

SEQ ID NO: 21601 - DNA, 23 bp, Homo sapiens
tttagtgctttctctttacgagg

SEQ ID NO: 21602 - DNA, 23 bp, Homo sapiens
atgccagaagaagggtttaaagg

SEQ ID NO: 21603 - DNA, 23 bp, Homo sapiens
caaaggttacctgctggagctgg

SEQ ID NO: 21604 - DNA, 23 bp, Homo sapiens
ccacagacattttcctgaatggg

SEQ ID NO: 21605 - DNA, 23 bp, Homo sapiens
ggggtgggggacacggaaagggg

SEQ ID NO: 21606 - DNA, 23 bp, Homo sapiens
gggtgaggcaggctcttagctgg

SEQ ID NO: 21607 - DNA, 23 bp, Homo sapiens
tatcaaagctatatcaggcctgg

SEQ ID NO: 21608 - DNA, 23 bp, Homo sapiens
aggacttactctacagtgaaggg

SEQ ID NO: 21609 - DNA, 23 bp, Homo sapiens
ctctcttttccagagagcagtgg

SEQ ID NO: 21610 - DNA, 23 bp, Homo sapiens
accctctgctggaagaacagagg

SEQ ID NO: 21611 - DNA, 23 bp, Homo sapiens
tgcagcacagtcaatggtaaagg

SEQ ID NO: 21612 - DNA, 23 bp, Homo sapiens
gatggcagacacaagcagtacgg

SEQ ID NO: 21613 - DNA, 23 bp, Homo sapiens
ctcacagcaacactgactcttgg

SEQ ID NO: 21614 - DNA, 23 bp, Homo sapiens
accagcttggaaatcagttatgg

SEQ ID NO: 21615 - DNA, 23 bp, Homo sapiens
ataacctatgtctccttatgtgg

SEQ ID NO: 21616 - DNA, 23 bp, Homo sapiens
atgtgcatttcattgatccttgg

SEQ ID NO: 21617 - DNA, 23 bp, Homo sapiens
agtatcctcacctcagatgaagg

SEQ ID NO: 21618 - DNA, 23 bp, Homo sapiens
tgctaaagcatttaatgctgagg

SEQ ID NO: 21619 - DNA, 23 bp, Homo sapiens
acaggatgatgaaaagtggctgg

SEQ ID NO: 21620 - DNA, 23 bp, Homo sapiens
tggccgcagccgggactcactgg

SEQ ID NO: 21621 - DNA, 23 bp, Homo sapiens
agtgaaggtgaagaaagaaacgg

SEQ ID NO: 21622 - DNA, 23 bp, Homo sapiens
cagctgttttttgtgacgtgtgg

SEQ ID NO: 21623 - DNA, 23 bp, Homo sapiens
ttcttctttattgtgacgtgtgg

SEQ ID NO: 21624 - DNA, 23 bp, Homo sapiens
gtgttggaacacacatctgatgg

SEQ ID NO: 21625 - DNA, 23 bp, Homo sapiens
agggcaaggccctgatgtatagg

SEQ ID NO: 21626 - DNA, 23 bp, Homo sapiens
cctgaaagatttagcaatggtgg

SEQ ID NO: 21627 - DNA, 23 bp, Homo sapiens
tctgagaagcagaatgcagaagg

SEQ ID NO: 21628 - DNA, 23 bp, Homo sapiens
gaattatctggcattcgtgcagg

SEQ ID NO: 21629 - DNA, 23 bp, Homo sapiens
ttcttctttttaatgggtggtgg

SEQ ID NO: 21630 - DNA, 23 bp, Homo sapiens
aaacatgctatgcatcagactgg

SEQ ID NO: 21631 - DNA, 23 bp, Homo sapiens
aaatgttcccagcaggccacagg

SEQ ID NO: 21632 - DNA, 23 bp, Homo sapiens
gtgagactcctgattgcttctgg

SEQ ID NO: 21633 - DNA, 23 bp, Homo sapiens
gagacgtcctatgctgtagatgg

SEQ ID NO: 21634 - DNA, 23 bp, Homo sapiens
gcccctccgcgtgctcacgccgg

SEQ ID NO: 21635 - DNA, 23 bp, Homo sapiens
ttttaaaagtttaccgggcatgg

SEQ ID NO: 21636 - DNA, 23 bp, Homo sapiens
gctcgaacagtacaaaatggagg

SEQ ID NO: 21637 - DNA, 23 bp, Homo sapiens
ggtgcatctttcctggaatatgg

SEQ ID NO: 21638 - DNA, 23 bp, Homo sapiens
tcattactgtagcatttgtgagg

SEQ ID NO: 21639 - DNA, 23 bp, Homo sapiens
gacctgctcacttcacttatcgg

SEQ ID NO: 21640 - DNA, 23 bp, Homo sapiens
agttcagtgcgtagttaaactgg

SEQ ID NO: 21641 - DNA, 23 bp, Homo sapiens
aaaagtgaggagttcagctgtgg

SEQ ID NO: 21642 - DNA, 23 bp, Homo sapiens
ggatggggggaagaagtcaatgg

SEQ ID NO: 21643 - DNA, 23 bp, Homo sapiens
ctccgtgccaggcctgtcagagg

SEQ ID NO: 21644 - DNA, 23 bp, Homo sapiens
agccatctgtgccatcatcgtgg

SEQ ID NO: 21645 - DNA, 23 bp, Homo sapiens
aggttttctagaagtcaccatgg

SEQ ID NO: 21646 - DNA, 23 bp, Homo sapiens
tatgatgatgatgaggatgatgg

SEQ ID NO: 21647 - DNA, 23 bp, Homo sapiens
catcatcatcatcatcgtgtggg

SEQ ID NO: 21648 - DNA, 23 bp, Homo sapiens
agcagcaaccaaagccatgatgg

SEQ ID NO: 21649 - DNA, 23 bp, Homo sapiens
gaccagctgggtcagttcccagg

SEQ ID NO: 21650 - DNA, 23 bp, Homo sapiens
gccaagctgtgtgaagaaatagg

SEQ ID NO: 21651 - DNA, 23 bp, Homo sapiens
tggttcaatctgaagttcacagg

SEQ ID NO: 21652 - DNA, 23 bp, Homo sapiens
gttccctgttacttaagagaagg

SEQ ID NO: 21653 - DNA, 23 bp, Homo sapiens
atgtctcagactgtaagcgaagg

SEQ ID NO: 21654 - DNA, 23 bp, Homo sapiens
gctgttgcacagtcacactgagg

SEQ ID NO: 21655 - DNA, 23 bp, Homo sapiens
acaacaagaagtgaaggaagagg

SEQ ID NO: 21656 - DNA, 23 bp, Homo sapiens
agccaggcttaggagcaacgtgg

SEQ ID NO: 21657 - DNA, 23 bp, Homo sapiens
ctgtgcatgctacctctacaagg

SEQ ID NO: 21658 - DNA, 23 bp, Homo sapiens
tggtggatcacagcatcttctgg

SEQ ID NO: 21659 - DNA, 23 bp, Homo sapiens
gggatgatgagttagagctccgg

SEQ ID NO: 21660 - DNA, 23 bp, Homo sapiens
taccagatccgggtctgaggcgg

SEQ ID NO: 21661 - DNA, 23 bp, Homo sapiens
cggtatggcttggctaaattcgg

SEQ ID NO: 21662 - DNA, 23 bp, Homo sapiens
tctctctctggcttagatgtagg

SEQ ID NO: 21663 - DNA, 23 bp, Homo sapiens
gtccaggagctgaggaagcgggg

SEQ ID NO: 21664 - DNA, 23 bp, Homo sapiens
gggccagagaaggagaactaggg

SEQ ID NO: 21665 - DNA, 23 bp, Homo sapiens
ccacctgggtcctcagttactgg

SEQ ID NO: 21666 - DNA, 23 bp, Homo sapiens
gttccctgccaactacgtggagg

SEQ ID NO: 21667 - DNA, 23 bp, Homo sapiens
gtccacgttcctgccgtcactgg

SEQ ID NO: 21668 - DNA, 23 bp, Homo sapiens
tccatccacatatgtggaagagg

SEQ ID NO: 21669 - DNA, 23 bp, Homo sapiens
aggggccgagaaaaaagcgctgg

SEQ ID NO: 21670 - DNA, 23 bp, Homo sapiens
gggtggcagcccctatagtgcgg

SEQ ID NO: 21671 - DNA, 23 bp, Homo sapiens
gttagctttcttgcagctgctgg

SEQ ID NO: 21672 - DNA, 23 bp, Homo sapiens
ccagcattatgctttgttcttgg

SEQ ID NO: 21673 - DNA, 23 bp, Homo sapiens
caagaaaagccaacatgaagggg

SEQ ID NO: 21674 - DNA, 23 bp, Homo sapiens
gccggaggtggcaggagtcgagg

SEQ ID NO: 21675 - DNA, 23 bp, Homo sapiens
aggctcagccaggtgcctactgg

SEQ ID NO: 21676 - DNA, 23 bp, Homo sapiens
tgatgacctgtatggctaagtgg

SEQ ID NO: 21677 - DNA, 23 bp, Homo sapiens
gactaacacaactgagccaatgg

SEQ ID NO: 21678 - DNA, 23 bp, Homo sapiens
gatgattaaaggcttcacgatgg

SEQ ID NO: 21679 - DNA, 23 bp, Homo sapiens
cggctgggcctgaacttagtcgg

SEQ ID NO: 21680 - DNA, 23 bp, Homo sapiens
agaactaccgagtgtgtagacgg

SEQ ID NO: 21681 - DNA, 23 bp, Homo sapiens
tagttgctgctcagggagatagg

SEQ ID NO: 21682 - DNA, 23 bp, Homo sapiens
ccacaagcttggtctaggactgg

SEQ ID NO: 21683 - DNA, 23 bp, Homo sapiens
tgggctcgccctggagttggagg

SEQ ID NO: 21684 - DNA, 23 bp, Homo sapiens
tttgaactggaagcttaatgtgg

SEQ ID NO: 21685 - DNA, 23 bp, Homo sapiens
ggcaatgagatctcctgactagg

SEQ ID NO: 21686 - DNA, 23 bp, Homo sapiens
acgcgagtctgtgtttttgcagg

SEQ ID NO: 21687 - DNA, 23 bp, Homo sapiens
cgttctgtatcagtctttcctgg

SEQ ID NO: 21688 - DNA, 23 bp, Homo sapiens
gacaagccgaggcggtgagccgg

SEQ ID NO: 21689 - DNA, 23 bp, Homo sapiens
tgtgtcaccttcgcagcttccgg

SEQ ID NO: 21690 - DNA, 23 bp, Homo sapiens
ttcctccgttgccaagggcgggg

SEQ ID NO: 21691 - DNA, 23 bp, Homo sapiens
gtcgttgtgtcccttcatattgg

SEQ ID NO: 21692 - DNA, 23 bp, Homo sapiens
cgctgaatcaaggattctttcgg

SEQ ID NO: 21693 - DNA, 23 bp, Homo sapiens
acgggggatgcattttgaggagg

SEQ ID NO: 21694 - DNA, 23 bp, Homo sapiens
agatctcctggctgatcacacgg

SEQ ID NO: 21695 - DNA, 23 bp, Homo sapiens
agaagtaaccacatatctgtagg

SEQ ID NO: 21696 - DNA, 23 bp, Homo sapiens
tgagcttggggacatgttttggg

SEQ ID NO: 21697 - DNA, 23 bp, Homo sapiens
ctttgcctacatcaccgccttgg

SEQ ID NO: 21698 - DNA, 23 bp, Homo sapiens
aagtccgcatggaattagagggg

SEQ ID NO: 21699 - DNA, 23 bp, Homo sapiens
acagacttttggtggtgaggagg

SEQ ID NO: 21700 - DNA, 23 bp, Homo sapiens
cagaggcagaaaggcagaagtgg

SEQ ID NO: 21701 - DNA, 23 bp, Homo sapiens
ggaccgggaagggcagtcacggg

SEQ ID NO: 21702 - DNA, 23 bp, Homo sapiens
aacttgactaaagatgctgcagg

SEQ ID NO: 21703 - DNA, 23 bp, Homo sapiens
ctgggtcagcagatcagctcagg

SEQ ID NO: 21704 - DNA, 23 bp, Homo sapiens
cccagcgtgggattcgatacagg

SEQ ID NO: 21705 - DNA, 23 bp, Homo sapiens
gattgtgtgtttcagtaccacgg

SEQ ID NO: 21706 - DNA, 23 bp, Homo sapiens
cccctctgtggtctcctgaaggg

SEQ ID NO: 21707 - DNA, 23 bp, Homo sapiens
cgcattgcacatcaacggatggg

SEQ ID NO: 21708 - DNA, 23 bp, Homo sapiens
tatacactgcagtgtgatgttgg

SEQ ID NO: 21709 - DNA, 23 bp, Homo sapiens
aggttttgttgcttccatcgagg

SEQ ID NO: 21710 - DNA, 23 bp, Homo sapiens
cggcaggagaaaaagcagctggg

SEQ ID NO: 21711 - DNA, 23 bp, Homo sapiens
ggttgaaactagagatggacagg

SEQ ID NO: 21712 - DNA, 23 bp, Homo sapiens
ttctaactcttctggaaagtcgg

SEQ ID NO: 21713 - DNA, 23 bp, Homo sapiens
agataaaggatcagcagaggagg

SEQ ID NO: 21714 - DNA, 23 bp, Homo sapiens
gggatcctggtggtcagaccagg

SEQ ID NO: 21715 - DNA, 23 bp, Homo sapiens
ggggtggggctagatgaccgagg

SEQ ID NO: 21716 - DNA, 23 bp, Homo sapiens
gttagtggaggcagtggtagagg

SEQ ID NO: 21717 - DNA, 23 bp, Homo sapiens
attgcccatgcaaacaactcagg

SEQ ID NO: 21718 - DNA, 23 bp, Homo sapiens
cggtcaagctccactggctctgg

SEQ ID NO: 21719 - DNA, 23 bp, Homo sapiens
ctgctctgaattcagttccgagg

SEQ ID NO: 21720 - DNA, 23 bp, Homo sapiens
aaccccagggcaaggctaagagg

SEQ ID NO: 21721 - DNA, 23 bp, Homo sapiens
aatcatagagcacgaagaacagg

SEQ ID NO: 21722 - DNA, 23 bp, Homo sapiens
gaaaggggcttgagactgttagg

SEQ ID NO: 21723 - DNA, 23 bp, Homo sapiens
tgtcgggcgtcagtcctgcttgg

SEQ ID NO: 21724 - DNA, 23 bp, Homo sapiens
ggtagacacagtgcttctgttgg

SEQ ID NO: 21725 - DNA, 23 bp, Homo sapiens
acagtggcgtgaaggcaaacagg

SEQ ID NO: 21726 - DNA, 23 bp, Homo sapiens
tgcattccgggctcacactgtgg

SEQ ID NO: 21727 - DNA, 23 bp, Homo sapiens
attctgctgccgcagttgaacgg

SEQ ID NO: 21728 - DNA, 23 bp, Homo sapiens
caggggtcgaggatcccttgggg

SEQ ID NO: 21729 - DNA, 23 bp, Homo sapiens
tgcgcgcgcgggaacgtcctagg

SEQ ID NO: 21730 - DNA, 23 bp, Homo sapiens
ccagcagcggttgaactcagagg

SEQ ID NO: 21731 - DNA, 23 bp, Homo sapiens
catggcatgacaaccagattagg

SEQ ID NO: 21732 - DNA, 23 bp, Homo sapiens
gcagcagatactgcagagcctgg

SEQ ID NO: 21733 - DNA, 23 bp, Homo sapiens
gagaactatctgaccagcttagg

SEQ ID NO: 21734 - DNA, 23 bp, Homo sapiens
tatacaggttttgttttgcctgg

SEQ ID NO: 21735 - DNA, 23 bp, Homo sapiens
acttcttagtactgccacattgg

SEQ ID NO: 21736 - DNA, 23 bp, Homo sapiens
ttattcttgcttgtgctgtgagg

SEQ ID NO: 21737 - DNA, 23 bp, Homo sapiens
actcactttacagctcatgtggg

SEQ ID NO: 21738 - DNA, 23 bp, Homo sapiens
aacaccagcatgcacatgacagg

SEQ ID NO: 21739 - DNA, 23 bp, Homo sapiens
gctctgctaaaggagatcactgg

SEQ ID NO: 21740 - DNA, 23 bp, Homo sapiens
gtagtgaaggccaagtagtgggg

SEQ ID NO: 21741 - DNA, 23 bp, Homo sapiens
acggtctcgtgggctgctaaggg

SEQ ID NO: 21742 - DNA, 23 bp, Homo sapiens
ctctgctgtcttcagttcaaggg

SEQ ID NO: 21743 - DNA, 23 bp, Homo sapiens
gctacggctttagtccctagggg

SEQ ID NO: 21744 - DNA, 23 bp, Homo sapiens
ggctgcttaagtgcccctcctgg

SEQ ID NO: 21745 - DNA, 23 bp, Homo sapiens
aaattcaattctacagggagtgg

SEQ ID NO: 21746 - DNA, 23 bp, Homo sapiens
caggcagtgttctctgtcagagg

SEQ ID NO: 21747 - DNA, 23 bp, Homo sapiens
tacaggttgagggatgggactgg

SEQ ID NO: 21748 - DNA, 23 bp, Homo sapiens
aaaataaagccctgaggaaaggg

SEQ ID NO: 21749 - DNA, 23 bp, Homo sapiens
gcaacggtgactttcaaagtagg

SEQ ID NO: 21750 - DNA, 23 bp, Homo sapiens
tccaatcccggcacttcaggagg

SEQ ID NO: 21751 - DNA, 23 bp, Homo sapiens
cctgaggtctgtgattaagatgg

SEQ ID NO: 21752 - DNA, 23 bp, Homo sapiens
tatgacagacaggaatctgaggg

SEQ ID NO: 21753 - DNA, 23 bp, Homo sapiens
aaaccgagagcagctggagctgg

SEQ ID NO: 21754 - DNA, 23 bp, Homo sapiens
gcacaagcccagaagaagtgagg

SEQ ID NO: 21755 - DNA, 23 bp, Homo sapiens
cagctcagttggctgtaggaggg

SEQ ID NO: 21756 - DNA, 23 bp, Homo sapiens
ggcgtcaagttcttctagcaggg

SEQ ID NO: 21757 - DNA, 23 bp, Homo sapiens
atggatggtgcaccagtaaaagg

SEQ ID NO: 21758 - DNA, 23 bp, Homo sapiens
tcctgttcagttcacatttcagg

SEQ ID NO: 21759 - DNA, 23 bp, Homo sapiens
tgacaacaactgcaggcagtagg

SEQ ID NO: 21760 - DNA, 23 bp, Homo sapiens
catgtcggcgtcagatgagctgg

SEQ ID NO: 21761 - DNA, 23 bp, Homo sapiens
tgccccgggctcaggcatgcagg

SEQ ID NO: 21762 - DNA, 23 bp, Homo sapiens
acctatgtgtatcagctaattgg

SEQ ID NO: 21763 - DNA, 23 bp, Homo sapiens
caaatcttgctctgttgccccgg

SEQ ID NO: 21764 - DNA, 23 bp, Homo sapiens
ctcctctgaacatcctagaaagg

SEQ ID NO: 21765 - DNA, 23 bp, Homo sapiens
ccttatggaggccatgagtgagg

SEQ ID NO: 21766 - DNA, 23 bp, Homo sapiens
tccgaggggccaatttatgaagg

SEQ ID NO: 21767 - DNA, 23 bp, Homo sapiens
tgccgtgatgactcagtggaagg

SEQ ID NO: 21768 - DNA, 23 bp, Homo sapiens
tctatagtggagcatgaaattgg

SEQ ID NO: 21769 - DNA, 23 bp, Homo sapiens
aggaccgcgccggcgctcactgg

SEQ ID NO: 21770 - DNA, 23 bp, Homo sapiens
caggagtgtgtctaatacccagg

SEQ ID NO: 21771 - DNA, 23 bp, Homo sapiens
ggccgcaccgtggatcctaccgg

SEQ ID NO: 21772 - DNA, 23 bp, Homo sapiens
tgctgggctcaagtgtcagctgg

SEQ ID NO: 21773 - DNA, 23 bp, Homo sapiens
tggaccaggaagtgcaattttgg

SEQ ID NO: 21774 - DNA, 23 bp, Homo sapiens
ccacgtatccgtgggctacctgg

SEQ ID NO: 21775 - DNA, 23 bp, Homo sapiens
tcagcgagcagaagatgaaacgg

SEQ ID NO: 21776 - DNA, 23 bp, Homo sapiens
agaaattctcagaggactttggg

SEQ ID NO: 21777 - DNA, 23 bp, Homo sapiens
acagaagattttggtcaagaagg

SEQ ID NO: 21778 - DNA, 23 bp, Homo sapiens
ggttatgtggaactatgtgcagg

SEQ ID NO: 21779 - DNA, 23 bp, Homo sapiens
tcttattgatatgggatcccagg

SEQ ID NO: 21780 - DNA, 23 bp, Homo sapiens
ggtcatctgcgagcgcggctagg

SEQ ID NO: 21781 - DNA, 23 bp, Homo sapiens
gtttctggcacatcagaagttgg

SEQ ID NO: 21782 - DNA, 23 bp, Homo sapiens
tgggagcagaacaggtgagatgg

SEQ ID NO: 21783 - DNA, 23 bp, Homo sapiens
taatgagtttctcgagcttgcgg

SEQ ID NO: 21784 - DNA, 23 bp, Homo sapiens
ccgaaatttgggagcagaagagg

SEQ ID NO: 21785 - DNA, 23 bp, Homo sapiens
aatgacaattttctggcgcaagg

SEQ ID NO: 21786 - DNA, 23 bp, Homo sapiens
cccaaaagtccctgttcgtgagg

SEQ ID NO: 21787 - DNA, 23 bp, Homo sapiens
cattcctccacctgtgactgagg

SEQ ID NO: 21788 - DNA, 23 bp, Homo sapiens
tgggctctagctgtactacttgg

SEQ ID NO: 21789 - DNA, 23 bp, Homo sapiens
cacagcatctgaattacttctgg

SEQ ID NO: 21790 - DNA, 23 bp, Homo sapiens
cagaaagaggagaaactgattgg

SEQ ID NO: 21791 - DNA, 23 bp, Homo sapiens
tctcttcactaagagtaaactgg

SEQ ID NO: 21792 - DNA, 23 bp, Homo sapiens
aaattgccttcccaacactgagg

SEQ ID NO: 21793 - DNA, 23 bp, Homo sapiens
cctcccgatggtgccctaggtgg

SEQ ID NO: 21794 - DNA, 23 bp, Homo sapiens
accctggtagatggctgacaggg

SEQ ID NO: 21795 - DNA, 23 bp, Homo sapiens
ggagtggttaaggcataggctgg

SEQ ID NO: 21796 - DNA, 23 bp, Homo sapiens
gaccatcctcttcttcagactgg

SEQ ID NO: 21797 - DNA, 23 bp, Homo sapiens
agttcagttgtctctgtaggcgg

SEQ ID NO: 21798 - DNA, 23 bp, Homo sapiens
gggagaagtcacacgaccatagg

SEQ ID NO: 21799 - DNA, 23 bp, Homo sapiens
ggtagtgaccttcggtgagcagg

SEQ ID NO: 21800 - DNA, 23 bp, Homo sapiens
acagacacttttgccctcagtgg

SEQ ID NO: 21801 - DNA, 23 bp, Homo sapiens
agaggagagactttcttacctgg

SEQ ID NO: 21802 - DNA, 23 bp, Homo sapiens
tggcttacttgagatgcatctgg

SEQ ID NO: 21803 - DNA, 23 bp, Homo sapiens
gcgcgcgcgctcacaccaagagg

SEQ ID NO: 21804 - DNA, 23 bp, Homo sapiens
ccctgactctccaaactttgagg

SEQ ID NO: 21805 - DNA, 23 bp, Homo sapiens
cattgacatcagctcatttctgg

SEQ ID NO: 21806 - DNA, 23 bp, Homo sapiens
cccaggatctcatgaatatgcgg

SEQ ID NO: 21807 - DNA, 23 bp, Homo sapiens
ctatacgactgacctttctgtgg

SEQ ID NO: 21808 - DNA, 23 bp, Homo sapiens
cttgtttgtggctttgtgaaggg

SEQ ID NO: 21809 - DNA, 23 bp, Homo sapiens
tgtagtgaattagagtacagtgg

SEQ ID NO: 21810 - DNA, 23 bp, Homo sapiens
aagttcctgcgcctgctcttggg

SEQ ID NO: 21811 - DNA, 23 bp, Homo sapiens
taaaaccgctttattcaggttgg

SEQ ID NO: 21812 - DNA, 23 bp, Homo sapiens
acagcttgttctcctcgaagagg

SEQ ID NO: 21813 - DNA, 23 bp, Homo sapiens
tctcacatcaagaactctgcagg

SEQ ID NO: 21814 - DNA, 23 bp, Homo sapiens
cacaactgaggagattgagctgg

SEQ ID NO: 21815 - DNA, 23 bp, Homo sapiens
aaggtcatcaggcaccaccacgg

SEQ ID NO: 21816 - DNA, 23 bp, Homo sapiens
gagcgtgttggctatagagaagg

SEQ ID NO: 21817 - DNA, 23 bp, Homo sapiens
gcattacagggttcagctgaagg

SEQ ID NO: 21818 - DNA, 23 bp, Homo sapiens
tgggacctgtgggtctcatgtgg

SEQ ID NO: 21819 - DNA, 23 bp, Homo sapiens
gcagctggaggacatggcttagg

SEQ ID NO: 21820 - DNA, 23 bp, Homo sapiens
gctctcaagttactgacgacagg

SEQ ID NO: 21821 - DNA, 23 bp, Homo sapiens
aggcacattattttagcatcagg

SEQ ID NO: 21822 - DNA, 23 bp, Homo sapiens
cagaaaaagtgatcgccatcagg

SEQ ID NO: 21823 - DNA, 23 bp, Homo sapiens
ttctgacagggatgttgcgaagg

SEQ ID NO: 21824 - DNA, 23 bp, Homo sapiens
ccttccctatagaagttcaatgg

SEQ ID NO: 21825 - DNA, 23 bp, Homo sapiens
tgggctctgactcctacagatgg

SEQ ID NO: 21826 - DNA, 23 bp, Homo sapiens
gccagccgtgagccgtaagccgg

SEQ ID NO: 21827 - DNA, 23 bp, Homo sapiens
acgggagccatgtgcctcagggg

SEQ ID NO: 21828 - DNA, 23 bp, Homo sapiens
ctctaggaaagagtgacctttgg

SEQ ID NO: 21829 - DNA, 23 bp, Homo sapiens
agcgtccctgagacactttaagg

SEQ ID NO: 21830 - DNA, 23 bp, Homo sapiens
caacagacagaaacacaggtagg

SEQ ID NO: 21831 - DNA, 23 bp, Homo sapiens
ttctggatggtatcttcaaaagg

SEQ ID NO: 21832 - DNA, 23 bp, Homo sapiens
gtttgtgcttctgcggcactggg

SEQ ID NO: 21833 - DNA, 23 bp, Homo sapiens
acagcccagcgaacgtgtgaagg

SEQ ID NO: 21834 - DNA, 23 bp, Homo sapiens
ttctgctaggcctggcctcctgg

SEQ ID NO: 21835 - DNA, 23 bp, Homo sapiens
gtgcagctggcaaaggagtaagg

SEQ ID NO: 21836 - DNA, 23 bp, Homo sapiens
ttcttagacactcgacaacatgg

SEQ ID NO: 21837 - DNA, 23 bp, Homo sapiens
tgtgcacgagacatgaatgcagg

SEQ ID NO: 21838 - DNA, 23 bp, Homo sapiens
ccaaggcaagcagactgtgtagg

SEQ ID NO: 21839 - DNA, 23 bp, Homo sapiens
gtcgttcctgcaaagcagtttgg

SEQ ID NO: 21840 - DNA, 23 bp, Homo sapiens
gaagagtccaccatgtaaggagg

SEQ ID NO: 21841 - DNA, 23 bp, Homo sapiens
tcctgccgcactgaatactctgg

SEQ ID NO: 21842 - DNA, 23 bp, Homo sapiens
cccaggaagtgcagcaagtgagg

SEQ ID NO: 21843 - DNA, 23 bp, Homo sapiens
ttcacatcttcacaccatgaagg

SEQ ID NO: 21844 - DNA, 23 bp, Homo sapiens
tcactctagagatagatttctgg

SEQ ID NO: 21845 - DNA, 23 bp, Homo sapiens
cgagtgctactgaaagtcgaagg

SEQ ID NO: 21846 - DNA, 23 bp, Homo sapiens
caggaggtgaagaaattggtggg

SEQ ID NO: 21847 - DNA, 23 bp, Homo sapiens
ctgagaatggactcgggcactgg

SEQ ID NO: 21848 - DNA, 23 bp, Homo sapiens
tgatgaatgggatgactgagtgg

SEQ ID NO: 21849 - DNA, 23 bp, Homo sapiens
caacagcaatacggcgagacagg

SEQ ID NO: 21850 - DNA, 23 bp, Homo sapiens
agcaggcagaaagagttaatcgg

SEQ ID NO: 21851 - DNA, 23 bp, Homo sapiens
ttttcagctgcgcagggttgagg

SEQ ID NO: 21852 - DNA, 23 bp, Homo sapiens
tccgccggcctttgctcagtcgg

SEQ ID NO: 21853 - DNA, 23 bp, Homo sapiens
ggacgactgggaatcgtaggggg

SEQ ID NO: 21854 - DNA, 23 bp, Homo sapiens
ggataccctgtgtgctctactgg

SEQ ID NO: 21855 - DNA, 23 bp, Homo sapiens
gttttctcactttcgccatcagg

SEQ ID NO: 21856 - DNA, 23 bp, Homo sapiens
catccgtatcatttcacaacagg

SEQ ID NO: 21857 - DNA, 23 bp, Homo sapiens
gtacacaaagctacccaggaggg

SEQ ID NO: 21858 - DNA, 23 bp, Homo sapiens
ttttgaggatgatgatgagtggg

SEQ ID NO: 21859 - DNA, 23 bp, Homo sapiens
accctctcaaaactacttatggg

SEQ ID NO: 21860 - DNA, 23 bp, Homo sapiens
gctttcatgaaagagatggaagg

SEQ ID NO: 21861 - DNA, 23 bp, Homo sapiens
ctggcaggacctgctctagctgg

SEQ ID NO: 21862 - DNA, 23 bp, Homo sapiens
agggaggcaggagggcctactgg

SEQ ID NO: 21863 - DNA, 23 bp, Homo sapiens
tccctctgcctcctcttctcagg

SEQ ID NO: 21864 - DNA, 23 bp, Homo sapiens
tctagaaatttaaggcaacgagg

SEQ ID NO: 21865 - DNA, 23 bp, Homo sapiens
tgtgtggctgtgaaggttaacgg

SEQ ID NO: 21866 - DNA, 23 bp, Homo sapiens
ttgtaaccatgtagatggcatgg

SEQ ID NO: 21867 - DNA, 23 bp, Homo sapiens
gcccagctctcagatcagtgcgg

SEQ ID NO: 21868 - DNA, 23 bp, Homo sapiens
gagagtcatcaagacacgactgg

SEQ ID NO: 21869 - DNA, 23 bp, Homo sapiens
atgagagaggttcagaagatggg

SEQ ID NO: 21870 - DNA, 23 bp, Homo sapiens
ctgctggtctgcagatgggtagg

SEQ ID NO: 21871 - DNA, 23 bp, Homo sapiens
ttgcatttaagcaggagtaaagg

SEQ ID NO: 21872 - DNA, 23 bp, Homo sapiens
caacaaaaattagctgggtgtgg

SEQ ID NO: 21873 - DNA, 23 bp, Homo sapiens
gagagaagacggcagagaacagg

SEQ ID NO: 21874 - DNA, 23 bp, Homo sapiens
cgggggtggggctcctcagtagg

SEQ ID NO: 21875 - DNA, 23 bp, Homo sapiens
attaagctgtcactcttcaatgg

SEQ ID NO: 21876 - DNA, 23 bp, Homo sapiens
ttcactttcatgccccaacatgg

SEQ ID NO: 21877 - DNA, 23 bp, Homo sapiens
tggaggcgggagcagaagtaggg

SEQ ID NO: 21878 - DNA, 23 bp, Homo sapiens
ccattctcacctttagggactgg

SEQ ID NO: 21879 - DNA, 23 bp, Homo sapiens
cggggtctccgggcctcacttgg

SEQ ID NO: 21880 - DNA, 23 bp, Homo sapiens
aacggaggaggaactgtgattgg

SEQ ID NO: 21881 - DNA, 23 bp, Homo sapiens
agatatagaagtacagctcccgg

SEQ ID NO: 21882 - DNA, 23 bp, Homo sapiens
atggggaaggcctggtaaagtgg

SEQ ID NO: 21883 - DNA, 23 bp, Homo sapiens
cgctacactacagttccacctgg

SEQ ID NO: 21884 - DNA, 23 bp, Homo sapiens
ctgttgggcacttttagttctgg

SEQ ID NO: 21885 - DNA, 23 bp, Homo sapiens
tttgcttcctgagcttgtctagg

SEQ ID NO: 21886 - DNA, 23 bp, Homo sapiens
ctctgcgagtactcctgacgggg

SEQ ID NO: 21887 - DNA, 23 bp, Homo sapiens
ggggaggggacatgaagatctgg

SEQ ID NO: 21888 - DNA, 23 bp, Homo sapiens
gcagtagcatggatagttgatgg

SEQ ID NO: 21889 - DNA, 23 bp, Homo sapiens
gttactcagctagaaagagctgg

SEQ ID NO: 21890 - DNA, 23 bp, Homo sapiens
ttccccttttttctctgctgagg

SEQ ID NO: 21891 - DNA, 23 bp, Homo sapiens
gaagaggaagaggaaaaagaggg

SEQ ID NO: 21892 - DNA, 23 bp, Homo sapiens
caggaagtggcagcattctgagg

SEQ ID NO: 21893 - DNA, 23 bp, Homo sapiens
cacggggtggtggaaggggtcgg

SEQ ID NO: 21894 - DNA, 23 bp, Homo sapiens
ctgtctgccgcattttgcactgg

SEQ ID NO: 21895 - DNA, 23 bp, Homo sapiens
gttacttcctttctgtcaagagg

SEQ ID NO: 21896 - DNA, 23 bp, Homo sapiens
agcagaggtggcggcctgagggg

SEQ ID NO: 21897 - DNA, 23 bp, Homo sapiens
gccatagtccagtgggataaagg

SEQ ID NO: 21898 - DNA, 23 bp, Homo sapiens
catcccaggtggaagaaaactgg

SEQ ID NO: 21899 - DNA, 23 bp, Homo sapiens
gatgttgatgttccaaccaatgg

SEQ ID NO: 21900 - DNA, 23 bp, Homo sapiens
ggtggttggtgttaggtttgagg

SEQ ID NO: 21901 - DNA, 23 bp, Homo sapiens
caacttagcgtcgcctcccccgg

SEQ ID NO: 21902 - DNA, 23 bp, Homo sapiens
attccttaaactagacagcaagg

SEQ ID NO: 21903 - DNA, 23 bp, Homo sapiens
aaaagatgaagaaaatggcgagg

SEQ ID NO: 21904 - DNA, 23 bp, Homo sapiens
cttctctctgctgacttcactgg

SEQ ID NO: 21905 - DNA, 23 bp, Homo sapiens
catcatcatcacagatgtcaagg

SEQ ID NO: 21906 - DNA, 23 bp, Homo sapiens
ctggagtcacagcttgtcatcgg

SEQ ID NO: 21907 - DNA, 23 bp, Homo sapiens
ctcagcgcacaaatctgtccagg

SEQ ID NO: 21908 - DNA, 23 bp, Homo sapiens
tcaccctctggacttacaatggg

SEQ ID NO: 21909 - DNA, 23 bp, Homo sapiens
gcattagcccagccttcacgtgg

SEQ ID NO: 21910 - DNA, 23 bp, Homo sapiens
ttcatgatgcagaatttccttgg

SEQ ID NO: 21911 - DNA, 23 bp, Homo sapiens
gtcattttctagcgcagcagagg

SEQ ID NO: 21912 - DNA, 23 bp, Homo sapiens
gaaaaagtgaactggctcttggg

SEQ ID NO: 21913 - DNA, 23 bp, Homo sapiens
tctaagtgggatttgctaacagg

SEQ ID NO: 21914 - DNA, 23 bp, Homo sapiens
ctcacacactgctgaatctccgg

SEQ ID NO: 21915 - DNA, 23 bp, Homo sapiens
ggcaactcctttgctgtgactgg

SEQ ID NO: 21916 - DNA, 23 bp, Homo sapiens
ctggggatgacagtgactgaagg

SEQ ID NO: 21917 - DNA, 23 bp, Homo sapiens
gttctgcatcattgtctagatgg

SEQ ID NO: 21918 - DNA, 23 bp, Homo sapiens
tgcatctccctgactcacctcgg

SEQ ID NO: 21919 - DNA, 23 bp, Homo sapiens
ttcagaaagtgctttcaagcagg

SEQ ID NO: 21920 - DNA, 23 bp, Homo sapiens
ctaatgctgctgatgcgatgagg

SEQ ID NO: 21921 - DNA, 23 bp, Homo sapiens
gtttacaactggtatgactgagg

SEQ ID NO: 21922 - DNA, 23 bp, Homo sapiens
gggaaaactgcacaagtagcggg

SEQ ID NO: 21923 - DNA, 23 bp, Homo sapiens
tgtgtctgttggagatgaccagg

SEQ ID NO: 21924 - DNA, 23 bp, Homo sapiens
ggaaggcacgggggcactgaggg

SEQ ID NO: 21925 - DNA, 23 bp, Homo sapiens
agagaaggggtcatacatggagg

SEQ ID NO: 21926 - DNA, 23 bp, Homo sapiens
ttcccagctatacccaagtaagg

SEQ ID NO: 21927 - DNA, 23 bp, Homo sapiens
ggtaacttcactgaccatcctgg

SEQ ID NO: 21928 - DNA, 23 bp, Homo sapiens
tagcttcttgatgtgtctgatgg

SEQ ID NO: 21929 - DNA, 23 bp, Homo sapiens
agcagcattagaccatgaagcgg

SEQ ID NO: 21930 - DNA, 23 bp, Homo sapiens
aagcaaagaatgagccagaatgg

SEQ ID NO: 21931 - DNA, 23 bp, Homo sapiens
aacagcaagtcaaagaatcaagg

SEQ ID NO: 21932 - DNA, 23 bp, Homo sapiens
cccctgcaaggtgtcttaaatgg

SEQ ID NO: 21933 - DNA, 23 bp, Homo sapiens
tggaaagatgctggtgtcagcgg

SEQ ID NO: 21934 - DNA, 23 bp, Homo sapiens
agtgggcacaggggcgtcagggg

SEQ ID NO: 21935 - DNA, 23 bp, Homo sapiens
tccccatctccaaggcttaaagg

SEQ ID NO: 21936 - DNA, 23 bp, Homo sapiens
aaaaacatgtatcttcccgctgg

SEQ ID NO: 21937 - DNA, 23 bp, Homo sapiens
gcaagtgttactgagtagattgg

SEQ ID NO: 21938 - DNA, 23 bp, Homo sapiens
tattcttgtttgggttaccatgg

SEQ ID NO: 21939 - DNA, 23 bp, Homo sapiens
ttatgctgattggtttgacttgg

SEQ ID NO: 21940 - DNA, 23 bp, Homo sapiens
ctcctgcctcagtctatgccagg

SEQ ID NO: 21941 - DNA, 23 bp, Homo sapiens
gcaacagggtcagtcatcaatgg

SEQ ID NO: 21942 - DNA, 23 bp, Homo sapiens
tatgaggcagaggatggagcagg

SEQ ID NO: 21943 - DNA, 23 bp, Homo sapiens
cttctaggctggtatcaccatgg

SEQ ID NO: 21944 - DNA, 23 bp, Homo sapiens
cccccttttcccttttagggtgg

SEQ ID NO: 21945 - DNA, 23 bp, Homo sapiens
ctccctccccatccctgacctgg

SEQ ID NO: 21946 - DNA, 23 bp, Homo sapiens
ggggccccgcgggatcaggccgg

SEQ ID NO: 21947 - DNA, 23 bp, Homo sapiens
gttgctcccactctctaatttgg

SEQ ID NO: 21948 - DNA, 23 bp, Homo sapiens
accgccgccaaggggaagcaagg

SEQ ID NO: 21949 - DNA, 23 bp, Homo sapiens
tactatgaactcgtactcgttgg

SEQ ID NO: 21950 - DNA, 23 bp, Homo sapiens
cagtccctgctgcatctcagagg

SEQ ID NO: 21951 - DNA, 23 bp, Homo sapiens
gggcaagtcatcaggctttatgg

SEQ ID NO: 21952 - DNA, 23 bp, Homo sapiens
ggcagacttactacttccagagg

SEQ ID NO: 21953 - DNA, 23 bp, Homo sapiens
cgatcagtactctcaccgtttgg

SEQ ID NO: 21954 - DNA, 23 bp, Homo sapiens
agagagaacttcaagaagtgagg

SEQ ID NO: 21955 - DNA, 23 bp, Homo sapiens
acctgtaaatgaggctaaaaagg

SEQ ID NO: 21956 - DNA, 23 bp, Homo sapiens
ccctgacacctacagctgaccgg

SEQ ID NO: 21957 - DNA, 23 bp, Homo sapiens
aatggccatcaatagatggctgg

SEQ ID NO: 21958 - DNA, 23 bp, Homo sapiens
ccagggctggagggtctagctgg

SEQ ID NO: 21959 - DNA, 23 bp, Homo sapiens
tccgaatttacacatcggtttgg

SEQ ID NO: 21960 - DNA, 23 bp, Homo sapiens
atatagtaaggctgacagagcgg

SEQ ID NO: 21961 - DNA, 23 bp, Homo sapiens
agcgtgagcctctgcattaaagg

SEQ ID NO: 21962 - DNA, 23 bp, Homo sapiens
tgcttctgttgtccccttccagg

SEQ ID NO: 21963 - DNA, 23 bp, Homo sapiens
tgcatgagcatcctgtgagtggg

SEQ ID NO: 21964 - DNA, 23 bp, Homo sapiens
gaggataccgtgacaagatgagg

SEQ ID NO: 21965 - DNA, 23 bp, Homo sapiens
tgtatgagcatcctatgagtggg

SEQ ID NO: 21966 - DNA, 23 bp, Homo sapiens
acggttttagtaatctccactgg

SEQ ID NO: 21967 - DNA, 23 bp, Homo sapiens
aggacccagcatcatttctgagg

SEQ ID NO: 21968 - DNA, 23 bp, Homo sapiens
tctaggaaatatgcctcagttgg

SEQ ID NO: 21969 - DNA, 23 bp, Homo sapiens
tcagaaattgggagtgacacagg

SEQ ID NO: 21970 - DNA, 23 bp, Homo sapiens
aatcagcacagctagggcaccgg

SEQ ID NO: 21971 - DNA, 23 bp, Homo sapiens
gattgccgggatcctgccagagg

SEQ ID NO: 21972 - DNA, 23 bp, Homo sapiens
gttattcaagctcctccttatgg

SEQ ID NO: 21973 - DNA, 23 bp, Homo sapiens
acattgtggactgaaatgtatgg

SEQ ID NO: 21974 - DNA, 23 bp, Homo sapiens
tctacttactattcaacgtctgg

SEQ ID NO: 21975 - DNA, 23 bp, Homo sapiens
gatcggccaatagaatctagggg

SEQ ID NO: 21976 - DNA, 23 bp, Homo sapiens
gcccctgcgggggctagtcctgg

SEQ ID NO: 21977 - DNA, 23 bp, Homo sapiens
gacgtcctcaaggagtttcttgg

SEQ ID NO: 21978 - DNA, 23 bp, Homo sapiens
ccattcctgtcggcggcctgagg

SEQ ID NO: 21979 - DNA, 23 bp, Homo sapiens
ccctggccagtgggatggttagg

SEQ ID NO: 21980 - DNA, 23 bp, Homo sapiens
agttcaatgtgatgctctagagg

SEQ ID NO: 21981 - DNA, 23 bp, Homo sapiens
cacctgaatccaattacatctgg

SEQ ID NO: 21982 - DNA, 23 bp, Homo sapiens
agagcaggcaaagatcacctcgg

SEQ ID NO: 21983 - DNA, 23 bp, Homo sapiens
agccaggcttcacctgagaatgg

SEQ ID NO: 21984 - DNA, 23 bp, Homo sapiens
cagagctctgatgacatcaaagg

SEQ ID NO: 21985 - DNA, 23 bp, Homo sapiens
ttgtgccgtggaaatcagaaggg

SEQ ID NO: 21986 - DNA, 23 bp, Homo sapiens
agcacccgcccatgattcttcgg

SEQ ID NO: 21987 - DNA, 23 bp, Homo sapiens
gtggagtttgcatggacaatagg

SEQ ID NO: 21988 - DNA, 23 bp, Homo sapiens
tcagaaattgccaactaggcagg

SEQ ID NO: 21989 - DNA, 23 bp, Homo sapiens
accaggcagcgtgttaatattgg

SEQ ID NO: 21990 - DNA, 23 bp, Homo sapiens
attcccagcccggctctagaagg

SEQ ID NO: 21991 - DNA, 23 bp, Homo sapiens
agctcagaaaatatatctccagg

SEQ ID NO: 21992 - DNA, 23 bp, Homo sapiens
ggcacagacagcggcggcagagg

SEQ ID NO: 21993 - DNA, 23 bp, Homo sapiens
atcaatgacaacgcagcttctgg

SEQ ID NO: 21994 - DNA, 23 bp, Homo sapiens
caaggaggcccaggagtaggagg

SEQ ID NO: 21995 - DNA, 23 bp, Homo sapiens
ttaatgtctctaggtctaagtgg

SEQ ID NO: 21996 - DNA, 23 bp, Homo sapiens
gcgtctaggcggggtcagtcagg

SEQ ID NO: 21997 - DNA, 23 bp, Homo sapiens
ttcagaccctgttcgctcctagg

SEQ ID NO: 21998 - DNA, 23 bp, Homo sapiens
actctgattcatttaggaccagg

SEQ ID NO: 21999 - DNA, 23 bp, Homo sapiens
cattcgccggggatgttggcagg

SEQ ID NO: 22000 - DNA, 23 bp, Homo sapiens
gtactgcacgagtgtctgtgagg

SEQ ID NO: 22001 - DNA, 23 bp, Homo sapiens
ggtcagcgtctgcaagtgagcgg

SEQ ID NO: 22002 - DNA, 23 bp, Homo sapiens
gggtgaatgtgtgtaagtgaggg

SEQ ID NO: 22003 - DNA, 23 bp, Homo sapiens
gagcgctatgtctgcaagtgagg

SEQ ID NO: 22004 - DNA, 23 bp, Homo sapiens
ggagtggttacttgcaagtgtgg

SEQ ID NO: 22005 - DNA, 23 bp, Homo sapiens
cgcctgctggggtcatgtagcgg

SEQ ID NO: 22006 - DNA, 23 bp, Homo sapiens
ggtatctgtgtgttcaggtttgg

SEQ ID NO: 22007 - DNA, 23 bp, Homo sapiens
gacgtgcacacctgcaagtaggg

SEQ ID NO: 22008 - DNA, 23 bp, Homo sapiens
cgacgtgcacacctgcaagtagg

SEQ ID NO: 22009 - DNA, 23 bp, Homo sapiens
agggctaggcaggcggtcatcgg

SEQ ID NO: 22010 - DNA, 23 bp, Homo sapiens
ccagtttgtgtgcaagtagtggg

SEQ ID NO: 22011 - DNA, 23 bp, Homo sapiens
cagtacatctgtaaatagcccgg

SEQ ID NO: 22012 - DNA, 23 bp, Homo sapiens
gcggccgggcggcgggtcacagg

SEQ ID NO: 22013 - DNA, 23 bp, Homo sapiens
caacacgtgcagcgagcgcacgg

SEQ ID NO: 22014 - DNA, 23 bp, Homo sapiens
gaggtcttcacctgcaagtgagg

SEQ ID NO: 22015 - DNA, 23 bp, Homo sapiens
agtgcccagtccctgggtaaggg

SEQ ID NO: 22016 - DNA, 23 bp, Homo sapiens
cagcatagatttgtagccacagg

SEQ ID NO: 22017 - DNA, 23 bp, Homo sapiens
aacccgggagaaaaccctaaggg

SEQ ID NO: 22018 - DNA, 23 bp, Homo sapiens
cctgggaactcagcccttgcagg

SEQ ID NO: 22019 - DNA, 23 bp, Homo sapiens
tctcagctgcctgagtaactggg

SEQ ID NO: 22020 - DNA, 23 bp, Homo sapiens
tgtgtacacctgcaagcactagg

SEQ ID NO: 22021 - DNA, 23 bp, Homo sapiens
gtgggtgagctgatataaaaagg

SEQ ID NO: 22022 - DNA, 23 bp, Homo sapiens
tagtgcaccgctgctacgtgtgg

SEQ ID NO: 22023 - DNA, 23 bp, Homo sapiens
cttcatccgttcagctgaacagg

SEQ ID NO: 22024 - DNA, 23 bp, Homo sapiens
attctgttgagtttggtttgtgg

SEQ ID NO: 22025 - DNA, 23 bp, Homo sapiens
ggaggtctttttagttaagctgg

SEQ ID NO: 22026 - DNA, 23 bp, Homo sapiens
tagatttcttcaagcagaggagg

SEQ ID NO: 22027 - DNA, 23 bp, Homo sapiens
gccgattccttccaagcttttgg

SEQ ID NO: 22028 - DNA, 23 bp, Homo sapiens
tgaaagagttcctcacatacagg

SEQ ID NO: 22029 - DNA, 23 bp, Homo sapiens
ggagtatgtgcccagatgatagg

SEQ ID NO: 22030 - DNA, 23 bp, Homo sapiens
cctgtgtggacgcatcatcttgg

SEQ ID NO: 22031 - DNA, 23 bp, Homo sapiens
actccagctggcgctttgagggg

SEQ ID NO: 22032 - DNA, 23 bp, Homo sapiens
ggactcaagtgtaaatgtacagg

SEQ ID NO: 22033 - DNA, 23 bp, Homo sapiens
aagtgtctacatgttctagaagg

SEQ ID NO: 22034 - DNA, 23 bp, Homo sapiens
cctggaagtttacgcctgatagg

SEQ ID NO: 22035 - DNA, 23 bp, Homo sapiens
catcattgctgcctgtctcgtgg

SEQ ID NO: 22036 - DNA, 23 bp, Homo sapiens
cacgtcactgagctctgagcagg

SEQ ID NO: 22037 - DNA, 23 bp, Homo sapiens
acgtcatctgcagagagagctgg

SEQ ID NO: 22038 - DNA, 23 bp, Homo sapiens
tgtaatcacacatcatcagctgg

SEQ ID NO: 22039 - DNA, 23 bp, Homo sapiens
tcccagccgacgacgtctgatgg

SEQ ID NO: 22040 - DNA, 23 bp, Homo sapiens
tggcagccagtccggctaagtgg

SEQ ID NO: 22041 - DNA, 23 bp, Homo sapiens
tttattctgcacttttctggcgg

SEQ ID NO: 22042 - DNA, 23 bp, Homo sapiens
atagaagagacagagggatttgg

SEQ ID NO: 22043 - DNA, 23 bp, Homo sapiens
ggagaccgagggctttggacagg

SEQ ID NO: 22044 - DNA, 23 bp, Homo sapiens
tctcagttgatgacctaccctgg

SEQ ID NO: 22045 - DNA, 23 bp, Homo sapiens
caatggtagtgattacagccagg

SEQ ID NO: 22046 - DNA, 23 bp, Homo sapiens
ggacgggtcagtcttccttcagg

SEQ ID NO: 22047 - DNA, 23 bp, Homo sapiens
cggtggttagcttcatcaaaagg

SEQ ID NO: 22048 - DNA, 23 bp, Homo sapiens
cactgtaaaatgccagaagcagg

SEQ ID NO: 22049 - DNA, 23 bp, Homo sapiens
ggatttgggttccggcgtcaagg

SEQ ID NO: 22050 - DNA, 23 bp, Homo sapiens
aagggaaatcacaggtttaaagg

SEQ ID NO: 22051 - DNA, 23 bp, Homo sapiens
attttggcagaatcttcccctgg

SEQ ID NO: 22052 - DNA, 23 bp, Homo sapiens
gttgtcttcgtttaaagctgtgg

SEQ ID NO: 22053 - DNA, 23 bp, Homo sapiens
ccccagctgattagtgtctaagg

SEQ ID NO: 22054 - DNA, 23 bp, Homo sapiens
ttcattaatggcttccagcttgg

SEQ ID NO: 22055 - DNA, 23 bp, Homo sapiens
aatacagctgtgactctgactgg

SEQ ID NO: 22056 - DNA, 23 bp, Homo sapiens
ccagagactactagccagtcagg

SEQ ID NO: 22057 - DNA, 23 bp, Homo sapiens
gggcgcctccttctactgagggg

SEQ ID NO: 22058 - DNA, 23 bp, Homo sapiens
ctgcaaaccctggtctgtgaggg

SEQ ID NO: 22059 - DNA, 23 bp, Homo sapiens
gtggtggtggtgacactgctggg

SEQ ID NO: 22060 - DNA, 23 bp, Homo sapiens
agtaatgactgtgtagcacatgg

SEQ ID NO: 22061 - DNA, 23 bp, Homo sapiens
ctgtcacagcagctttctggggg

SEQ ID NO: 22062 - DNA, 23 bp, Homo sapiens
tgggaggcggtgggcctcactgg

SEQ ID NO: 22063 - DNA, 23 bp, Homo sapiens
aattctgcttgtctgccactagg

SEQ ID NO: 22064 - DNA, 23 bp, Homo sapiens
gcagtcagaacaactcacggtgg

SEQ ID NO: 22065 - DNA, 23 bp, Homo sapiens
agatctctgctctgcttaatggg

SEQ ID NO: 22066 - DNA, 23 bp, Homo sapiens
tgtcactcctgcaatagggttgg

SEQ ID NO: 22067 - DNA, 23 bp, Homo sapiens
tgcccttattcaggagcggttgg

SEQ ID NO: 22068 - DNA, 23 bp, Homo sapiens
tgtggtcagatgaaaaaactcgg

SEQ ID NO: 22069 - DNA, 23 bp, Homo sapiens
catactgtagcaactcatagagg

SEQ ID NO: 22070 - DNA, 23 bp, Homo sapiens
ggagtatgagaccacagtgtagg

SEQ ID NO: 22071 - DNA, 23 bp, Homo sapiens
tgcttcgccagtgaagggatagg

SEQ ID NO: 22072 - DNA, 23 bp, Homo sapiens
tttgtttctgcacttctgtttgg

SEQ ID NO: 22073 - DNA, 23 bp, Homo sapiens
caccctttgagactgaagcaagg

SEQ ID NO: 22074 - DNA, 23 bp, Homo sapiens
tccagcatggtgggtaagtatgg

SEQ ID NO: 22075 - DNA, 23 bp, Homo sapiens
cgtaagacttgtactatgtgtgg

SEQ ID NO: 22076 - DNA, 23 bp, Homo sapiens
tcagctcacagctgctcaaatgg

SEQ ID NO: 22077 - DNA, 23 bp, Homo sapiens
gccgccaggaagctctcgagtgg

SEQ ID NO: 22078 - DNA, 23 bp, Homo sapiens
ttacaaaaacaaaaccggggagg

SEQ ID NO: 22079 - DNA, 23 bp, Homo sapiens
tccttggctggagtgtctagagg

SEQ ID NO: 22080 - DNA, 23 bp, Homo sapiens
gcagtgaaggtcaagaagcctgg

SEQ ID NO: 22081 - DNA, 23 bp, Homo sapiens
taccagcttcccgagtagctggg

SEQ ID NO: 22082 - DNA, 23 bp, Homo sapiens
atttcttctggaatctcatgtgg

SEQ ID NO: 22083 - DNA, 23 bp, Homo sapiens
gctggatcggaagcagaagatgg

SEQ ID NO: 22084 - DNA, 23 bp, Homo sapiens
cttgattcagggttcaaagatgg

SEQ ID NO: 22085 - DNA, 23 bp, Homo sapiens
ccctggcactgtgaagctctagg

SEQ ID NO: 22086 - DNA, 23 bp, Homo sapiens
attgctattcacgccataagtgg

SEQ ID NO: 22087 - DNA, 23 bp, Homo sapiens
ttccagagagcaaagccctgagg

SEQ ID NO: 22088 - DNA, 23 bp, Homo sapiens
atccaaggctcgtgacactaagg

SEQ ID NO: 22089 - DNA, 23 bp, Homo sapiens
gccctttacagcactcacaaagg

SEQ ID NO: 22090 - DNA, 23 bp, Homo sapiens
tagcacatacttcaggcttgcgg

SEQ ID NO: 22091 - DNA, 23 bp, Homo sapiens
ggcagcaactggtgaagcacagg

SEQ ID NO: 22092 - DNA, 23 bp, Homo sapiens
gggacccagtcccactgacacgg

SEQ ID NO: 22093 - DNA, 23 bp, Homo sapiens
atctcatcaaagaggtcttctgg

SEQ ID NO: 22094 - DNA, 23 bp, Homo sapiens
ctgattttgcttccatcacacgg

SEQ ID NO: 22095 - DNA, 23 bp, Homo sapiens
atttgaagaaggtggtgatgtgg

SEQ ID NO: 22096 - DNA, 23 bp, Homo sapiens
gcgcggcctctggtcagtcctgg

SEQ ID NO: 22097 - DNA, 23 bp, Homo sapiens
aagagccaaatttactcagaagg

SEQ ID NO: 22098 - DNA, 23 bp, Homo sapiens
atattacatgacgaagatggggg

SEQ ID NO: 22099 - DNA, 23 bp, Homo sapiens
caccctcaggaagatacaattgg

SEQ ID NO: 22100 - DNA, 23 bp, Homo sapiens
cccacagccagtgactcacaagg

SEQ ID NO: 22101 - DNA, 23 bp, Homo sapiens
ccagtggacagaacggcggctgg

SEQ ID NO: 22102 - DNA, 23 bp, Homo sapiens
cactcccatcccggaggactagg

SEQ ID NO: 22103 - DNA, 23 bp, Homo sapiens
aggattgctttaacagtactcgg

SEQ ID NO: 22104 - DNA, 23 bp, Homo sapiens
cgggggcctccggagtgaacagg

SEQ ID NO: 22105 - DNA, 23 bp, Homo sapiens
tactgattgtgctttacatgagg

SEQ ID NO: 22106 - DNA, 23 bp, Homo sapiens
gtgcccagtgctacctgagccgg

SEQ ID NO: 22107 - DNA, 23 bp, Homo sapiens
gacgggcgactcaggtagcaggg

SEQ ID NO: 22108 - DNA, 23 bp, Homo sapiens
gccagtttagttaaacagctggg

SEQ ID NO: 22109 - DNA, 23 bp, Homo sapiens
tgaaaaatgtgtttcggagttgg

SEQ ID NO: 22110 - DNA, 23 bp, Homo sapiens
ggagaagcctcatcattgaatgg

SEQ ID NO: 22111 - DNA, 23 bp, Homo sapiens
cctagtttaaaagaggcttgagg

SEQ ID NO: 22112 - DNA, 23 bp, Homo sapiens
gctttctttatctagcttggtgg

SEQ ID NO: 22113 - DNA, 23 bp, Homo sapiens
cctgtaaatcgctgaaagggggg

SEQ ID NO: 22114 - DNA, 23 bp, Homo sapiens
tctcaggatttgttacttgttgg

SEQ ID NO: 22115 - DNA, 23 bp, Homo sapiens
gcctcttcggagggagctgaggg

SEQ ID NO: 22116 - DNA, 23 bp, Homo sapiens
tgacgtcctgactgtaagcgggg

SEQ ID NO: 22117 - DNA, 23 bp, Homo sapiens
tcccgaggctgagcagggcgggg

SEQ ID NO: 22118 - DNA, 23 bp, Homo sapiens
agttgagttggaatcactccagg

SEQ ID NO: 22119 - DNA, 23 bp, Homo sapiens
gttactcagcactgctctgctgg

SEQ ID NO: 22120 - DNA, 23 bp, Homo sapiens
tgtctgtagggggtcagagtagg

SEQ ID NO: 22121 - DNA, 23 bp, Homo sapiens
gggcacctcactccgctcactgg

SEQ ID NO: 22122 - DNA, 23 bp, Homo sapiens
tactgtggctttcccagagatgg

SEQ ID NO: 22123 - DNA, 23 bp, Homo sapiens
ctttgagattgcagagcttaagg

SEQ ID NO: 22124 - DNA, 23 bp, Homo sapiens
acagagccacagtaccagccagg

SEQ ID NO: 22125 - DNA, 23 bp, Homo sapiens
atctggggccagggggtcaccgg

SEQ ID NO: 22126 - DNA, 23 bp, Homo sapiens
agatcttcagccgcagcgtccgg

SEQ ID NO: 22127 - DNA, 23 bp, Homo sapiens
gcgggcgcgctcaccgcaccagg

SEQ ID NO: 22128 - DNA, 23 bp, Homo sapiens
gcagccaagtccagctaatgagg

SEQ ID NO: 22129 - DNA, 23 bp, Homo sapiens
tccctggccccctcctaggaagg

SEQ ID NO: 22130 - DNA, 23 bp, Homo sapiens
ggtggggtcagtgtgactgcagg

SEQ ID NO: 22131 - DNA, 23 bp, Homo sapiens
agtgctgcttcattgttagtggg

SEQ ID NO: 22132 - DNA, 23 bp, Homo sapiens
tatccttgcgctttgttatatgg

SEQ ID NO: 22133 - DNA, 23 bp, Homo sapiens
ttcccattcctgatttactgagg

SEQ ID NO: 22134 - DNA, 23 bp, Homo sapiens
tacccttgtgccatactttatgg

SEQ ID NO: 22135 - DNA, 23 bp, Homo sapiens
cacgggcaccgactgcgtcgcgg

SEQ ID NO: 22136 - DNA, 23 bp, Homo sapiens
tggcaggctgcatcacatgatgg

SEQ ID NO: 22137 - DNA, 23 bp, Homo sapiens
gattgagggctttttcagccagg

SEQ ID NO: 22138 - DNA, 23 bp, Homo sapiens
tgttcttgaggggaaaaagttgg

SEQ ID NO: 22139 - DNA, 23 bp, Homo sapiens
aggtcacacttctccaaagttgg

SEQ ID NO: 22140 - DNA, 23 bp, Homo sapiens
aggaatgaagactcactcaaagg

SEQ ID NO: 22141 - DNA, 23 bp, Homo sapiens
ggacaatggctgggactgattgg

SEQ ID NO: 22142 - DNA, 23 bp, Homo sapiens
catgatcaaagacaacggctggg

SEQ ID NO: 22143 - DNA, 23 bp, Homo sapiens
ggacaacggctgggactgagggg

SEQ ID NO: 22144 - DNA, 23 bp, Homo sapiens
tcgagagagtgagggctttgagg

SEQ ID NO: 22145 - DNA, 23 bp, Homo sapiens
cctgcttcccagagtttcacagg

SEQ ID NO: 22146 - DNA, 23 bp, Homo sapiens
gacagagaccgaggggagagagg

SEQ ID NO: 22147 - DNA, 23 bp, Homo sapiens
agttgtgtttttttctcccaagg

SEQ ID NO: 22148 - DNA, 23 bp, Homo sapiens
agagtcgaaacaaacaatgaggg

SEQ ID NO: 22149 - DNA, 23 bp, Homo sapiens
tcaaggtcgtgggaaataaaagg

SEQ ID NO: 22150 - DNA, 23 bp, Homo sapiens
agaggaggaagccatgcgtaggg

SEQ ID NO: 22151 - DNA, 23 bp, Homo sapiens
gacgaaggagacgctggggaggg

SEQ ID NO: 22152 - DNA, 23 bp, Homo sapiens
taaagaagcgctgcaggacgtgg

SEQ ID NO: 22153 - DNA, 23 bp, Homo sapiens
ggcggcgaaggcaacaattaagg

SEQ ID NO: 22154 - DNA, 23 bp, Homo sapiens
caggatgaagaagcaggagaagg

SEQ ID NO: 22155 - DNA, 23 bp, Homo sapiens
agaatgtgatgcggcagaagggg

SEQ ID NO: 22156 - DNA, 23 bp, Homo sapiens
agaaggaggggaaaattaaccgg

SEQ ID NO: 22157 - DNA, 23 bp, Homo sapiens
gtcttctctcttcttttcactgg

SEQ ID NO: 22158 - DNA, 23 bp, Homo sapiens
gatgctacagaggaaatcagtgg

SEQ ID NO: 22159 - DNA, 23 bp, Homo sapiens
gctgatggtgctagagaggtagg

SEQ ID NO: 22160 - DNA, 23 bp, Homo sapiens
accaaaaacaacccgtgaaaagg

SEQ ID NO: 22161 - DNA, 23 bp, Homo sapiens
aggcggcctagactgtaaagggg

SEQ ID NO: 22162 - DNA, 23 bp, Homo sapiens
agcttactgttgacagagtgagg

SEQ ID NO: 22163 - DNA, 23 bp, Homo sapiens
tcaaaactgagcaacttaacagg

SEQ ID NO: 22164 - DNA, 23 bp, Homo sapiens
ggcagcgggagctcaggcacagg

SEQ ID NO: 22165 - DNA, 23 bp, Homo sapiens
gaagctgaaagtgctgtcacagg

SEQ ID NO: 22166 - DNA, 23 bp, Homo sapiens
aaagctgtaaatattgccacagg

SEQ ID NO: 22167 - DNA, 23 bp, Homo sapiens
cttctggcttctgtttattgcgg

SEQ ID NO: 22168 - DNA, 23 bp, Homo sapiens
aacatgtcatcacactaccgtgg

SEQ ID NO: 22169 - DNA, 23 bp, Homo sapiens
gacagcagcttcctgtagcgagg

SEQ ID NO: 22170 - DNA, 23 bp, Homo sapiens
tggaagggatgtactgctgcagg

SEQ ID NO: 22171 - DNA, 23 bp, Homo sapiens
ggaagtggccacacccctacagg

SEQ ID NO: 22172 - DNA, 23 bp, Homo sapiens
tggccaatccaggctcatgatgg

SEQ ID NO: 22173 - DNA, 23 bp, Homo sapiens
ctaagtcggattcgcatatgagg

SEQ ID NO: 22174 - DNA, 23 bp, Homo sapiens
tgaacaacttcattctgctcagg

SEQ ID NO: 22175 - DNA, 23 bp, Homo sapiens
ggcaaagatgctttcagagaagg

SEQ ID NO: 22176 - DNA, 23 bp, Homo sapiens
tcaatgatgtccgagaaacgagg

SEQ ID NO: 22177 - DNA, 23 bp, Homo sapiens
ttgatgacaatgctaccctcagg

SEQ ID NO: 22178 - DNA, 23 bp, Homo sapiens
aggggagctggtggggaggtggg

SEQ ID NO: 22179 - DNA, 23 bp, Homo sapiens
ctgggtgggggcaaagggtaggg

SEQ ID NO: 22180 - DNA, 23 bp, Homo sapiens
cagatctctcacttctccacagg

SEQ ID NO: 22181 - DNA, 23 bp, Homo sapiens
tcaggttcttttcaaatgcttgg

SEQ ID NO: 22182 - DNA, 23 bp, Homo sapiens
ccctctcgatgggatgaatcagg

SEQ ID NO: 22183 - DNA, 23 bp, Homo sapiens
gaggtagcacatatttcaggagg

SEQ ID NO: 22184 - DNA, 23 bp, Homo sapiens
ctccacgcctgcgcggctagcgg

SEQ ID NO: 22185 - DNA, 23 bp, Homo sapiens
agacgatagcctgtagctagagg

SEQ ID NO: 22186 - DNA, 23 bp, Homo sapiens
ctacctgtgctatgtgtgaaggg

SEQ ID NO: 22187 - DNA, 23 bp, Homo sapiens
cccccgcctgccgagtgagctgg

SEQ ID NO: 22188 - DNA, 23 bp, Homo sapiens
aagatagctctcaagaactttgg

SEQ ID NO: 22189 - DNA, 23 bp, Homo sapiens
tgacattcagtctagtaagacgg

SEQ ID NO: 22190 - DNA, 23 bp, Homo sapiens
atgaggatgcatgtgtctgacgg

SEQ ID NO: 22191 - DNA, 23 bp, Homo sapiens
tcaagactgcatttagtctttgg

SEQ ID NO: 22192 - DNA, 23 bp, Homo sapiens
ggtggaggagcaaactgaagggg

SEQ ID NO: 22193 - DNA, 23 bp, Homo sapiens
ttacaggtcagctctgctcctgg

SEQ ID NO: 22194 - DNA, 23 bp, Homo sapiens
ttgcagtgtgttgcagaattggg

SEQ ID NO: 22195 - DNA, 23 bp, Homo sapiens
agagaagctgctactcaactagg

SEQ ID NO: 22196 - DNA, 23 bp, Homo sapiens
gacggcctgagccagggctaagg

SEQ ID NO: 22197 - DNA, 23 bp, Homo sapiens
agtacttgtgtgaattgagtagg

SEQ ID NO: 22198 - DNA, 23 bp, Homo sapiens
gccccaaaaactaacatctaagg

SEQ ID NO: 22199 - DNA, 23 bp, Homo sapiens
tcttcctccaccacctgacgggg

SEQ ID NO: 22200 - DNA, 23 bp, Homo sapiens
aaaggagtttagtaagactctgg

SEQ ID NO: 22201 - DNA, 23 bp, Homo sapiens
tctgatgctcccgattaagatgg

SEQ ID NO: 22202 - DNA, 23 bp, Homo sapiens
agaactgctttggtggttggagg

SEQ ID NO: 22203 - DNA, 23 bp, Homo sapiens
caacaagcagtgaagttgacagg

SEQ ID NO: 22204 - DNA, 23 bp, Homo sapiens
tccccctggatgtttcagtctgg

SEQ ID NO: 22205 - DNA, 23 bp, Homo sapiens
ttctaattcttgccactcaaagg

SEQ ID NO: 22206 - DNA, 23 bp, Homo sapiens
aagaacccggacagttgactggg

SEQ ID NO: 22207 - DNA, 23 bp, Homo sapiens
gaacccagaagggcgatgtgggg

(The sequence listing continues in the following parts.)

What is claimed is:

1. A method of determining the distribution of protein levels in a population of cells, said method comprising:
    a) sorting a library of cells into at least two groups based on expression of the detectable marker in each cell; and
    b) nucleic acid sequencing of the cells in each group, wherein the tagged target genes in each group are determined;
    wherein the library of cells comprises a plurality of cells, wherein each cell comprises a polynucleotide sequence encoding a protein tag integrated into the genome of the cell in frame with a protein coding gene selected from a set of target genes, wherein the library comprises more than one cell tagged at each target gene;
    wherein the library of cells is treated with a perturbation prior to determining expression of proteins, wherein the perturbation comprises a small molecule, protein, RNAi, CRISPR system, TALE system, Zn finger system, meganuclease, pathogen, allergen, recombinant virus, temperature, salt, lipid, biomolecule, a pool of any perturbation thereof, or any combination thereof; and
    wherein the protein tag is a detectable marker and the cell library is for use in detecting the distribution of protein levels in single cells comprising a plurality of cells.

2. The method according to claim 1, wherein the sequencing comprises PCR amplification of the UMIs with primers specific to the polynucleotide sequence encoding a detectable marker; or
    wherein the sequencing comprises transcription of the tagged gene by T7 polymerase, cDNA production, and sequencing of the cDNA; or
    wherein the sequencing comprises tagmentation with Tn5, PCR amplification; and/or
    wherein the localization of proteins is determined by further sorting the cells based on cleavage of the cleavable marker by the protease localized to a cellular compartment; or wherein the localization of proteins is determined by comparing the distribution of protein levels of tagged genes between sorted cells and sorted nuclei obtained from the library.

3. The method of claim 1 for use in identifying cell cycle regulated proteins; or
    for use in identifying or confirming drug targets that are not regulated at the transcript level.

4. The method of claim 1, further comprising transferring the library to an in vivo model and recovering the cells before the step of sorting.

5. The method of claim 1, wherein the cell library is for use in detecting protein interactions between a protein of interest and a set of target proteins, wherein each cell comprises a first polynucleotide sequence encoding a first protein tag that is a complementary protein integrated into the genome of the cell in frame with the protein of interest or comprises a first polynucleotide sequence encoding a fusion protein of the first complementary protein and protein of interest, wherein each cell comprises a second polynucleotide sequence encoding a second protein tag that is a complementary protein integrated into the genome of the cell in frame with a protein coding gene selected from the set of target genes, wherein the library comprises more than one cell tagged at a target gene, whereby an interaction between the protein of interest and a target gene can be detected with a detectable marker.

6. The method of claim 5, wherein the second polynucleotide sequence further comprises a codon-neutral unique molecular identifier (UMI) sequence or a non-coding UMI after the detectable marker coding sequence.

7. The method of claim 6, wherein the library is sequence-verified, such that each UMI identifies a tagged target gene.

8. The method of claim 7, wherein:
    a) the first and second complementary proteins comprise protein complementary assay (PCA) fragments, preferably, wherein the PCA fragments comprise split fluorescent protein fragments or split TEV fragments; or
    b) one of the first or second complementary proteins comprises a permuted inactive reporter and the other complementary protein comprises TEV; or
    c) the first and second complementary proteins comprise a different epitope tag, whereby interaction may be detected by proximity ligation; or
    d) one of the first or second complementary proteins comprises one or more TEV cleavage sites followed by one or more epitopes and the other complementary protein comprises TEV.

9. The method of claim 6, wherein the second polynucleotide sequence comprises a selectable marker operably linked to a separate regulatory element; or wherein the polynucleotide sequence comprises an IRES or a 2A peptide, whereby the selectable marker is expressed as a separate protein; and/or
  wherein the second polynucleotide sequence comprises a T7 RNA polymerase promoter;
  and/or wherein each cell comprises a sequence encoding a guide sequence specific for the tagged target gene, whereby detection of the sequence indicates the tagged target gene; and/or
  wherein the library comprises eukaryotic cells; and/or
  wherein the cells of the library were generated from cells configured to express a CRISPR enzyme; or wherein the cells of the library were generated from cells obtained from a transgenic animal configured to express a CRISPR enzyme.

10. The method of claim 1, wherein the cell library is for use in detecting protein modifications comprising a plurality of cells, wherein each cell stably expresses a protein tag that is a fusion protein comprising a protein modification binding protein fused to a first complementary protein, wherein each cell comprises a polynucleotide sequence encoding a second protein tag that is a complementary protein integrated into the genome of the cell in frame with a protein coding gene selected from the set of target genes, wherein the library comprises more than one cell tagged at each target gene and wherein binding of a protein modification binding protein to a target gene protein can be detected with a detectable marker.

11. The method of claim 10, wherein the polynucleotide sequence further comprises a codon-neutral unique molecular identifier (UMI) sequence or a non-coding UMI after the detectable marker coding sequence.

12. The method of claim 10, wherein:
  a) the first and second complementary proteins comprise protein complementary assay (PCA) fragments, preferably, wherein the PCA fragments comprise split fluorescent protein fragments or split TEV fragments; or
  b) one of the first or second complementary proteins comprises a permuted inactive reporter and the other complementary protein comprises TEV; or
  c) the first and second complementary proteins comprise a different epitope tag, whereby protein modification may be detected by proximity ligation; or
  d) one of the first or second complementary proteins comprises one or more TEV cleavage sites followed by one or more epitopes and the other complementary protein comprises TEV.

13. The method of claim 10, wherein the polynucleotide sequence comprises a selectable marker operably linked to a separate regulatory element; and/or
  wherein the polynucleotide sequence comprises a T7 RNA polymerase promoter; and/or
  wherein each cell comprises a sequence encoding a guide sequence specific for the tagged target gene, whereby detection of the sequence indicates the tagged target gene; and/or
  wherein the library comprises eukaryotic cells; and/or
  wherein the cells of the library were generated from cells configured to express a CRISPR enzyme; or the cells of the library were generated from cells obtained from a transgenic animal configured to express a CRISPR enzyme.

14. The method according to claim 2, wherein the PCR amplification comprises a nested PCR and sequencing the PCR products.

15. The method according to claim 2, comprising linear amplification (LAM).

16. The method according to claim 2, wherein the PCR amplification comprises nested PCR and sequencing of the amplified DNA.

17. The method according to claim 2, wherein the nuclei are fixed.

* * * * *